United States Patent 10,724,096 (METHODS AND COMPOSITIONS FOR INHIBITING AND TREATING NEUROLOGICAL CONDITIONS) - sequence listing, part 70

SEQ ID NO: 1517 - DNA, 856338 bp, Homo sapiens
actatcgagaagcagatgacaggctcaggccttaccagggatgcacttgccacattttggaaagactacataaaaaacctttaaaaattggagccctttgggcctcaggtatccaaagagcacattttttggaaactcaacactcaggaaggtcgcatagagccagtttatgcaggtgagtattttgctcactcttataaggtccttataaggtcctcttcatgtctggtttggttctccttttcatgccctggtgagtttccctgttccccatatatgagtgactcttttttaaggtacctttaatcttttcttcatttagtttgtcagttaaccatgaagggctttttgctcaaagtttggtttcaatgttcatcataaaaatgacatcccaaaggagaaaatttacttttctatattttacacaaaaagagaatactagtaaatattgctaataattaaaatagtatatatatatatgtgttttcatagttttatagatttttaaacattgaatgatattcttagcgttttaaacagattatatctcattattgtgtgttaccattaggcaacaatgaaatgtttaaaatatttttaaagtattgtattttagttgtatcgagacatataagcctttcttaatttaggggaacaggaataagactacccactagacaattgaatctctggcctacagccaaattttacagagtttagatttaatgcttatcactttttttaagtgattattctttttaatttccctaagtcccccaaattagttttttgatatttactttttctgtgattattttgagaagtttccaatctttattttattttactttatttttgagacagggtctttctctattgcccaggctggagtgcagtggcatgatcatggcttattgcagcctctgccttctgggctcaagtaatcctcccatctcaccctcctgagtagctgggactagaggtgcacaccatcacatctggctaatttttatattttttgtagagacgggtttttgccatgttgcccagcctggtcttgaactcctggactcaagcaattttcctgccttggcctggcctcctttttttttttttttttttgagacggagtcttgctctgtcacccaggctggagtgcaatggttcagtctcagcttactgtaaactccacctcccaggttcaagcgattctcctgcttcagcctcctgagtagctgagactacaggcgtgtaccaccacaccggctaatttctgtattttcagtagagacggggtttcactatgttggccagacaggtctcgaactcctgacctcgtgatccacccgcctcagcctcccagagtgtttgaattacaggcatgagccaacgcacccagcctctcagcctccttaagtgctgggattacaaggtgtgagccactgtgcctggccagaagtttccaatttttaaaagttaaggtagttcttaattttctaattataagcattgccaacgcgtcagttctaagtgaatatgtttattagaaggcataataaaaagcaaaaattcgtcataaatttactgctcagagataattattgcttacatttgacacttggcatttttattattttttatacctatttatttacatttgtatactagagatcactggatatacaactgagcgtcttcatgttttcaataaaatactatatcattagtattatcctgtgtaaactttctcataattattatttaataatggtataatattcctttgggttaatggactataattcatttcactgctcccttgtggttggcagtttattttttcccaatttctcttttgtatagaatcctgtgagggcaatttttatgaaccccacaatttacatttacaaagttatttccatagaagagactccgtagagtgtagcaatctgctgggaactagaagcatatcaaaggctcttgacatgtgactccaccagtgcttatgtgtgcttatctcatggcctcctgactgggttcgagtttcatagattgttcagtcttttctaatagttgttttaaatttaatgtcattgaatagtggcttcattgagcattttttttcaaatgtgaattagcatctggacttctttttttttttttttttgtacgtgatctacatccttttagatagtggcaactggacagatgtaacattaatctgcactgtaggccaagtgcagtggctgatgcctgcaatcctagcactttgggaggctgaggtgagaggattacttgagtccaacccggccaatatagagacctcatgtctacaaaaagttaaaaaagttagccaggcatggttgtgcatgcctatagtcccagctacttgggggactgaggtgggaggatcactctgagcctgggaggtcgaagctgcagtgagctgtgatcgcaccaatgcactccagcctaggcaacagaaaaagatcctgtctcaaaaaaacaaaaaacaaacaacaacaacaaaaacactgtgtaaatgtatgtatgtgtgactccaggtgacttatttaacctctttgaatttccattctttcatttgcaaaatgacgataataatgaagacttcacagagtagtaagaattaaatgagatattataagcataatacttagcacaattcctggcagtggtaaagagccgttaaatgactttgttataattgttactaaaattataattaacattttttcaagtatctattggggaaatagatattttctattggcgtacatgagctttttatggattaaatacattattcatttgtcatatttgcttatggaaatattttccagtttgttcatgctgttttaaagtttgttaaattattttacctctgtttctgtgttttgtcaaaatgaggaccaaataagttgttacagcacttaacagaaacaaaaagtagccacaaccctttgggcatcctctaagcatttggtcattactatcattagcatcaggggacaggaatataaagagcatacagcacctactattcaataatgaggcagaagtcaagttgaaaagttcagttctgaagatgtcattcataatgataccaactcagattgtagttattttcaagtctaaacacttaaacatttattagagtaaataaccgttaaaaataagaggagaaaaattatcttctttcaagaacctgcctccaaatttatcttaacctctgaaatgcggccttcgtagtttcagctaaggccttgtttcatcagcatactgggtcataagttgaagaagaaaaaaactggagtaaaaaacttgaggtttcagatagtctcccccaccctctgggaattcactggtgactgatttaaatactgaaacttcacatgctactttgatgactatatattcagtcaccttcctttggattaaattgccatactcttattttttcaatctggttttctttgcaatgtttgaccctgtcacccaattacctcatttttggtggggtaaaggtgagaaaagatcaaatcactgttagtagctgcagaggctttaaaagactcatttaccagtatggttgtatcatgtttaaatttctaaatggctaagcaacatgtgccactctctgagtagacttaaaatgatgaaactaagtgaaaccatattaactacgtaaggggatcactaggatcccaggttgtgctatttgctagcaatcattacagtttatttaaactccgtgtgctagaaagttataaaatggcacaaggcatgatcccgatttgtagttcagagactaaatctatgagatttcactataggtaatctaactggtatttgtttaagttacagatacaatcagagcagcccttctcaaactttaatgtttatacagatcctctatacatctttttaacatgcagattctgattcagtgggcctgagattctgcatttgtaacaagctctcaggagatgcccctgttgctagaccatggaccacactttgagtaacaaggggttagaagcaaattatcaactgggagtacataaataattcactaggaagctcattaaacacagatttccaatgctactcccagagactgatttagcaggtttagggtggggccccaagatttcgaattcccaaccacctcccaggtgctgctgctgctgctgatctgcaaaccataatttgggtagctttaatttagaagtactcaaactccctgcatctcggacataaagcaaaagttaattatggtgagatgaaacatgggttagtggaaagtctcttaggttgtctagaaggaaactgggttctttgacacagagcttctctacagatctcagtttcctcacctgtaaaataagccaaatgatgagtgcccccctccccagatatctaacataccaagcagatgaatacacttttaatttgacacataagttttaactattttggccatgtctcctctaacattcgcaggacccaggacaagagtacaaatggacacctaatgccatatggataaacatttagtagttatacattaagccaacaagtacatgagacaatgatacaaattgcttattattgcaataggtgacttagccaatacgtgcaactgtcacacattcaactctaattcatgaatactgcccaagaccacagtttgttacatgaaagaaattgagatggatagttgtttctcctaggaaacaacactttattatttgagaatcttttgcacttaaggtattttagagaaaggatttgacaggttaattaattatttttccccttacctaagcacttctattgctaagtcctccctccactctgaaagggtgtccatctctgatgtctgcatttgcacaatccacaaccctttgtgacattcaaatgcagtctccttttattctgagatacaggaaaagagatgtaagcacctccctggggtctgaacagtgttaatgatgagatcagatgtttaggattatacatcacattctgccagagctgaacactgaatcccagtgaccaaagtaaattggcatgtgtataaaatacaggacccacggaaggggcacctatttattggatctagggcagtattattttggtggtcataagggaactgatacctgaacctgaatatcactcaaagatcactcatggtgcctgatatttggaagagacatttgaaggaccagacgaaccacttattcttttagatgctctaaaattgaaccgtataaaaagtagactatgccgaagtcatatcattttagctacatggagaaatcttgttccaaatcaagagataatgatataccctctggttctttgatgacagtgtggtggctatatgcagaatgtttctgcaccatttgcataactactgcttaagatatccactatgtcattcaatatcccttatatgagagttcaatgaggtagacgtccttaaatttactatcaggttaagaaaagagcagattgtctctttggacaacttcgtgtatttctttctttagctgcctggaagctcaacactaaatttagtattcatctgcaatacttgactcagcccatggtttttacacattaatatttcttttctctaaatgccttgttggaattgtacttttaagttcatctattttttaaaatgatttaaaataatcacattaacccaggaagaagcagcatataaaagaaaggaaagaaacaaactgtttaatgacctatcttgctgggttcctacaactcaagtgggaaaatatgtgcatggtagaattatgcaaattactgtgtaaaacttcctataatttgaaaggtattatgatattttatctacctcatgacccaagatggctgctggagttccagccatcatcaggttagagtatgtcagtgtagacagaaagaaaaaggaaagtcagaagagcaaaatgaaatcattttgatgtttttagcttttccagaagctctatgagacacttggtcacatgaccacatctactggcatggactactgaaaaatgtaacattttattcctggcaacagtgaacttagctaaatattaagtttctgttactttgaagaaagaagaaaaaatagatatagaaaatttcaatccctgccacaattctttgttcatattgggatgggaacttgttaattttttgttgtagaaatcacacatttggtttttcaaattgtcataaagttttaaaatatctgatgccacattggatagatttttattcaaatattttccacattttagacattcaaatcttacatcgcaaattagtataatttttaacaacaaagtaaatgagacggacaagacaagagacagataacttccagaattgttcatgtacaatttggctttgtttggggattgaatcaatggtttattttcataaatattgatttcttttcctggttgttttatgaaccgagtgggaagggccattgtattcagtctttgttttgttttcatttagtcacagagtgcagcagtgattgtggataattccttgactatttgtactttagattcacatcagatgataaattgagcatgagaaatatgttattaaattgactgcattgtaaattggcactttacattttttatttataaacatggtaccttttactcaatatccaggaaactttggataaatatgaatttccattaacttatgtgttaactgccaaaagctattatttatatctgaaatgaactaaactaagataatttaatcttctagtccaaggtcaagtgcattacaataaaacatgtttcatgaataaacatcattaaaaacacacagccattacatagcagtttttcataacacaaaaatctgcaaattgagtaagcaaaatctccactcactgaacttttaaaaatcctatgttaaattaataatctcacttcttctaagattatatactttattttttacacacagatagtaatgaatagatattcattgattctgatgtaggtggtgtataagtgactacgtttgtgtgtatgtgagtgtgaatggtataaaatattgtgctttgggaaagtcaaaattgggaatggatttaatgtctgtgtatcaatcaaccatgatatcaatgatgcacttataactcccttccccaataataggttttactttattaatcataattttttggtgggggtcactattagaaatttccattgtccaattttctcaccatgaccagccaagcatctatcacttgtttttaacttctcaactagttttcacaatttgttgtcctgtaaagtaataaatggcccaaattttccacacgctaattaaaattccatttctcatgaattctttaatcgagtgcaagtcattatgtgctttgttgatatcttaagtgcaaagataattgcaatgggcagcgtgaaaagggtttgattattgcctgtcgacgcttgtgaattctaataggtctaattgcatagcatcaattcatcatctcagcatcacttctttttattattagctctctgaattgtaatgtgctcataaagaagtgttgtagtatatcagagatgacatggtacctggcctattataattttcagcccttaccttgtgcaactcttgaaattaaaagtttattatggagtgccctttttctgaaactaattttaaaatgctcctgtatgatgaaatgaatactgtccaataatctacatattaatttgcctttgtaataattccattaaatgactgccaagacctttttcgctcagattgtgcctataaattcagaacataatgcattagttggaaaacatttgttaggctttttaatgggaattcctggtagcatttctcagagaatttctatactagagtgactatcctaaggctaaagaaagaaaaagattccactgcataatgatgtagaatcttccacgcaccccaataatatgactaaaggaccaccagcaattgagttgccaaacaccctatcatttgcatgtagggaatagaacagccctagtgtagagaaggaaagtaaacctttaattactctacagataaaataatgttctatatatgtgaggaagtgtgtctaataataatagacacaaatggggacttacaccctgtgtcaaacactgtactttaatcgttatctcaaataatctcagggattcttatgaataaagtttcagtgtgataattttacaggcaagtctcaaaatatcaccgaagatcaccagatggtatgtggcaaagctggaatttaaacatctagacagaagactcccatagcttgtctgctattttcaacacacactatggcatgactcagtcaaattaatgccatcagaatcagtaacagtgaactttggaagaaggatgatcatactgttaaagtgtgagtccaagtaaacccaaaaactaaatcacacttcaggggcttctatttttttttttaggataatatggtcagaagtaattataatccatgttaaggaatgagtcaagttcctagaaggagcatccatacagcaaatattccaagagatcaaggcaaaaccggtgaggcttatcaccttctgttggaagtctgacaacagccaacttagctaaatactaagtttctgttacttcaaagaaagaagagaaaatagatacaggtctgttggaagtctggcaacagccaacttagctaaatactaagtttctgttacttcaaagaaagaagagaaaatagatagaggtagagaatttaaatccctgccacaaattctttgttggtgttgggatggaaacttgttaattttttgctatagtaacaatatatttgattttacagaatcacttcaagatattttattggttttaagtattgggaagggatttatactccagcttttgttaaaggagtggcaaggccacattgccaaaaagcaaatgagctgagacatattgttttgggcatctctgggtaatacagcctgccacagggaatgagtcaacttggtgttactgcttgttgggcagtaaagcaatttgcaaggaagcagtcccccagcaggtataaattattgtttcaaacatctctctgaaaattactgtaatgagaaggtacccctttgccttgtgtgtgtgtgtgtgatgacaagcaaaagtaaaacttaattcattttctacagatcaaatgtttggttcttttttaaaaaaactttcaaactacgtggtttaggtataaatattttattgaatatattggttcatttccaaatataaaaaaaatcaagaagcaaatatggattctaaatttgctgtaccataagtaatttgcaatgaaacctacatctgaatagagaaataaattaccactcaaaaatttccattacttatgttctactttgaaaatcataggttggaacttacatggagctattgcttattctgtttaaaaagtatatagtcattctggttttaagaatttgagtaaaatttacagaataaaatgcaaaaatcttaaatataccatctggagttttgattacgtacatacatcaatcaatgtggagaatatttccatcacatcagaaagcattttatattaagtaatttttattgttctattttccctcatggccaatccagtgaatctttacctctcaaaggcactgctctgacctctatcaccatgaattatttttttcttttcttaatgtaaatggaaccatacacaatgtactctttgtgtctattttgttcagcatgaagtctttcatattatctatgttttttttttttttttttttttttttgagacggagtctcgctctgtcgcccaggccggactgcggactgcagtggcgcaatctcggctcactgcaagctccacctcccgggttcacgccattctcctgcctcagcctcccgagtagctgggactacaggcgcccgccaccgcgcccggctaattttttgtatttttagtagagacggggtttcaccttgttagccaggatggcctcgatctcctgacctcatgatccacccgcctcggcctcccaaagtgctgggattacaggcgtgagccaccgcgcccggcccatattatctatgttgtcacatgtatcaatgttcattattcttcattggtcagtagtatttcattgtatgaagcacaattagttcttccattctcccatatttttgctttttctgctattttttctagtttcctgatgcctcaaaattatttccttcatcacaccctctctgtttcaagaactttagccattcttgtagggtaggtctggtctgctcatgacaaattattttagttttcctttgtctgagaatgtcttcatttcccccttcattcctgaaggataagtttgctggatataggattctgggtttgacagagttttaattttatcatttgaaacatattttgccacttctttctggcccccattacttcttttgtttgtttgtttgtttctggtttttttttttttttttttttcagagatggagtctctgctctgttggccaggctgcagtgcagtggcatgatctcagcttactgcaacctctgcctcccaggttcaagtgactctcctgactcagcctcccgagtagctgggactacaggtgtgtgccaccacgcctggctaatttttgtattttcagtagagacggggtttcaccgtgttagccaggatggtctcaaactcctgacctcgtgatctgcccacctcggcctgccaaagtggtgggattacaggtgtgagccacatcacctgacccctctggcccccattacttctgatgaggaatccactgtaatttaaatggtttttctccaatatagataaggattcatttctgttttgctgcattcaagattttttctttgtttttagttttcagatgtttatattttgtcttagcatgaattcctttttgttgtattcagttaagttcactaaactttttgaatctataggttatatcattggccaaatgtgggaaatttgcagtcattatttctttgaatactattttagccccactttctttctgttcttctgagatttcagtgatatgattttagatcttttgtaatagtttcacaggtccctgaaactctattttttttgacgtttgtttagcctattttctattttctccttgttttccactttaaataatttctattgtcctgtcttcaagttcactgattcttccctctgtcctctccattatgctattgagtccagccactgagttttttatttcagttattgtattttttggttctaaaattttcatttggttcttctttacatcttctcttctttgctgagactttctatctgtttgtttgtttcaagcatgtacataactgtttattggagcatttttaaaaatgatggttcctttaaaatcttagttttaacacctgtgtcatctctttgttgggtctgttgattgcctattctaattcaagttgagattttcctggttcttggtataatgagtgattttatataataccctgtatgttataagactctggatctttttaaaatcttgacttagcagactttctctgaaactgtatcacactcacagggaaaggggattctgcctcattacaactgccatgttgtaggggtgaaggtccagttcctctttcggcttcctttgacactccagggaggcaggggtgttttctttctgctgagaagagttgggatttcagaccctgctgggcttcagctagtgccaccttggctgggaggggaaacattgtcttgttactactccccagttagcttccactgacccagtagtgaggaggcctgctgggtggtagtaaaagtgccagcttcctatgtggtctgctctgacattatatggggaggggggttgttaccaccagcaagggctgaaattggcttcctaaccagcctcctctgataccactcaggacaggaagtgcctcggtacagtgaggtgcaggtagaaatctcagctccccactggacctttgatgacaggggaagggatgaagccttggctttgtctgtgctgtatggttggaataggatagtttttatctttctgttttgttaggtcatccctttcctgtggtggtggtggtggtggtggtggtggtatttatttatttatttatttatttatttattttttagtctgctcttgttagcatttctgggttgctggcttctttgggacccaggctgaaatctgttaggcaaaaagaaaacccagaaaactcatcaccgtgttggtcctatgggctgccttcttctgttcacctttcagagtcttcttatatttgttttatgtatactgtccagggtttttagttatagttagcaggaggaatagggagaagtccatctgttcaatcctagtccagagctagatattttttgcttttctgtgagtattttaaatactaggtcttggtgagtgctaaagttaggaaaagatgaaaataaccttaggcttagaacagtgcttgccacatgttaagcactcagtgaggatcatcttattctctttgtacaatcctagtgtctctgaaattctaatcttcttttgtaggacaggttacgcccaggtttggaagaggggtgcaaagggagacatatccaaaatcctcacctcactagtggatgcagaaaccttcccagcatttcttaatacacatcacagaggtagctgttcctggcctgttcatgcttgtggctgacagtacatgcatatgtataaacacacataaaacctccaacttttacatattgatgaagacaaacaaacctaaggccaagacatacagactctgaaaatctttccagaaggacataggaagggatctacttcagttcctaagaggatggtaacttttgcctatgaatgtttgacctaatgttttctaatgccaggatggttctccatagagtttatttgtaaaataaaacattgtgctttctatggagactctttgtaattctattcctaaagaaatccctgtgatcagctaacataaccacatctgagggcttcagatcttctgatggacttgtgtcttttccaagcatcactgtagttcatctctctctcactatttatgaactccacgtacattttcactgctgtcaattgactagtttgcactgaaatatccaagcaagctttgtgaaaaaatggaagtggctctcagtccttagatttgtaggcagttgtgtatggcacatagttttctttactatatgttctttccagttattggtaagaaaggcagtcacagaggatttgtccagtgggactccagtggcaaaggtttatctgactctttccagtagcactaaaaacacccctggacagatttcatggagttaacagactctgttttcctggtcttatttagaagtattgccttccgtgttttgcatattctgggcacagtcaatatcaaataattaaccatttcatctgttcaagcagccatccaccatctactaactgtcatgctcctgaatttacaggcacgtccagcaccgtttcttttattcttttcttctgtttttttttttttttttggtttattttgtttagcttttgttatggtttagacttgtgtctctgcccaaattttatatcgaattgtaatccccagtgttagaggaagggcctggtgagagctgtttagatcatgggggcagatttcccccttgctcttcctgtgatagtgagttctcatgagatcgttgtttaaaagtgtgtagcacctccatactctctctcttttctcctgctccagccatgtaagatgtacctgcttccccttagccttccactatgattataagtttctggagccctccaagccatgctgcctgtacagcctgtgaagccatgagccaattaaaccacttttctttataagttacccagtctcaggtatttctttatagcagtacgagaatggactaatacagcttttttcaaacgtacaattcagtggtgttggcacattcacagagttgtacaactgtcaacaccactatctaattccagaatatttttgttgccttaaaaaagattctatacccattagtagtcagtgttcattcccccttccccactccttgacaaccattaatctacattctgcctctgtggatttgcctattctggacatcttatataaatggaattatatactatattctcttttgtctctgttttccttaacttagcataagatttccatggttcactcatattgtagcatttatcagtactgctttcctttttatggctaaataatattccattagatggatatacatttggttattcattcatcagttgatggacattgagttgtttccattttgagctattataaataacgcagctgatgtggtttagatctttgtcccctccagatctcatattgaaatgtaatccccaatgttggaggtgtggcctggtgggaggtgttttggtcatgcaggtggatcctttataaatggcttggtgccgtcctcacagtaatgagtgagttatcactctatgagtccacgtgagagctggttgtttaaaagatgctggaatttcttcctcactctcttgctctgtctctcgtctcttaccatgtggcatactagctcccctttgccttccaccatgatcgtaagcgtcctgagtccctcaccagaagcagatgctggtgtcgtgcttcctgtacagcctgcagaactgggaaccaaaataaacctcttttctttttaaattacccagcctcaggtgttcctttatagcaatgcagatggactcataaaacagctatgaatatttgcatataagtttttgtgtggacatgtgttgtcagttctcttgggtagatcctagcagtggaattgttgagtgatatggtaactctgtgtttaacattttgaggaactaactgttttccaaagtggcatttccattcctatcactgatgtatgagggttttaatttctccacatactaacacttattaatatctgcctttttgttgatagccttcctaatgagtgtgaaatgtcatctcattgtagttttgatttgcatttccggaagaactaaggatattgagcactatttcatgtacttattggccatttgtgtatcttctttacaaccatttctcaaacccttctttgactcctccttaaatctattaaaagacaaattacatgcttagcttttttccttcattttggcctgttcactttttggcttattttagaagtatgctttctttaaacttcctttcttctcacaattagtgcacatgcacaccctgatctttttataatttaaattatttcaactaatgtctcaattaatgtcatcaatgctctgttgacatttaatccagaatgagctcttcctactgcaaaatgagctctttttttggcgctttgttataatttatgagaactaaagtagagagtagacaagttttacttttggacaagttttgcttccacatggaaggatttaaaatgatagcttgtcattagtgtgtgcgacaacagggcaaggcaagccaggagaggcaacacaggtcaaggtcattaacacaatataatgaatgaaagatcatagctgtgggtgcagttggtgtgagtctggtggacaaaaacaaggtcagagtcttgggtgccaagctgacactcaaatatcagtgatgggtaaaattttggtaagagagctgtacactgccatatagtacaactctacatttgacattttgagtctagtctagactggtagttttcaacctgtggttcctaggccagcagcatcagcagcatctgggaacttgttaaaaatgcaaatcctttttctccacccctactccattccagacctactactgaaatagaaatactgagagtgtgacctagaaactcatgttttgttttaccagaacctttagatggttttgatcgccctcaagtttgaaaactactgaccaagacttttaaggaggtgcaaaaagaaaaggtggttggagatgtcgccagagtttaggattaagtgagaacacacaacaacaagggtatggctgtagccaaaagcaagttaagcatagcccatgctacactgctaccatggaattaggcaacattcacttagccagaatttacttagtgactggttgttggaataggagagtgggccctagaatgaaggagacctgattattctggtgcagggaggttcaaggagagcaacccacgtccttacttgtcttcaatttgttatccctagtgtatcaggcattctgcttgttaaagggatctgttatattttcttctttggacttaaattactcagtataaataatcagcctcattctgcatgcattaatgaactccattagaaggagggaccattttttttttcctatgttggttaaggaggcctcttagcaaaatctaaagggaggtcttctccccaaagaattgtttttgtaggccttttccagtcaagaactgtgacagagattgagtttatgctgggtgcagggaaacatggagtaagtcacgtccataaaggtgaaggaaggccaatgttttggcatgggtaagttgctaagtacagtgtgggtgcatctggctctcacccttattccttgagtgaagtcattcatccaagttggcaagagcaggtcataggaaaaatgaggacatctggaagagtaaatggtttgtgagaggggccatctctcagataggcccataggctttctctggaaggatgtcagaaagccacatttatcagaagctgcaaacacagccagccatgtcctaggaaggacagtgctctttctatcacaagagaattccaagggcaattttctgttttctttttttttttattttttgtttttttgtggagacacggtctccataaaagaaaccagattggtcttaaattcctggcctcaactgatccttctgccttgtcctcccaaagttccgggattacaggtgtgagccatggctcccacccccttcttttctgacagtaggaaaaataaaaacacttttatttcatttccagcttctgtgctttctccagctctttttcctatctgaagaagtacacaaaaaatatctatgtgacaaagctcccaagccaggatccagtatgactttatttttctctggctgtgtccaggatcatggtgacttgacccatttagaggaatgccaccatatgctgctagcaactgctgaggtttggcatttcacaggtttctcagaacctaagaactaagtgaggactccaagaatattccatggactctaagtccatggctagattcccaggcccagaggatacatttggaaaaggaccaaagttgtcgtcatgaaattctatacattgcaagcctgtaatcccagcactttgggaggccgagatgggaggatcgcttgaggccagaacttcaagaccagcatggtcatcatagcaagattccatctctaaaaaaacaaaacaaaatgaaacaaaacaaattatataaaaagaacattaaaatgcaagaaataacaaaacatatttgatttaatcttgtgaaaactttcatattttcctaccaataaaattgtctatgacaattcctttagaatggttaatttggttgtttaggatttttattgtatagcagtgtcaaacacattcttgccattcacttattctgttaaagagaactattgacactctcctaactgttgctccttcaggaggagataagcagtaagactgttaaaattctatcaaaatactctattgatatcatgtgctgcggcttcaaaacactactcagtaaggatgctttggaaagtaactcagctgcctaatgtgtttctgctttaaaatatctctgggcagctaagtttgtaacaaggcatataaatctaatgtttagggtaaaaataaatatcccttttggtccaagcagtttaaatagtacttgtaattaatgcataataattaggtatctaaaaacaactcttcaaaactgaactatagttttctggcaaatgtgtaaatccatgtttatttaaagtgtattatatttataaaagatgaggtataaaataaatcgggcttaaaacaatgctgtcatcaattctaaatgaagcactatgaaacagctagttcaaagtcatgaaaatattgaatattttttttctcctttttctcctgtattttgtgtgtgtgtgtgtgtgtgtgtgtgtgtgtgtgtgtgtgtgtgtattttcaaccaggaagcatatgcttttttatcatgttgggaaaataaaatcctaccttttaaccttaaaaaaactatgaagatcttagcaatttctacaattcagttgtttgttaggtgaggaatacattccttgttaaaatatctatttgcataatttggtgagcaattacattactagtgttcttttcttatttgagatactctcccaaggaattgattatttgcattacaaataaaaccctgatgaaaatacataaaatacataaaatttgtataaaactatatatttatataagttatcagaaaaaagtgtgaaggcatatgttaagtgaattaaaatccactaagggcttgttattaccaagtcttgacctaggcaacaaacatatttatatccagtcaaaaggttggtagagaaaataattacatatgacaaaagtagaagttataaaaatgatgttccagtaagaagagaaagaacaaccagagaataaaaattcttggaaataagaacaaaagtttcagaatgaaagaatgcatgatggaaaggaaacagctgaagacttactgtaccagaagaataagtcaaggaaatactctataatgtacagcagataaaatatttgagagaaaatcaaaggaaatgagatttactcctagacatataaactcgcctattaagagttctagaaagaatggagaaaatgaaagagtagtaataattttataactagaaggagaaaaatgtcctgtcctgaataaggcatggtgaaagttcaaaatcccaagtataaaaaacagttagaaagaatgaataagacctactatttgataatagtacaaaggaactatagtcaataataatttaattgtacattttaatataactaaaaagtataattggattgtttataacacaaagggtaaatgcttgaggggatggataccccattattcatgatgtgattattacatattacatgcctgtatcaaaatattttatgtaccccagaaatatatacacctactatgtacccacaaaattaaaaattaaaaaatttaaaaactgagaaaagaatttcaaggataaataggaagttgataaaacttctggaaaggagaaaaaataaaaataaaaaacagcttacttatggaggtataaaaataaaactgtctttttctcacagtagacgtgaatgaagaaaaatcttcaacattcggagagaaaaaataatttttaaaaattagaaattgagtatcttacataacaaaagaaatgagtagtattacggaagtctccaatttcttcccttttcatgtttttaaacccactctatattgcactttgtcctcaggcttcgaccctcacgacggtaagctgactgtgacagcgacaaactttcacactgagaagtcaaaggcagaaatgatggggattattttcctcactcatcttattttgagagtaagcgcttttctcagaagacgcccgtgaaactgctcctcacattctctgcccatttgcttctcaccacagtctatcctttttctttgcttcatttttctccttagcacttgtcactgtttgacacactatgtattttacatctttcttgagaaaaattaattttgaacctggaagcatatatgtcagaaagacagcattcagaattgagaacaaattaaaaacatttggaaatgcagtggcttaggaaatttccagccacagaccatctctgaaagaattactcaagaatatacaccacccgcaacaacaaaaaatgagtttaagagtgagaagaccaggcatccaagaagtagtagaagcaaagaaaccagtaatatgtcagttctgacataattggttaatatgtataatcatgaactttgagagtataatgatgaaatattgactaaatagagaagaatgtattcctatcccatgtatgcacgtggtaaatgcaactacgtagaagtactagtgataagtagtacttctcatcacctcccacatgccaggtactcgacttgatgctttcacatataatacataatttattccccacacaacaaacttgacaagcagatattatcctattttttagagaggaagaaaagtaatttgccccagttcacacagtgagtgagtggagtgtgctgttgggttatggagacttgtttttcttgctctctcctgatatcatgctgtctgataataattacacattctattgatcttttttttctgatattgtcagctactgctgtgtaacatattttcctactcataccaaatcttcccatttttactgccgctaatttctttcattatagtgcctctcaagccattttctcatatcatctcaaccacaaccccatttctaaataaagaacgaaaattgttattaattgacctgcatgacaacagtatattatcagggagccagtcaccagatattatttattttcaggtttttttttctttttaaacctgatactcatcaaagcctgcatgcaaacatttcattcttggcatctgaattactgtggaaaggtctcttggttttcttcgagtgcttttacattaatggtttctactaaataatctcgcagaggcacatgttgacctctgtgctcttagtctcgtaatgaattatgttggaaaggctcagtgatatattctcttcccctcactgattctatgtcaggcccaaaataggcaaagaaagggaaaagttaaaaaagaaaacctgtcttgatactgaacaaaatgagttattttttattgtccttttttcttttactcttaactaacacttctcttattcttgtcccctttctgcatcttatttctatgttgaggataggctctcagaagacctgacaagcactgcagtaactcacaccccaattctatttccattctatttccctatttctgttactaactcagtcacttagagtcaagctccttgaaatcaatttttacactttgttttctcttttcccatccactctaaaaccatcatcacagtttgccagttcaactctaagattcttgaacggtctgcctctctttttcacgccttggactctgctttcatgtcagctgatctcttcccttttgtagcctccaattcattctgcaaaggagtaagcatgaggaagtaaaactactgtcatgattttgcatgggaattcatgttcccaaagaatatctcttggctttactccatgatgtcttatagaattcttgtttaaaaagctgctcccacccttctcttctccatgtgaatcagtgtatctgatagcagtcatgttggacttttttccttgagtctttgcaaactctttaagaagtgcttttccattctcaagaggatggtgagtggaaataccccgattatctcaaagaagaggaaaaagcaattactccggattttgaagattgagcagaaaacaattgcatttagttaaaattactcttaaaaatcccagcactttgggaggtcgaggtgggtggatcatgaggtcaggagatcaacaccatcctggctaacatggtgaaacacttgtctctactaaaaatacaaaaaattagccaggcgtggcggcgtgtgcctgtagtcccagctactcaggaggctgaggcaggagaatggcatgaacccgggaggcggagcttgcagtgatccgagatagcgccactgcactccagcctgggcgacagagcgagactccgtctcaaaaaaaaaaaatcccttaacctacataaaagtgaaattggtgacataccagttcaaaataagttcaatacaaatgattctccctatggagtcgaaagacatcactgtttcttcaaacttgaggacagataaaatagttaatgatgttgcattggaaaagtaaatattatttattagatctgcacagtgagaagctataatgtagcagttctgaaagtgtcaccagaaagtttgaaaatagctctagtgcacagtaaacccattatctctgaaaagtaggtgaggatattgactgatctactgggcccagcaatgtaagccaccctgctcctactcctgctgtaacactcactcatttaaataaatttaaataaattgcccttattatttaaatattttatcattctcagtccaccaacactttgttcatattgttgaatttaaatgagttgaacttgtaaaataatgtaacttcacagtatagaaattttcacatattcttttggctagaagttatgttaatgtaattcttgaagtagcctcttctcatttgtcttttctaaatacaacagttccttaagaaaatgagatgtagggcctggagtgaagacgtagagcctaggtttagtgcagagctgtcctatgaatggatcaatttcagagagaaatcagatccgctttattttggtggagaggtggattcattatatctaaatgctactttttaaagaaatgtgaatagtgagcccattaattccttcagagggtgtctagaaagtctgtcatgttccattttgtgatttgagagccaaaacctatctctaaaacaaagcagatttattctaaaatgagcaatatgcagatgagggaaatgacaggtttagagaatgcacttatttaatcatctcctgaaaaaaaaaaaaaaaaggcaaagggatcactgcacattttttttttttttctgtttgagtctttggatagaatctcatagcttttgttaaagagtgtgatagtgttagaatcttatttttaaatcttccatagtgcagtcattaggagatttttgatgaggttttgatgagtctttctatgaagaaacagcttttcagctctataaaatgtatgctgaatgagctgaaccagtataactagatgccattgcttgcccagtctagattatcccttctacctcattgttttctctaatctggtacatcattcctgattagattgattatatcgggccaacttttatttaatcacccacagattcactaattatccattaagcaactgttcccatagaattcttggctttgtgggaaacacagacatagatttgtcatattccctgcagtggaagcatcgagtcactgcaggaaaacagaaatcacagaatcatgacattgcagagttagcaagaatcttgggacataggtagtcatatcggattgccttgaatgatagggcattccctgctgcctaaggcaggatgccatatgattggagagctctgaccgatggaaacttctcagaaatgttcgtgttcaaagtcatattaatggtttatcgtaagtgatattatagagcaacagaggtgaagtgaattcaaactctgttcatatagaggaatttatggatctcatctttaaggaagcgaaattcttcacagtgtaggaatctccatgagaaactatttcataagaagaattttcagagaaaaaaatggggggggctctccagaaatggggaaagtcctgtagtcagaaaagcacagacctgtttggtgagagtcatggaacaattgccctatgcactggcacatagtgggttctcactaaatatgtattatataaaggacagaattaatgactgagtggatgattgcagaagagtctttcttgtccaggcgtgtggtggcacgggagtggtaaaggaatgctgacgacaagcacatgcaacctcagcatcagcctgcgtgtcccgacattgacccatctgcacatttcagtcccagcctagattctgcatttgtagaattacccttgcagtggggactaatattcattcattttacccacagtatagagtctttaaagccgattttctcctcacatcttaataaaatactggttttgcatctctctgaaaaggctgcaagttgctgacatctcttgaaccagaacaaagatcttattatcatcttccttgaaacagtcatattgtctatttggaccttcacctcctctcacccctgctattgaagcactagaaatgccatgcatttgactcacttccttctgggatgtgttctctttgggttcattctaaaatgacatgaaatgttggaattctgcagataattcagcttcccacatttcctctgagacccctctctgttggaaataacactattgtgatgcagatgcccccaataccctgtggaatctcaaaactatcaatggctgaccacaggatatcccttttccatgagtttcaatctgtgttattaaaaagggacccttacatgtaggagtccaatttgaaacaggatacagtcccatcaacaaggtcagtctcaaatagatttgtgcaggaaagggagagctgataaaaaattaaacatgagctttgcctctttcttttttaatatagaggatggcattttggtagaaattgattgaatgatattttataacgtgggcttaaaacatcacagctttgaagtcaatgaagaataaaacatattatcagcacatgatgccccaaacataataacattatcacattctcatgtaaaaatggaaccaactttccagttgagctgaaagtatgcatttgagctttggcagtgcattctgtatgcctctatcaactgtaaaatgcaaatgtttagttgctgtgtatgtaaccttagacatagatatcttatttagagaaccatagcatcaaggagggtgagagaggtaaaccaaaagccctttgtaaccaagaacagtgaaaaacagcaatgggtcaactcacaaactcaaaggaaactagatttaaaaataacattgtgaattctagtttatcccaaactcatgcaaaaagttgaatgactatagtctttccggacatagacagaaatccttcatacagctgaagaaatgtatgagagtaatccgaatttagaaaaatgctgcagggtgtgttgaagtacattttcaatgatatcttcggcagattgaaaaggaacatcttatagacaattgattgtttcttgaaatataataaaaacaaacttcgaaatgtgtatatgaaaacactgacctatgtggaaagaagaggcagcatttactttgtaatgctatcaggtggtaattcaattttctgttaactgaacttcaagtattctgtttcaggtcatagattggtggtgcttatataaattggccagtaagatttacaaatagtacctttagtgctcagttttgtggttgtatctctaaaaaagaaaatcagtttaattccatgcattggttttcttcttaaaattcatgcaatttgatatgattgacaaggcacagcattattatgcagtctgttagaaggaccgattatgcttatgaatacaagaatggagtgaatgaaagcaatgtgtaattgattctacacttggtctgactgttcattaacagtttgaatgtagcgcagttgcttctcaaatggaaaatgatgagagcaacctatctgtgctctctcatttgttttaaaattcattatgctaatattttttcacagaatgtttttgctgcatttgttttgccaaggataagtctgattgaatctttgtaaataattctactgctttcaatatttatttggcatttcaatcacatatttttcaatttacacttttggaaatgaaagtaggctctcccccacacctctttcaaagaaaaccttatatcctatcctccttttctctataattcagactaatttcccaggataaataggagtgggggagtgcaaagtggtgcgatagttatctcttcagaacaaagaagctgatttacagactgattgatttcagaaatagatgagcaaaaacagattccatttgtcttgccacactttagtctgatgaagcacaaaagggcctgccatctcattttccatagctcttcaagaggttgcatttgaaatgctgattaaatgtacaaatcgcattgctgttttcgtggctttcctgagtgctgtaggagagggcttcagtgcacaaaggctgcttttcctttcttgaatgtggagctggacactttagggaaataacatcactttcaccactcataggaagttatgatgctaattctgtgacagccatgtctgccctttcctctgtccacaggttcctgccacattataaaacaaaagaactaaaccagcactgtgccagtcatttctatctaggggctacaattacattcattattcccaaattagattgtgtttacaattaatactaatctcatgtttcaatctttggctacctcagatttttattaaattagcagttgactgattgagataataggtctgagaactccatactggtaaagttttaatcatctcagccttttctctgatttcttatttatctgccacctgactttgtacttggggctcaccaaaataaagcgccaactgtctggggagtcctgcattatagctgttttaagatatgttcaaaatttttttactgctcttcccatcaagaggtgaggtctaggtccttccatctgaaaaaatatgagatctttgtgacattggcaaccagtagaatattgtggtagtgatgctgtgtgactcccaagcctgtgttataaaaggcaacatggcgtccacctgctggtacacttgctcttagagccctgagttgtcatttaagttatccaactgctctgaggctgctgtgcagtgaggaaacccaaactagcccacatggagagtccttgagaccacatgaagagagaaagatgtcagtccagcctttggctcccacagtcctccactgctccagtgccagccaccagttgactacaaccaaatgagagaccctaagccaaaccccctagccaagccattgcagaaggtctgacccatagaagccaaaagaaataataggatggtggttgctgtgttaaaccaccacgttttgtggtaatttgttgcatattgcaacaaatctaaccacaaagctaaccagaatttgcatgtatacaagcatgaggctaaagtaatgagattcatgacaaacatgccaaaatgtatacatacaaatgtatgccattcatttctttccataaggagtcaccttgagaggaacttactcataatcatattgtcactgtgatgttgtcattgtgatgctgtcattatctccccacattgatctctgactttgggcacattattctgtctctctgggttgcttgaaaagtaggcgtagattaaatttttacatagtcttttcttaatctctaaaaattcttgacaattattcaaaattctttggttgttgaggtaaccaaaggaggagataaccaaaggaggagcataagaagtatgctctggccgggtgtggtggctcacgcctttagtcccaacactttgggagaccaaggtgggtggatcacttgaggtcagcctggccaacatggtaagttcgagaccagcctggccaacatggtaaaaccctgtgtctactaaaaatacaaatattagcttggtgtgatggtgcatgcctgtaatcccagctactgaagaggctgaggcaggagaattgcttgaatccaggaagcagaggttgcagtgagccaagattgcaccactgcactgcagcctgggcaacagagcgagactttgtcttaaaaaaaaaaaaaaaaaaaagtatgctcctatcctacgttaccactttaatatgtaaactgatgtcacactcagtgtacatattaaaattatagtaaaactttaatggttgatgctggccatgtaggaaaaaaatgccctcttgttcatcatttaaaccctatatttatctgaaaataattttttaatataaagaaattattgaggctaggaaaataaaagaaagatatacctaggggagtcattctgttaaattccttgaaattatatctatctttttctttaagagtatttttatatgtgtaatgatataagctcatctttggaaagcacattaatgatctttacattttataaggacagggtaaatgggattccagaatatggattaataaatcatatactctttgtttaaatgttttatttaatttttgaatagctaatgtattcacataacttgaacatcaaaaaataaaagcagtgaaaagtttcctccccatattccctcccccatcttcatagtttctgtcactcttctagtaggtaaccactcttattaactgctagtttatccttccagagatgttttatgcatgtagctaaaacaaacctatattcttccctacatcggtagaggaattttttttaacactaatgttagtgtgcttttctgaattttatttttatgttgtaatgtgtcttgggtatctttccatatgcatacatgaaggccttctttgtctattttacagaagcctagcatttcatagtataaatgaaccatcgttttactaacattgtttagtctgtcccctatggttggacatttagctgtttcccatcttgccttattatatacaatgtttcagggaatgacctgtgtaaatactgttctgcatatgggcgagcatattatctttaggatatattcctaggaatagaactgctggatcaaaaggagtctacatttgtaattttgttagatatgattaaatcattttctctggagatagtgccaatttgcacttcgctgtataatcgtgtttgggaaacgtgaaccatgattgatgctcatttatctggacaaaaatgaattaaacttcttagaatctttagctcagttcctgatagacgtgtacagaaggagatgcacttgagagctgcaaaaaaaaatgttattctgatttattccttcttttgactttgaatactgaaggccaaagaggagagtgacttgcagaaggtcacgtagctgattagtgacagatctgggacttacaacctgtagtcagatcttaggattggtgttctttccacatgagtaaagagatggtaactttctgtcattcctgcctgtgtgctgaggactccttgtacactgctgctgttgatgatgacatttaccatttcttgagccttcctatgtatcagactttgaatttaatacttctatttacattatcttatttataccaagggattcaaaacccatgtgcaagataaagcattgtccatagactttgcatccatgtatattacatatatatgtccactatgaagatgctacagtgtttaataaaacataaatcaatacaaatcatcattaaaattataatagctgtttgtctctaacatgttctcaatggattttgaaactattgtgaaaaattagtcatattttgatattaaaaagaattcttatagtcaaaagcctatgagctgcttaaccatgtctcagatcacttttacctgcccagatattctattttccatccctctccattataaggttagatattaataatgctacacaacacagaagagaccacagagataatctaagcaggagatttattttataggtaaggaaaaaggcaagcaccactgaaaatgatgggtttatctaaggcacttgatgactaaggggctggagctggaattcaaagacaggcctcctgactgaatttaactactccacactgagaaaatgagaaactcagtgtggagtagttactcataagtactatggacaattaaaataatgaaggagatttcctgtctagcctcatattgattcacctccagctttgtggatctgagaggtcatcatgttggtcgataataacattcgatcttggatgctataaatttaatatagagcataaatacaaagatcaatattttaatgctgaggaggctcatttattggctgtttatcctcagtcctttaaatgaaatggagaactaaagaaatgcaaggaataatttttcataaatttcatttaagttttatagacgatgatgactaaaggaaagcaaaggaaaagtttatgatgtcactatttcctacacttatgggcttttctctctttctctttttctttctctcccttatccctccctcccttctccctccctctttcccttcctccctcgcccccgttaatatctctaagcctcttctttactttgctcaatgttttttattactccagataagaggcacttattcttgatcttctccatccacaaaataagagaaccatggtcatgtcccgttgttctttcatgtattaagtgtttgatgtttagaagcagtggggaaggggctaaaaagcatagactttgtcttcaacaatgggaacaagattgccaaaatggccctgaaacaacatttcccaaaggtgaaattgtggaaatctagtcctataaggtgttcttcaaagcacaggtttcaatcgtcaactgtatttaggaaacagagcattttatattctcctcctggagacgcacaactccttacggcattttaaatgcccactgaagtcttgcagtaaggtaactggtgtgatagaatttcacctgttttttttttttttttttttttttttcaaatttaattgacctttaaacccatatcataccgaacccatttggggaaatgctgctttatagaattgtgtgttattctggttcaatttttctgtcatttgtatccatcagaaaacttagaatatcatagttgggtataaataacaagtagccaccagaggggaaataaagtaaggctaagcaccatctccttcctttatggattctaacatttattaaagaaactaaagtacaatattcatataaatatttactatggtacaggacttgcattgcttgaatttatgcaactcttgcttgttacttttattacaaaaaaatgatatcactgtgtgctattttttttcctgagtacacctcaagcccatttatccttcacttctatattgtagtggttctcactttaaaagtaagtttacctgtgaaacaatatctgcgtgaacttattagtgaagttttgtatgcctcctttgatcacatgagatgagcccctcttaatatcggctgacaagggtttaaatactgtttcagaattaatcatggaaaccaatgctttaggtcttttctcaaacatcaaatagtatcaacatttagtgggcaaccaacagagatttttcttttcttttttccttctttctttttttttttttttttttgagatggagtctcactccgtcactaggttgtgaggtgcagcggtgcaatctcggctcactgcaagctccgactccctggttcaagcgattctcctgcctcagtctcccgagtagctgggactacaggcacacaccaccacgcctggctaatttttgtatttttagtagagatgggatttcatcatgttggccaggatggtctcgatttcctaacctcatgatccgcccacctcagcctcccaaagtgctgggattacaggcgtggtccactgcacctggcgagatttttcttttagtgacttatttgctgctattgaaatgccatatgcattttttaaactgtaccatattcttatttttgtatactcttattcttctgtcattcttgttggaattgagtggtaacgattagtcaacacaaataatttcgttataatactccaattacattagactgaatttgtctttgtgatgaaagttgattagttgttatgatttacaccaatgaaagggactaataattcagttcaccgataagactgggaagcaagacttacaaggcattttcaagtaaatttgattaaaacgtggggtttttcttctgctctttcttaaaatgaggacagtcccctttcactacattcctaaaattaaaagtttacgtgtgtgtagagattaaaagaatagcacaatggcttgttgtgtataaaaaatatcaagttttgtatttttcaacataaataggagttgaacagtatagattgcattaaaatgtttgaatgttttaataatacaataaaatagataattaactattaacctattaaaataggtatgaactattagcataccttatgtaggtgaggattggtaggctatacttcaaaattggcaggaatgttttgcaattattcttctcaaggttattaatgattattaaaaattctcttggtattttttttcagaaacttgctcttctttattgtgtacaatgcctgaaggttgtcttagaagtaagctaggctagcactggctcttcccgtgccaatccagatgttccttttgcaggcaattactcctcagtttatttccccagtttatttcccgccaaggatttgtctttttccagggagccaattatgcacgtcttatactataatctgtgtcacttgaatctgaccaaaaactatgaaacaattcacttgttggggattccttttcacaattatcattttcctgggaaattgcctactttaggaggttgtgctacttaagatcttctaccagagaaatatttgcgtcgccaatgtattgcttagcttgcttgtctccaggctctaacacaaatacctaaaataaataaagtattaattatgtaaaaaaagtgaaaaatacctcgcttatcctctttttccttccttttgtatttacagatgtcatccatactgtagggccaatagccaggggccatattaatggttcccacaaggaagaccttgcaaattgctataaatcatctctgaagctcgtgaaagaaaataacatccgatcagttgtaagtaattttatgttttttatttctcactctttttcaacctttatgctttagtaatctgtcttgtctaaagagaggtaggaaaccatttccaaacttttgagaactaagtttaaggatcttagtagccgatttggttatcatgactctaatctttgatgtgctataaatatttgctaaatttttcatgatgtttcagaatttaaaactataaaacctcagaactggatttatcttatctactttttcctctttattttgccacttactttcttttggagaaagtaaatattatggtagtggccagcagatttaaagaaggaaaatagcaagtgctgagtttgttatgatagcgcacatttaatatatattggttgtatgcttgtgcattctggagccatgtttaatctctatgtacatgcatgaatgtgtgcatgcattctcatgctagtgtcagacatgatttatctgcaggaaattactctgcgtatgtattttaacctgaatgttgttattcttttagatttattttactcttattaaactaatattctgtaggtggtagctgggtataccacagctcttctaagttttatcagtagacaaagggagttcagaaaatgtggatctaatctatttccttaccagtaggctgagatgaaaggaattctcttctagctggatttggaggtatttactcacctgcttttcttttgcaacatgttctacctttattacatctcaattacaccaagaaaatcaaactatagaaaaacacactgtaaatatctaataataagttaatttggctggaatcccttggttgttccccctcccccatatagattatagccttgctgaaattgtggggcagaaaaaatagttaaatgcttgatttcatagcagactgaatagatcagcattgcttgatagttcacagaggtagtggttttattatttgcatgaagaaattttgagaagcagatacatttaggtaaccctggatggttgttatgctttttgtgcatgattgtaattatgaagtgcatttttcaatgcaacattggtgattctgcttgaaataaggaaacttttcatgacctaattatatagccctttttaatctttggataattattaacagagctggatattttatttctctctttgattttctaaaattttgttcgcaaatggctcaatacataagatcctattctctcttagaggtgaaagctgaagttcaaagagaatggagcaaagtataccacaagaccagttggttaattttgttctctataggaaaataagaaaaatcaaaacaggtatgcacatttagggaataattaaaattttgtcaatatggcttattgatttaaaaaagcaaaagactgaagtgcttggaaaatggatatgtagagaagtttccaacttggaaaatatggattttgaggcctgaagagaatttgctagtggaatcactggcatctctaatgacttgtttttaaaagccaagaaaaagtaagaagtaagaagtttgttagaaacagtataaaaataacattcaaccttttaatagagaaaggaatctctaactgtaattatcttaaaacaatcgtgttactctatttgctaccattaggtaagcaatggaagaattatgggctaagttaactttttaacagatggcatgcagatgggctgaagtaatgctcctgtaatactctagtcattctttgataggaattagatctaccttaacatctttgatgattattttgaagggccaattacatattacttgaatgaaattagcaggtaaggctgaactgaattcatcccaatattagtaaataaaaatggagatagaaaatacacaaaatgtgggaagaaatgtccaacgaaattgatcatcatgttttgcatggtagactacagttgccatcaaatgtcttgtctcttttacacataaaaaagaaaaatatttttcttttctttctccctccttcccttccttcctttcttcctttcttcctttttttggagtaaatggggctctcttctttatatggtgtgtcatgttcttgatcaccattaaataaataataatgctaatctcatcacattctgattatgtagagggaaatagaaaactttcagaaacatgattatgactggatacatgttttatagtataggcttgtattttgtcaacttatcacaatagatggtagacatggttgatataaaaagcctggttattaggatgaaaaataaacttaacttgaactcatttatatacatgtcaaaaagaatttctcataaatccttttatcagagtggcttagtgtttgctttgccacttattactgtgtgactgtggacaagtaatgtcaacattttgtaactttggtttccacttataaagaatcagtaaattactactgttattgcagacctgtccaactcatgtggctgttgttatagggatcagtcgggataatgtgtataagataattggaggaatggaattctctgaaaagtatttgacaatgttacttcaaatataagatgttttcacacctcatgatttggcaatttaaggaaatatcacttatttctttgatatctattctgaacaccagaactctagacatttaccatgtaatttcttgatgtttttaaacaacagggaaatgtccaggaataaattaaatatttgataggcaccacttttctgctaaggttaaaccaaaggctttaggatcacagcacaggatccaacatatatattcttattcttattttaccaaaagaatagattcttcaaatatttttaatggatgtaagacaagtagtatgataatttatttaataaatatgaataagacctactgtgtaccctgacgttatcaggtaacttccgtgacaaagagaggatctagtggttgttttctaacaaaatgtgactccatcttatgaccacctagacaaataaatggacaagatcatcatgtccactgtgtgatttgagaatactctgtagttctcttatcacttttaaatatcttcccagagatgcatgaaattccataattaatgagtaatttaggatgttaaggcattgttctttctctgcaaatttcctttaaaatgcagatactcataagatcagtagataattaattttctaatacattaatatgaagaaatttatcaaattacttttcatgttgacaggataaattagagtatgataaaagtactgagcaccttagcctgggggaggagaattggagaaaggtctgaaaggagatggagaaaaacagaaaaaagagtagggtataaataaatttcacctacctctcagttttgctaagaggagatcattcttgaatagtagagagggaaatgttatagtcatacataattatttagaaataagatactgatttgggcgtaagatgtgttgtggataaaaatttttaccatgaaaaaatactatatattttattaacttaggggaaaaaattcattacatttctgttctccatgcattgtttgtaacagctgttttttcatacctatccacatttgctttaggtggtaaaggaaaaagataaattaatcaacaaatcaaatggctcattttacgatggcatttcttttatgaatgatgatttagtgcttaatatcaggaaatatttaaatgtaagattttaatcctgattctccttctaatcttaccgtaaatcgtttcaattgaaaaaatatgaccaatctttcatgcctcctagacctagtctgtgcaagtttatttcttccaaatattattccttattccaaatattaaagtcagttatttttatttaaccatgagttacccttggatccaaaaaatttatttttatatatatttatttatatatatatatatatatatatatattctttttttttttttttttttttttttttttttttttttgagacggagtctcgctctgtggcccaggtgggagtgcagtggcgcaatctcggctcactgcaagctccgcctcccaggttcacgccattctcctgcctcagcctcccgagtagctgggactacaggcgcccgctaccacgcccggctaatttttttgtatttttagtagagacggggtttcaccgtgttagccaggatggtctcgatctcctgacctcgtgatccgcccgcctcggcctcccaaagtgctgggattacaagcgtgagccaccgcgcccggcctatatatatatattcttgacaaccttgagattgttgattgcaagataggcaaaatttaaggcaccatgaagaggataattagcagtacaaactggaaattggagtgggaataaaagaaaactttaaaagaagaccagggagcctacagattttctctgtaaaaccttgggaaagacaaagatatagctgtcaaaaaagaaaaaagacccaggttgaatcccagaagtctaatgcatatgacctgaggaatgcatagtcagaccagtgaaatcaagcatctaaattatgttgatttctagaacaacagtatatcctgaaacaatgaaaactacacatatacatgatatccttggctatatatatctaaaacatactaacagaaatcgtgtatattggtgaaaatcttggtgaaatctcggggtgagcgtaggggtgaagacaagaaagaaaaatttctattgagccagggctggaaaatgaaaatgcctaattttgtatccaatatcaccacgcactgatggagaggatacatagatattttcttatatatcatgctgtctttattctttttgtttgtgagcacagaaatattttgtaatgatttttatgtgtttatcctgacttctgtttcccttcttttaacatcatgttcatttttaaaaaactaatccatgtcatacaaaaagtatcacagcaatttcttcttctagcaccagttaaaaggcatagatttatatttgtcaatcatattaggtatttgagaaaactattttcactgatgaaatacaatgcaccctgtctgacattctttgaatgacaacgtgtaatagagtagatgttttattttgaaaaaaacataatctgcatataagccagattttacttaggttaaaaattattttcccatgaaaataaatactaattgacataggaatttagtgattttatgtgattatgggcagactaaaacttgtatgtttgtttaagtggtgtatgctacctgtgatttccacaagcatcatgctagatgatttttttgaatgaaaaaacattgtaaatttttgttagtaggaaccacccaacttcaatagggatccctcagagctaactgatgttccttccttgagtcatagatcttgagaagcaagagcttccaatgggaaagatgatgggcctgcaaattcagtactacctctaggcattgtggcaatcaagcaattttggaattctgcatttagttgttccactgtagtgtaggttttcattttaaggcgtagtcaagtgaatcttattttcttatacaagttcccttctgagagggttgccatggcaatgagttctcagcctgaaattcttaaatgttggttttatttcattatctgagtttccattacaggccacatcaatcaatgcagttctctattcaagaacacgtctgcagccttaaaaagctgaccctttcatttggtacctctgctcctctgcctaacttgatgtcaccatttcccagacaactcttcatctccaagaaccctcttctacagggctgtcaatttgatcttttccagtttccttttaggcaatatctagtcttggttctcacctgtctcattttctcatttataaagggtaataccaagtctctatgtcttccctggttgggtttctaacagctgtgtgactaacaatactattaataagtaacaagaacaaaggcacttttgcatttgtgcatcactctacagtttacagcagtgtattcctatacatcatctcatttatttttcaaattctctaacttgctgccactgttactttgatttagccagtgtgggaaaaagctaactcaagacttttcctttcttcttttcccctacattcacgtttcgtaagatctcctcagagggcacagaggtacacaggttattgttactgggagtgacaagtgacaggacaggcagcagagtcgaggaggagggcgggcatggaatgatagtaaattcacaggctgtgccttggaaacagatagttatacaaccaaacccacattgacagatcctgcacaatttgtgtcttctggtggccacaccagagagatgatttgagttagaggggtgaatgagatcaatcattgagccatgaaatatagtaataagaatagcaaatgtttctgaactcccacttggtgccaggcactgtgttttagtcattaattctcaaaacaatcctgagttagaaaatgtgatttcttccatcttagagatgaggaatatgcaccagaaggaaactgccttccctgtggctcaattcctcatccaaggatatgagccaaaaccaaggtgatgcatatcgtgattctgtttctccactagctaagcattatgttgacgaccgtaactccatgcattctgtgggctattacactaacctgccatctgtaggttggacctgtaacactactggtcttagctcaagtgaattaaggtcttaccttgaacaaaaagttgaggtgggatttaaactgaggtagtctaaatctagtggcctaagccactgtgaagttcctttttctttcctccattattatgtgcctttttttgtctaaaccagtggttctcagtgggtgtagcactgccctctagggaccattttgtgagggtggttttgggcagtgacaacaactagggagtgccacaagcattttgtgggcagggacagggatgttgtgacatgtggtctggccaagcccacatgggaaaactgtccctcctcccacacaatgttttaacgttttgccagacagtcatataagtgaaaacctgtttataaacaccaagatacatcaaaacaaagcctctctctctttttcactgtatcctggactatcatgaaaattaaaggaagcttgtacttagtttgcttagaactttaccaagagtgcctgagaaaattatgctacagatggccatgcccaagcagcaggagagtttttcacacctggttgagtccacatttagagaattttttttgtagtgattctacgtagtgaagcaaacatcttccttcttcattgcgtgttctagtgtattcatgcccttgtctttacatgttgaaaatagaattttactataaatactttcattttaaatcattttcatatcacacttatggcactctattgattttttttaaattgatgtgttgttttcatttggcttcccttgggaacagaccctgagccaaggtgttgtgtgcacgtgctttctataggaggtgatgacagggaacagcgcagaggagtggggatgtgaggaagggaagaaaaagcagccaggaggagtgggagtgttataagttggcagtgtggacaagtggggctctgtcttgctggggagctctcagcaaccatgtagaacatgcctagaagtggtcccatctgagggaggagaaaagctggactattttttttttttatctttcccccttcatcagctggctgaggactgctcctgggtcattaacttcccagcatttcttatctgcccgcttgggcaggcagaaggaaaaagctcaggcagagagtgacagcaagggtatttgctagaagatgctgtggatgggcatgtgctagaatgatgagaactgggcagatatgggtggggcactgatgcctgtttcatgtgtgcagatgagtgttaatattgataaatgtcatttctgcatagcaaggggactttacaaaatatttgttataaaagggtttgctgagcctgatagaattgagagcattggtttaagttaaacagagtttctaatagagcaaagctacattgaatatgctaaacacaggttgctcaaagatttttattcttaaagttaggcatccaaattatctgcttctttaagcatagtgtgatatagatgtcataaaaatggtaattgatgtgactggccttatatcctatagaatacatggtcttatgaaagtgaatgtaatgcttagctaatagaaaaacaatatcacgtgttgtgtcaccttagttaaagttttttcaagatctcataatcctaacctttgattcatcatgcaaattacggaagagttggccacccaaggttgaatgcatgtaaagttgtccatcaatcagaagacacatattagaggtgagcaatttaagcaggagtctacctttgattttattctaatataaagtttctttcaaattatgtgttctttcaatgatttgggaaatatattgtcatatatttccttcaaaaatcttactttaggaccgtgatcaattctttttgtaagagtgtctgaaactttttgctttatttcatctacaatttgaaagaattatttttagtcacttgtatattctgcagatgtaagtctactagcaagaccaagaaaactatgtttaaaatgaaagtataaaacatctcaatttggctggatttgtcaacataattattttctgttcttttatcaggctagggaacattctcaggaaaatcattattggtttctacaacagtgtcttccagaggaaatactggcctagcacactgtcaaagagagtatattacagtgaaatttgtatagaaacagtaaagagatttgcaatgcaagctttcatcttgagtgctttatttttccctgacctgagcggcagttattagatcactgtatcatgaggaaatagtcaattgaagacacggaccacagagtcccaagcctgacattaggtttgaacaattgggcaattttggcatatatctagagggttaatagtatagagcaaaggcaatggctttaaaccaaacattttttcttgcaaatgttcagatttttttttttttttttggagagcaattgcaatgtatggaatctaagctattcttaaggtgttgaactcagaaaccaaaggagaaagaacaagtaaaaacaataaaaaatttaaaataaaaacaaatctgtcagtggaaagaaagctttcttgacttgtttatgtacaattcaatggagttgcaaagaggattttttttaatggaaaacatgtcacagattgggttcaagctgcactttagctatttttgtttgtttattttatacacacacaaacacatacccttcaaaactgtgcaaagtgaaatatttgctttcctggatgtcttatcaaagtggtatagtttgaatttataattatgaattaagttcagcagtatattaaacacctagatttcagcccatacgagtaactttagtgcagtctctccatctcttctgagcccatgttctgaaaatttccctgctcccagtatactagcaggtaagctatcccggaggatgcacaacagaaaagcttatagaccaaattaagaggcatgactcacattgactcaaggagaaagaagccaggagaaagaaagaaataggttaacacacttagactaggtgacaaatgtgtggaagaacctcattttctggttatgctgtgtttgaatgctctctttaccatctctaccctctcaatggtgatgtggttatgaggaccatagttgaggtttgaacaagggagcatggcagatggtgagtgcctggggcccactacacacacttgctctatcagaaagacaggggcaagtgggcctggccggtatctcatcagttcattggtgaacagcaggggggtttacctccatttctgtcagagaagatgtaaggccaaatgagactataatgagtatcaccaatgggaggataatttgaggataacattgctgtcactctagaggtgacatgattcatgcttctgacctgttcttaccattcttttccattttgaaatgacagtcttgtttgttccatcctttttatcatatagcatgtcttagaggttacttagtactgcatttaacacaattctatgaatcctgcctatatctcaaaatctgctcgcttagttattatcaacacttaacacgagttatatatcccatttgtttttattttcttctatagaagaattgaatattctcaaataatacagcaagcatattacactttttataagatgggatgacagctaggtgtggtggtgcacacctagagtcccagctactcaggaggctgagacagaaggatcatttgagcccacgagttagttatgatcgcaccactgcactacagcctcagtgacagagtgagacccagatacccagtctaaaaagaaaagaagaagaagaaaaaggaaaatgggataacatatatcagtaactaatcattttaactgggtgatgggcaggttctatgtatggactgaattgtgtcccatcaaaattcatacattaaatctctaacccccaatgtgatggtatatagagatgggacctttgggaggtgattagacttaaatgagttgataaggatggggccctgaagatggaattactgctgtgataataagagacaccagaggccttgcttcccctgactcttggcttctcaaggatacagctagaaggcagccttctgaaagacaggaagagagccctcacaggggaacagaattgtccagaaccttgttcttgttctttccaacctccagaactgtgagaaataataaattcctgttgtttaagcctcctggcctatggtattttgtatggcatccagagctgattaatgcagtgagtatgcaggcattcattatactattctctctgtttgtgtatgtttgaaattttccgtaacaaagcaaacttaaatgtttaaatatataaaagagaatgatagattataacagtatgtacttcctaggattattgtgaggctataaagaaggaatatttgtaaagttctcagtagattacatagcttattaaaaataatttacctgacagatatgttttaagcaactattatgtttcaatcactggtcaaagtacttgagatatagctgcccttgtggagcttacattctactgatagcagttttcattattgttaatagatggtttcacatcatttctagatgctgtgacattcattattattacattcttgggcaattatctcattaccattgcatttttttcttatttttgtgatttctgaatctttaaaaagctaagaaggtgatagaactgagtagagatccagcaagtggcaattctatgaaatagtaataatataaccctcagttaacatacatccatacaaacagacaactatgtaaccaggcctgtattactgaagatcatgttttattgggcagtatggtgaatcaatcaggacgctgtcttgcagaacaagtgaaacataccactacataaagtcttcaaaacaatgaaaatccagaaacagcttctcaagcatttgatgtttttcaatgtaaaaaaatagatatttagggtatttctctcaaaaaaaaaaaaaaaaaaaggaatagctcaaatctatgctaaatactttaaattccttgggctatttggctaccctagggaaacaaggactcatagaaattgtggtcagaagcatgaataaggaataggtgacatgttctgttgctcacaatagaaccaattctccattaggttcaggctttattttttttccttcaacaaaatgcaattagattctccaaggcatgtattaaatatgaaagaacagacactgactttgtagtggagaaacccagcagataccaccataatcaagtgatcaagattaagataatcagtaatgagatatgtcaacattatgaacctcttggtataatggatcaagaaagacactacatcactgctatggtattcttgccatagccacagtccagtcataaccatagtctaatcatgagaaactataggcggacctccaaagagggacattcaacaaaataggtaattaatactcttcacaactgtcaaaatcataaaagaaaatgaaaagctaggtttattcttctcatattgttatggcatattacattaattgtttttcaagtgttaaaccagccatacattcctgagataaatcccatttagttgtgtcatgtaattcataatcatttttatatgctgttggattattttttatataataagtgtttgagaatttctgcatctatattcataagagatactggtcttcagtttgcctttattgtgatgtctttgtttttggtgttatagaataacttcagaagtgttatctcttcttctattttttgagagagtttgtgaagcattggtattctttaaatgtttaggagtagatttaataatttttaagctatcgtaagaaaacatttatttagttcatatttgtggtatctaataaatgaccaagaaacaggatctagtagtatatttttaaaaatgtaaaaattagaaattcatagcacatgcattttggtttttaaattaaaaatatttgcttacaggttttattatttcacagctactttgccaagttttcaggttgtctttctcaggaaccactctgggatggaggttaatgtgcaggacgctaatatggaaatgtttttgcaatcaatatctgcagaagggaagaaggaaacagaattgggcagagggagaagtcacgtgatgatgcaatgtttatggagcatctggtgaccctactgggagctctaaagctgagatgattgtttcaaaatggttccaagttggtgtgaggagtctagacctgtacattctgagacaaccagttattaatgcaggctgcacccaggaacgaatgtgatcttggaataagtagctcctctcagtcaagggtaatttctggagagggctgacagctgagggctgtcttctggcaacatcccttgaagctggggcactgtcctgcacagagtctgggtggtgcatcacagcacgaactgggattcttaaactgagcatgatcctgctccaatgcccaatgtatttgacagttatgtattctctcttggatatggtttaaaatttaacagctctaggaaaataagaactgaggcaaaataccttgcttcaagtgatgaaaagggtaataggctgagtattctgtatttactggtcagagcagagtcattttgatctacatgcacacagtagaatcgaaggaaacagtcctcatttttcttggttatctggctcatttgcaggaataacacacacacatacacacacacacaggtcaatatatgtggatcttaaataaatatgcagtggggccaacttgtagtggtttatgagaactgattgttaaaatgtcaagaattctgtgagctggccgggcacggtggctcacgcctgtaatcccagcactttgggaggccgaggcgggcaaatcacgaggtcaggagatcgagaccatcctggctaacacggtgaaaccctgtctctactaaaaatacaaaaaaaaaaaagaaaattagcggggcgtagtggcgggtgcctgtagtcccagctactggggaggctgaggcaggagaatggcgtgaatctgggagatggagcttgcagtgagccaagattacgccactgcactccagcctgggcgacagagcgagactccatctcaaaaacaaaaaaaagaaagaaaattttgtgagctgattattaaaacacaggctttattaaaaattaaattttataaactcacaatttaataagttatattaaatatgaagataataagtactcaatacacagcaattcctaattactatattttactattacctatgccctttggtttatttatgtctattatatttatatggtggaaatagtatataatggtgaatttctttgcatcctttccaattctatgttcagtgacatcatatagatagtataaaattttccatgttggggctatttacatggcagaaaccaacaaatgctaaaaatcagggcttgatgtactattttgctggttaatgagacttaagaaatcttgtcagtgctataaatattagagaaaaagtacactagccatagtaaggtgatcatattattactcatctaatagcaacaccaaagcaaaatctgctaatttcatgcataagtgatggtttttgtacctggacagcagggataccaggggaaggctgtcagctgcctagtttgggtctggagacatggaagactttgaggtggggagtgccagttggtttgaggcccccctgcaccccagattgctgttttttatggttgaataggcagacacttctttccctctcactactgcaagtgtatcattccagaaggtatggtttggccaaaaggcatagtattcctaaagaaaggagttccaatagcttttctctgctaaaagatctcagggtctgattttattttgatattaagaattttacctaactaaaccctagtacaacatttttttaaattatgggtaattaaaaacttccatattttaaacagtagtaaaggcacactctgcaaacatttctgtctgcattacctaaaatttaatggatcaggcaaatgatacaaattaggcacacatttgccaatatttttaattagcctactggtttacctgcatacatttgttactgtaagttattacttataagagttacttcaaattcaagatcagcagaactctccataaaattatatacctgtggcactatcaccaaaatataacatcatagacttgtcataaataattcagagatttgttgtaaccattcaacatggtagtgttaatgtgagacatggagaattagcatttgaaatggataattccatatttatttcatgccttcatttattttacacatttaactgctttggtttaaatggaaggagaatcctttctcaaaattcaatctcagctgtcttcttttcaggttaatggttgatttctttcaaattacaaatcttggttcaacataaggatgatgacatattgcagaaatacctttctattgcttgaaatgagaaaatgtatttacttattttctgtgacaagtgagggggatgctgttatggcactcaaaatgtatttatggtatttctattagaaaaaaaatctcaggaactaattatgaggcaaggcactggcaattctattgttgtattcaaataactgtgtggcaacttttccaattttgacaaatttggcttaaataataattcaatgatgcccctcaagtttcaaatacagacagtcccttacttatgattttttagttttatgatggtgagaaagttatatgcattcaatggaaactgtacttcaagtgtccatgcaaccattctgtttttcactctcagtacagtattcaataaattacatgatatatttcacactaaattataagctagactttgtgttgaatgattttgctcgacggttgtctaatgtaagtgttctgagcacatttaagatagagtaggctaagctatgatgcttgataggttatgtgtattaaatgcattttcaacttaccatgggtttatcgggatgtagttttatcataagttgaggaacatccagatttgcacttttctaacagcctatgttgtgagcaaatttaaagacactgtgctttcagacaaattaagaagcatttttaggaactggatacttcagctttagataatagtgtgcatctttctaaaataactcatatgcaatggcatgagtagacatgtccagatgtaacgaaccataggctagaatcatgtcctaaaacaatctaaagaactacagacacatatgcctttaatgctaataaatcgtcttatctcagtgtcaaagctattactacaatttaagtttaacctctttggaaactttctgttagtatattggtattttggtgagtatatcattaaaccattaacatagtgaatagggtgctcatacatgaatgtaaatgtgagtgtatgtgtatgtgtgtgtgtgtctgtgtgtgtgcactgtgtatccacatcacttcctttccctgagttaccaaacctgagttttttaggggccagcaatccatgcctttacaacactctgatgttgatgtggttttataatatctttgtggtatcacagaaagaaagttgacctagaaatctgaaaactaatatttgagttttggcctttctaattaattgctgtgtaagcccatctttttatttttttttattagtgaaatgaggaaaacaagatcttcccttaatcaaatcaatgggaaataacaagggttaatgaggatattaaaaatttgaaactcttaaccactgcagtggatgcgtaagatgatatagttgtggaaaacagcttggcacttcctcaaaaagttaaacacagaattatcttatgatcaaacaattccacttctaggtgtttacccaaataattgagaatataggtctgcatataaacttatacactaatgttcatagcagcattattattaatagcaatagccctaaagtggaaacaatccaaatgtccaccacctgatgaatagataaacaaactatgatccatttgcaataaaaaagaatgaagtactgacacatggtacaacatggatgaatcttgaaaatgttatgccaactgaaataaaccagtcacaagaggcctgattccatttatctgcataggaaatccgtagatacagagagtagattaacggttgtcagaggctggggataagagatgggaatcagggaatggggtgtgactgctaatagggtatcttttttgaggtgatggaaatgatctggaattaaatagtgatgatgattgcataactgtgaatatactaagaacactgatttgcacactgttaaatggcaaattttatggtatttgaattatattacaatttaaaatttaaaaaccttgtcctgtttatcctggaggattgttgtaggaatgaaatagaagtggaaagttctataggctctaaatcatattcaggaatccatgccattgcatggtgaagcacgtaggcctcagtgtacgcaacttgataaagagagtttgcatgaaaagtcatctttatgttgggtaattgggggtgtcacatggagggttatcactcagaatgcttgctgtgaagagctttatagaagagttatataaattacacacaaaaaagtatttttttaaatggaaagcacaagagagatggagataaatcgaactttctgttgggacctgccactttctgctttacatgttaatagtgactgtataataactgtcttcctaggctgcgaaaccctgaaggatggaagcttcgtgtggttcatctccattactctgcagcaccctgcgtatagagagtgcacagttagtaataaatgagctttgacagatttttttttttttgagactgagtctcactctgtcgcccaggctagaatgcagtgacacaatctcagctcactgcaacctccacctcccaggttcaagcgattcttgtgcctcagcctcccaagtagctgggattacagacaagcaccagtaggcctggctaatttttgtatttttagtagagacggggtttcaccctgttggccaggctgctcttcaattcccaacctcaggtgatctgcctgtcttggcttcccaaagtgctgggattacaggcatgagccaccgcacccagccagacttttctttttaaacaatatcctgtttggaattctaagcaaagtcagcaggctactgaatggacttcaagcaccaccctctgggacttcacaggctgctcctctcttgtttaaatgtggaaggatggaagctcaccccaggactctaggcaaagccagaacttgaggtcagcgcatctcacactgcctctaggccaccagggcatgtcttttccaaactctcttagggctgctctctgtgactttcctggtgtgatcctcaagccgtcctccctgcatctgtctgtgtttatctcacttgagctcactgcagtacttgacacttgtggccattcctttaggatgcttgcctctcagcttccaggacaccactctcctctctttcctccttcctacttggctgtttcttctcaattgtctttgtggccacctctggcttaaaccctctgtgactcctttgttcaccctttgctcttcttgcacagcagtatatctttacttaccagtaccagtcaaaccctaacactggtggtataggggcttcagtgactacaagtccctgattcccaaatcatggctcggctaagacctctgtcttgatctccattactgaatatccaactacctggtggaaaattccattgcatgccccagagtccgctcagtctcagtgtatctcaggcaacctgcttggactcctgtaactaatgccattgtgaatgtcactgacatgagtcttatgcagtcagaaatccaggagctgttctaggtctctctgcctcacccctctccttccagccagtcatctcttgcagtcctgtagacaccccctcccccacaagaactctcatatcctttgtcttagtttctgttctctctgaagcaaaccctgagaatgagacaagtacttggttacaaggaatttattgggtagttcatttttcccaggaagctccatgagggagtagggaagtgagacagggaagaagcaaaaccaataaagagtgtgttaacaaccaggtgattgctaatggcaactggggcacagtttagctggggagcttctgagaaggcacgtggaagctgcttcagaattgccccgccaaaggacaaggacgctgaggtatttgtctaccaacccctgtcgcctccttgttcgagatctccctcttgcatagctagcaccttgagtcagtgatcaccctcaggcagtctcaggaggttatctgtggctatgggagtagtctgcaggggaacgctgcaaagaccaggagcagggtgacagcccaagagcttctgtggtactgtcttctctactctctcccagccaccattttctgtcacttctcagctgaaccactgcactggtctccttgagactttaaggtttttaaaatttctttgtaactttttgcacatcctgccagaaagattcacacacacacaactgaccatagcatacactccttccctctgattagagatcttagaggctcctcagagttttcaggatgaagcctgattaccttagcatgtgcttcccaatactccaaggcacccaaggctccatagcaattgcatgggggttggacaggatactgtaacatttgaaaaaaatgcagttctttaacatttgttgggcatcctggtaactattagtttaaaggcagtctacagtttcaaaattagatcatgcaacgttccttttcttgatgctacgttatttccaagttgagttcatgactattgctgtgattaaaaagcatatgcagaatgacaatccatgtggaaaaggaaacatgggcggcaggggccgagctggttcaaaggtttgaggatttgcacagcgccaacaggaccaccatcccattaccaaataattgtggttatttaagagtgaaatgtaggtattatttttccctttatatgtatgacttttaaaaataggtactgagctgttagtattaaacccttactacgttgtttagacttatctacttaagaaaagaaacttttaaggcatttctttacctaaggccctggccaccctcttgtgtctcctctgctgccactcttaaatacaaatttttggctacctggaaggtccaggaaggtcatcatgcctttgtttgtgatagcacagactattccatctgtcaagattaccttcctcacctccccaccaccttcaccagccctacaccacacagcttaaggtgcacttctgctaggatgagtctctgattagtgttttttgccccaggtattattttgttgcctctgtgtctgcacagccttttgtacacagcttttatgtggcaatattcttactatacccccactggtgatgtacttgtctatctgccacattgttccacgatttccatgaactccatgggcacagacgttgcattcgctttgactttgctggcattttttattgggattatgtccatttagcttatgataaattagcatgagtgcctaagatgggatatagattcttgaaaaaaggtgaacatataagtcaaaggattgagaaaaatgtaagaatgtatgtgaaataataagcctttactctttttcttcttgtttatcatttcaacattttatgttgtgattttctgtgtatatgccacaggacctttgcatatgccatcctctgtgtttagggggatcttccttctcccttcacctgagttacctgcctcccttcttatcctttggatctcagctctgtcttctcttccttgggaaaaagttttacatttatatttgtatgcttatttgaatatttttcttcttcctccccagttcatgagctccatgagggtagggacaaggtctgccctgctaattattggatccataattgagtatattgcctaacatgtagcaggcattcagtaaatgtttgtagaatgaatgtagaatgaataaatgaatgttgaatctatgaaagcttcatgtttgcatcaagacctgatgactattctgaagcagtgggatgtagtttttccaagagagagtaggaatgttgtctacattgtgagaacagaaaggatttaggcaagggccagcagggaatggaattttagttccaagcttgaaagaaattgggaatcattttaggtttccgaaaaaaggggtaggggtcagatgatcaaaattgggctgaatgcaacacagaaagttctgtttatttaaccacttgcaatatttcacttcaaaatggattccctgccactgagaagctgccatgttttcatttgctggaacgtggtgaagttagataaatgataatgccatgtctttgttcattcctcagttagaaagcctcagccttaaatgctccccagtgcaaattctcactgaataaacatggagtgtattgttttacaacatgctgctcaatgacattgcagcacatttggcactgctgagcatttcaggatgaggaggcagaaaataacaacagcaaaaagcccataaaacaaattgcatcccctatattccttaatgaaggacttgggtgtaagttgcatcaacgtcagagaatactcattcattgcaaaggtttgggaaaatcatatttatgcataatctccttgttctcaatgatattttattaatatttatttcccttttgcctttcatctggtgttatcttcttttctttttcatctttattttccaagtgactagctgaaaagaaaaacagtgaatcggtgctaagttgctattttttcaattttaagggactgattcttaatcaagttactattttaaatgtttaaattgagaaagttccgggtaacaacctaaaaaatgtaaatacataccacacagttaattaatgtttctgaattgctactgtttgaagttgataagccccatgtatgaattcctcagctcaaagctgagggagttatattaagaagacagtagaaaataaaaataattagctagtgttttgtaaggagggaacataaatggtatctgtgtggctctaactttatcaattcagtctgttgatttcaaaattcagtcatttgagatatttggtattatgcagattttaggcagcatgtgaacaaagggctaaggtaaggattattgtattgcatgtatttctgtgaactaattttgaggagctatactaggcttctgttttatgtgtatctataagcattttacaaaacaattccatatgtattgctaattaaataaattcatctcaaagtttgttacaaactcaatcaagtgtttgagatgtagaaggaacatatagtttaatcctgtaccagtcaggatagcctaagtcatgctgaagtggcaagtgatctcaacatttctgcagcttacagccacaaagattgagttcttactcaggctagatgtccatagaggcagctccagctccactacacatcaccttcactctgggactggctgacagagctgtctctctctggaactgttgcttgtcacaacagtgagagagagaaggcggttcttaaagctacatatggcttactgtcacatttcattaactagaagaagtcattcggccatacctacattgaacaggacagggagacaaagagggataatcctccctcaggaaaaaggtatcaaatacttgtgattagtctaccactcactccttcatattttggatatgaaaaacatcaccagaaggattaagaaacttggccaagatcacttgcaaagctgggattggaccacattcctgtgacccaattgcagacattcctgtgactacatccagtgtctccttgtatgcaaatttgtggacacaccatggcatccacagactcaccagagaaggatgccacctacagagccagctgctcaccagagcctggcttgcatcatggcatcactttgatggggtcagcatattcgccccttgactctgtaggtccaaaatttgcatctgttaatgtatgctgtatcagtcaggattcagtcatggaggtagaaccgtatacattttggtgcaaggaatttattataggaattagtacttaaaccatgtgggaggaactaggaaaatgaagaaacaagggaggagttgaaggccaaaccagctactttgataagccaagtgtgttcagtcatcaaaataggcaggaaagggaaggtttttgggagtccagtgggatgttgggcttcggtgtggctaccactgctgtaggaccaccactaaccatttaggtaatgcctatggctgcttttgcactatgacagcaaaattgcatagttgtaattaagactcaatgacccacaagcctatgatatttactatctggccttttacaaagtttcctgacccctggtctatagttcagaagattgatttgctgatctatagtaagaaactcagctatgcagcaggtccagcaactacacagttccaagataagatatcatttccccattgttaaatctatgtgcaaagctaacttatgattaaattatggtaagcttaactgtaatacaaggaatcatttcatactatttgtaaagcagtgaacactagcgtaataagttatgatcgtggaggctaccacctgcaccatccataccccgagggctggacactcataactatgggtgaggccattccttccgctggggcaagaataactatagatgcctatgggaaactgatacaatctcattctctacacttcctttatatgctgaaggtcacaatctttattcttgcttagtgaagagagaatcgactgagctacatccacacactattcaccataatgagaattggaatattacttcaaattctgcagtcaccgaagcaaaatctgtaacagggtggatttcaaaaattattttttatcaaggcataacctcatttattttaggttcatggatgtaattttattctccaaggtaaccttatcttcaaattttataggtctcatgctgtcccccatcctgtatcacctacaggtgacttttccttgatatgacttatagaacattaacagtgctttcttttcaatcatactccgatttggttagttccaacttaggggacacttactttaaaatgtctcttcaccctgcaggaaacgagtttattagtgaaactttcaacggatatttttattccatttatgccatttatctctccatgccttgtgaggcaaaggagtggtgtttcaccaggttaagaggtaattgatcaagattcagttcaaaaaaagtgtaaacagtacagatcttaactctcttcagtacttttaatcaaaaaggaaaatcaaagcgtatcagccagaatcatcaataactcttggtggatgttcaaatgcagtgacctcttgacacttccactgccttcagtttttgtttttatcatttgttgcttagcagcacggggggaaagagcaggactgtagcttggatttaagctcctcatttactagctgtgcccttttatcaaatcgtttaatactgggagccccacttttctcatctgtagactggggatattaatggctcctatctcaagcagttttaagagttaggtaagttgatattgaactaatttgacattaatgttaaatacttatcatagtacctgagtatacctgagggcatatccttcattcatctaacaaacaaggtgctaaagacactattataattatcacagtagttctatgaggttgctatgattatcttttttgtttgtcttttaacaaagaaacagagaatcagagcagttaaatgacttccttggtcataatcctagagaattttagagctagagatagaattcagatctatctgactacaaagcccaagcttgtggacttaccctccatttgtcaaacgtgaattccttgaattgtaaaccatttggggccaaagcacacctttttttttttttttttttttttttcagttaagaagctggtaattgagtgaacacaatatagtggtacttcagttaactggagctcctggggatacatcattctggacagcctagcattccagaaagctttgggtatttgccaaaactttaaaaatgttgtttaatttagatagaaccctccataaaatatatatttctctatcttcttaaacagattatattgaacctgatttaagattacattaactcagtcatttatcatcgtgaacttcatttttatcctgtactctctaatgtaagaagattctgaggttttattgaaataaagagggatatcattgacctagtctgttatgcatttttaagttcctgtgtttgatttgtaaagtttaggtgcttcctgtccaagcacttgccacttctctttgcctatttgaattgtcagtctcccacaagaccacctgaaaactctgttgacgaagcaaaactaggtttattaaacctatggtacaattggcaatcatcactttgacagtcttggcagtatttcaaaatgagggaattaggttgacatttacatggtagggtatgaactgggtggttttaaggtgagtctcacaagataggaaattgtctgggattgggtagagttgataacataagagctctggagggcacagtgaggtgaaagatttaaagcaagtgttgatgatcaagtcattggtagtaataagcaagctctttcagttgggtcacagttatattttacaagagcacgtatttctttgagtaagaagctcagttatttttgcctagttccaatattaaaataggcaggtatgtctgatcccaggattgtatggtataaggacaagaaagcatattgatttggtctctcacttgactctatgtcttggtgcttctacatgctatggcatgggacactcaaaactggaactgtatggcaacagagatccagtaaaagctaagtgggagcccaggaaactgacttacacacatgagttttgtgcttgggcttgtgacatccatttttaaaatgcagagactcctttttttcactcctttttttcttgcttaatccctggatatctttctaatgtcacgtagccaacaccatcaactaggtgagcatcagttaggtatctatttctgcactgggaatcttgaatttataaatcctggtcaaaagcgagttaaagagatttttaaacaattacacaaagtaattcttgtgttttatttattcagtttatattgagttttttgcagctcttactctcctcttcttttgtgtttgaaaatttaaaaagtgatgctgtttggacacgagatttgttttgtaaacatgaaatttagaatgtctggggattctattaacactttttgaaaagatattgccttgttctagagttcttgagctattatataattgaagtaaatagcctgagaacatagggatttggtgtggaatacatggaagataaagtgatcaagcaagtttaaaatatacaattagtacctaaaataaagtgagtattgttttacatcttcaatctagtagtcggcaaataataaaaaaaggtcaaaagtcccaattatatagtaactatcgaactggaaaaagaaatgaatttgactcttactacttaaaacttttagctgtttatagtaatttaaaccaattgaaaataaatgttccagccagcaaaaatcctttctaagaactatgtgtggtaagaggatacaataaactaatcaaacaaagtttctgaagtctcattaaccacggaatttttagtgaaatggcatggatatggtatacttggatttatttggaaatgacagaaatttcctaacaatatttgaagcctgttttggtgagtgctatcaagggctgtttttctttttcttttttctagttatatattcagtactataaattgttggcagctggcccagaaaaagagcctattttcggaaaaaaaaattattctgcaactttatgctataacttaaacacactaaaaagtgtgtttaaattttattgtcagattaccagcttttatgcaggtagactccgtggaaaccataggacaatgacaaagttgcttcttttctttctcttagctatttttttactctggattacggtgtggatattaatatatatactttttatcaagtatagggaacaaaaagaaaacctgcctgcacatgtaatctttcttacaatatacatacctgtgaaacaccagatgagaaaagctatgatctgatttatgtcatgcgaaatgaatgttaataaatcctatttagtcacacagatgccaaactgagacaaatggaagcctctgggggcaagtggaggtgggcaaatgggctccactgatttatgagtgcagagtcatgaaattgaattcggcaacctacaaatgacacttattgagaacctatcaagtgctaggcacccatgctggtactttgaatacagaaataaaaggtttggattgtaaaaatgtcacagtataattgacaaataaaacaagttaattaaacaatatggtaagcaatagaagtgcaccctgcataacaatgttttggttaatattgatggtcccatgggatcataatgaagctgaaaaatttctatcttcttaaggttgtaacacaatgcatgagtcatgtgtttttggtgatgctggtgtaagcaaaccattctgtgctgtcagtcacacatttatgtacagcacatatatatgtatagcacacaatacttaagataataaactatattattgttttacgaatttgctatacttcttatcactactttagagtatactttttctacttataaaaaaatacaagttaaatgtaaaacagtctcaggcagttccttctggaggtattccagaagaaggcactgttatcacaggagatgacagctccctgcgtgttattgcccctgaagacctcccagtgggacaagatgtggaggaggaagacagtgatattgatgatcctgacttctgtgtaggcctaggctaatgtgtgagtttgtgtcttggtttttaacaaaaagttcaaaagtttaaaaaaaaaggtaaaaatacaaaaaaagtttatagaacacatatatatagaaaaagtattttttgtacaacatacaatgtctttgtgttttaagctattatttccaaaaagtcaaaacgtttaaacaaattttgattttataaatttaaaaatttatacattaaggttactttattattgaagaaaaactttttaaaaataaatttagtgtagcctaagtgtacagtgtttataaagtctacagtagggtactgtaatgtgtgaggccttcacactcactcaccactcactcactcactcctgaaggcagcttctagtcctgaaagctcccttcatggcaagtgccctacacaggtgtaccctttaaagaaatcttttataccatacttttactgtatcttttctatgtttagatatgtttagatacacaaataccattgtgttacaattgtctgcagtattcaggaaagtaacatgctgttcacatttgtagcctaggagcaatagactttaccatacagcctaggtatgtagtaggctacaccatctaggtttgtgtaagtccctctgttgatgttcacacgatggtgaaatcacctagcaaagcatttctgagaacatatccccatcattaaccaatgcatgatgacaggtaaaaaggttgattactgccaaatagtacttttgaaaaagttaaaactaggactttcacacaaatatgaaatgaatatatgtcaaagattttgttaaacctattgataaatgagagaaccagtaaagtgatagaaccagttcaaggaacgtttgcagagctagatattcataggcaagttaataaaggaaaattaagataagattgctaagttagagataaaagcagctaatttcctacaggacaagagagcataacttttggaattatcatttcttctagatataaataattattttagtctctgttgaataaaagtctacaaatgtagacatgtaacctcactaaatctggactcttttatcaatagtaattggtaggttggacaaagctcatctccatagaaattcaaggatgcttctttccccccatacaacattctgctgcttatcttttgccttattttcaagttttgggtaattttttaacaacaacaacaacaacaaaatttaggagcaatagcatatgagacagaggaaaaacagtgggattccaggcttcctcactgggctttgttaagcagaaagttaaggagagaagacacctgagataggccttctacaaatgagaaaatttccaataggacaaaatgtggggggagctggcataggtagaaggaaggcaaaaacaggtaaatcccaagaaccatttgacaggcaatgttgtatttacttttgtaacagatatagcactgtgactgggggccagtttatgagagacattactttatactttgctgcatttgttgtggtgatggtttttttaagttagaaaatcagatcatctgcatactgaagagcagttatgagtcagttgtttttaaagccatacatttatatgttagagaatttaaactctttcagaggaaaatgcaaaagcaatgaatgtagaaggcagtgaagacagagatgattttaatgcacccaggtattaaaactgagcagagcctctaattattcaacattattctgaaattctctttcatcacaccataggcttttttttccctcttcttttctatttcacctccatttcttttctctctggccccagatatgaaatgaaatctgggagcaaccacaatttctgtctcactggctgagcaggatgcttctgaaagaagcagcatctatatatagtttttcttcttaggctgcaggtgtgggatggaatagaatgaaatggaacagaatggagcaaaaaggaatggaatgttatctctcctgaaattttttttatttaaattatggatgcataatagttgtacatatgtatgtggtacatgttatattttcatataggcatacaatgtataatgatcaaataaaggtaattgggatatccaattaccttcagcaatagtttttttgtgtgttaggaacattccaatggcactcttttagttattttaaagtatacaaataatgattgttaatcatagttgccctattgtgatactcaatactagatcttatttattctaactgtacttttgtgcccattaaccattccctctttatcccccctccccacttcctttcatagcttctggtaaccatcattttactttctatctccatgagatcatttttttttttttagctcccacatataagtgagaccatgcaatgtttttctttctttgcctgacttatttcacttaatagaatgtcctccagttttgtccacattgttgcaaatgacagtaattatttttaatggcttaatagtattctgttgtgtgtatgtaccatttttctttattcaactgttaaaagacacttaggttgattgcatatcatggctgcagtaaatatgggagtgcaaatatctctctgatacactggtatcctttcctttgattatatacccagtagtgggattgttgggtcatatggtagttctgtttttagttcttgaaggaacctccacactgttctccatagtggctgtaccagcttacattccctcacaacattgtatgaaggctcctcccctctctccaaatctgtgctagcatttgttattgcctgtcttttgaattaatctctttctgctgttaataatgtaataatgtatttacttagctccatttttctctttgatattaatttccattttgcaaaagaagtcacattaagaaatgtttattaatttaaaatctctttactaattgggctttgccagtaggtaataaactatgggccatgaggttattcaatcttgcagtattttttccaggaaggtggtaaaatatgaccatagaacaaactattggccttgctatatgagctgctgtgattagacatttccaagcccagcttaaggcaacatctaaccagaagagctctaaatataaaataaatgaggtgctgctctagtaatccatttatacacagcatttattttagccattttttttcatttgactgttggcagtcgatcattggatttatacggtttggcattgatcttggagaaggccagtttggtgcccacgtcaaacatgcccaatattctattgtccatgtgactccctagaattaattagaaaacatttcaaaagggccactctaggatttaatactatcaataatagttgtttaacccaaaatatgatgaatctttgctttatttatttctaattgggcagttttgcattttgccgagtaggattaataagcaggttaagtctaattggcttgctttgactgaagggctgaatcatttcaatatagaaacctgtactttttataatttgaaaaaaatccacccaaatcaatcctgaacaatttttattttactttctcaatttttctttttaggtcatttaaacatcttgggtccttttacatgaacagcaagactgatgctttttgaagaaaagtctgtcttcagatagaaaaggcttctgtttgtatagaacaattagctaaaattagcatgtaaatttgaacaatattatattgtgaagctgattgggcctggaggttgggatgcaagtaacttctcttgtttattgtatgcaaatatagccacttagctttaattggacattgaaacccagaacaattatcaacaattgctttagtattaatgcacagtgggaactgcctatcatgactttttatttttttcttaacatttaatttttaatttttgtgggtacatggtaggtgtatatttttagaaagtacatgagatatttttgaaacaggcatacaatgtataatactcacatcaggttaaatggggtatttatcacctcaagcatttatcctttctgtgttacaaacaatccaattatactcttagttatttaaaaatgtataataaataattgttaactgtagtcactctgttatgctatcaaatactagatcttatttcttctatgtaactatatttttgtacccattaaccatccacacttcccccttacacctacccttcctagcctctggtaaccatcattctactctatctgcatgagttcaattattttaatttttagctcccacaaataagtgagaacatgtaaagcttgtctttctgtgcctggcttatttcacttaacacaatgaccttcagttccatccatggtgttgtaaatgacaggatctcattatttttatggctaaatagtactccattgcgtatatgtaccatgttttatttattcattcacctgttgatggacacttaggttgcttccacatcttggctattgtgaatagtgctgcaataaatatggaagtgcagatatccttttgatatactgatttcctttctttgaatgtatacctagctgtgggattgctggattgcatagtagttctatttttagttttctgagaaacctccaaactgttctccatagtggttatactaatttgcattcccaccaacagtgtacaaggactcccttttctccacatcctttccagcattttgttattgcctgacttttagataaaagcaattttaactgggataagataatatctcattgtagttttgatttgcatttctctgatgatcagtgatattgaacacattttcatttacctgtttgccatttgtatgtcttcttttgagaaatgtctcaaaaccttttggccagattattagttttatttttctctatagtgttgtttgagctccttatatattctggttatcaaccctttgtcagatggatagcttgcaaatattctctccgattctgtgggttgtttcttcactttgttgcttgtttcctttgttgtacagaagctttttaatttgatgtgcttctatttgtgcatttttgctttggttgtctgtgcttgtggggtattactgaaggaatctttgcccagaccaatgtcctggagagtatccccattgttttcttttagtagtttcatagtttgaggtctcagatttaagtctttaactcattttgatttgatttttgtttacggtgagagataagggtctggtttaatttttctctatatagatattcagttttcctaggatttttttttctctttctgcaatgtttgttcttggcacctttgtaaaaattgagttcactatagatgtatagatttgtttttggttctctattttgttttgttggtctatgtgcctgtttttatgccagtaccacactgttttggttactatagctctgtagcataatttgaagtcaagtaacatgattcccctagttttgttctttttggtcagaataattttggtgattctgggtcttttttggttctatataatttttaggattttttatctatttctgtgaaaaacgtcattggcattttttatagggattgcattgaatctgtatctcgctttgggtaatatggatattttaacaatattgattcttccaatccatgaacgtggaatatcttgccctttttgtgtgtgtcctcttcaattttctgcatcaatactttatactgctcattgtagagatctttcacttctttggctaagttagttcctaggtattttattttactcatggctattaaaaatgctattactttcttgatttcttttttggattgttcactgttggtgtctagaaatgctactgattttgtgtgttgattttgtatcctgaaattttactgaatttgtttatcagttctaatagtttttttggtggaatctttagttttttccaaatataagataatattacctgcaaacaggataatttgacttcctttccaatttgaatgccccatcaggactttttaaatggcagagacttataagcaattgatactgcatccaaagaatgacaatctttgtgctcatcctttgcacaataaaatcaagtataggccaaaatctggccaataaggtttctatcagtgtctttccatttcctctaattgtgcctttttgctttgtggaaattaatggaagatgcctctttgaataaaaggaagttcaaaataaaatttactattttgagaagatccagaatgtggactgttttcaagcagatatttgacagttcttaatctggtgggattctaaaaggtcagtaagttggcttcctaccagttattgctggggcaaagggaaccttccttcattctttgattcagaatttcagtctctagaataaacttgagagtagacaggttaataggagaaaaagcatacacatttattatgtacatacacatgaggtcccacagagtgtgagactcaaagaagggcaagatgattgaagcttaaaaagcattttgagctacagaaatagggttttaaagactcttggagggtggtggcaacaagctatgaatgggtgaatggaggaaccacactgcagacaaaggatgtcttattctgcggatagtctcgcaggttgcagccctcagaagaataggtgaaaagtctctctgagcacagtatcctgggcatggagaccttttagtctcctctcctgccacaaagagttagaggatgaggggattaacaacaatctcattcctcctggaggaattttccctagtgaaataagggaacttcagagaaagccccctgaccaccccaaacttcatgagagaaagaggatagtgagatggacagactgggcctggggaatggtgagaagtgaagtgggaggggtcagagagaccttagatctgaggctgcttctttagttaaaagcaccatacttctgggtattgttttctgagcccaaacattattaaatcatattatatttgaatatcacaaatgaaaatcattacatgaattaatcagatcttgatgttcttttaacagtatggcagcacctggagaaaactgtgaaataggtatacttgatttagtctttggctttagaattgcaaggaagaggtgctaagaagtggctatttgatcaccctgcaagctctcctctctgtgttttcctgttcccaggttttctccttctgctttggtctgccagtcctaaagaggaaacacattcacactcaatcaggagtaacttacttccattcactcttccaggagtatttgagcatcaaaatgggactgtgaaaaggaaatgcattatctgaaggaatggatgccaagaccccaccagcaaatgtggaaatttgaggggagtgggttctgtgcacctcgaattcagccacatgtttacccatgctactctacctaaccaatgagctgccctttcttggcaattcagtcttctttcaatatattaagagcagggtgttatcatgtgactcattttttttcgatgtaactttagctgcttgcagaaataaaattgcttcttaatagcagatctaaagagggacaaatcacaagaatgttccagttaaatttatattttctgtaaatatgccaactgcacttgcacttctttttctttcttcttttttcttattttcacattttccctgaaccttctcttactgaaaagaaaataaaaggctataaccatgcacacagatattgctctgttttgaattaggttgctatgttaaccaaaagaaaaaaaaagttaccagctatcattgttccaaaggttgatttctgatttctctaacttctgttgtgtctgcatttctctcctcatttttcaaagaatgaccctcaatagcttaataaatcagctaacaaaatgttttagcatctgctaacattccctcagtgtgttacatgcatgttcaaaggctttgttagaaaacacaatgaagggaaaccacaggcaattctgacaggcaatatgatcgggtttcaaaatacttcaaaaccccaatctttacattaagactttgcttgtaaatatttacattgattgcccagatggtggcagaattggagaatgtggatcactttttttttagaaatgtctcttaataaacttaaagattcataagccacaattgcaaactttagtaaacacagtactacatgttcatgtgaaaagttttgcagctataattattattagttttttaaatcagagcaatgggaagtgaaaagatacaagttttcttcagattttgaggacagcaccttcctgcactatccgtcactaagataagcctgggtcttggttgcttctaaaatagttcaattcaagacaatgaacttgtgttgactaccaacgatgtgaccttcattgtgccaatgatacaaaatcactctaaagtgtagccaggcaaagaattacacagttaaaggagaaaggatgtgactccttctaagtaggtataatcaggatcctcagcagctcttctcttacctggtcagctgcagttatctcctaaaagttcttcttgcttccacttttctttctctctaaaccattctctgaaccacaaatgttccaaatctcaattccatgccactctcttgcttaacacacttcagtgaatccccatcactcccaggacaaagtccaaatcctaaagatggctttcaagacctcccatgaattgtatgtctcttggttacctcagtgaccctgtctctaccacttttgtccccatcctctacttttgggtttagccacacagaactactcatggttacctaaatagggtactctgcttccgtttctatgcaagacattcatccagacgcccttcgcacaagcctgtattctagagggcaggggcgcggggggcatgagaaggcatttagaggaattgttcttgtggcttagcagccattgtgcaaataatgtggattttattagtaggagtggagagaaacaactaggggctaaagccatgtgcaagaggggatgggcaggaaggaccagctctaaggacaagagcatgcaaggcctgcagtgaaaaacctctacgtccttcacgatcccttaaaaatctacctgcaaagcagtcattccatccccctctcctctgcatccccactccaacttggccaacccctaataactttgcttcagaggtcacctctctccagaagactttcccaagtctcaccagcgcttacctccctacccccagggaagggtcccccagaggtctctgctcaaatctggaagggtgtttctcacaggccattataatttgttctttgcttctctgccttctgcaccagactgctcaatttctggaggatagggacagtgccttgtctacctttgtgtccccagagcctggcatgcacactggcacaagataggagctcaaaacctttgtctccccagagtctggcatgcaagctggcacaaaataggagcccaaaacctttgtccaagatattgaataaacatgggatggcgtcagacattcactaagcatgccccagcctctgactcaacccccaggtagagaccactatcctgtcactctcctcatctcccctcaacagatttctaggcttttcttgctcagatttgaaaactaggtagaaaactgtctcactgagacagccaagtaaaaatggctccccagagaacttccgactgacctgagcactgggaggatgggacggggccttgggaagttcctgccagttgcggaggtggggaggagcctggcctctccggttcctgggtggacctgggattcaatcagtgagatgggggcctgtgaacaggaatctttctcgctttgctgagagttttgtttgtttgtttgttttgttttgtttggcccaataaattctgtttttctcacccttctgtgtgtccacgaacctaatctttcctggtcatgtgacaagaacccagtttttagctgaactgaggagaaagtcctaacaacatcagtaggtggcagatgagtgtgaaaagttagtgagtgaaatcagaataatatatattcaagagaggagagaggaagagaaagagaggaagaagctgaggtttgacaagagagaggggagagttttagtttcttttgagttgatttgcttggtttgagaacaggtgttcaagattagtgcaggatttcagaaattgtagcagagaaaaaaagaaatggaaaagaagttgactgttgagacttatgatcttgttgatacccaagaagcatcatttctgaattggaattctttcagattaaagttttatttaaaaatagattgagggccagcgcagtggctcacgcctgtaatcccagaactttgggaggccgaggtgggtggatcatgaggtcaggagttcaagacccagcctggccaagatggtgaaaccctgtctctactaaaaatattttaaaaattagccaggtgtggtcgtgggcgcctgtaatcctagctactcaggaggctgaggcagaggattgcttgaacccgaaaggcagaggttgcagtgggctgagattgcgccactgcactccagcctgggtgacagagcgagactcatctcaaaatacataaataaataaattgaaattcccttccctttttccttactggctttgaactgtgtttatttgtgtgagtacagagatcagactatgagaatcatggactctttcaagagttatgaataaataaatgagttaactaatgaacaaataaatgcatgattgaccttccttccttcagagtcatggctgcagtctccacccatgaactccccacgggaaaaaaaacagtcttctccccagactttggggaatatgaagcagccaaccatgaaaaagttgataacttttctctttctgcaatttgtcttctcaaaagaggaatgccatctgaattagctcccttaacacttcagagccacagcatcttctgaatagctggcacaattttcagcaacattcatttcaaatcctgttgactgaacatgtggttcagatgagagcttattatatattgttaaatgatttcattggattataaatcactgccttcacaattctctgtgggacacacatggaattctggttaaaagatgttcaatattgtaaccctccagagagaggcttcccatgacccttcctcatgcagatgatatggttaagcatgcatggccaggctggcctgcccaacgtggcttggatgaggtttctcttcccgaacttgagcaaggttttcccttagtacttgaccttgtatcatcctctcttggccttcagtccacccattccttagctgtcccttcaccttgctgacccaccatctcgctatggctcccttgcagctgattatgtcttgtccctaactgaaaaatagaaactaaatacattttgaaggaaaatggctaactactgataaatactgctttgccattaggggaattcttgagtaagatgatagtcagcagtgaatagtcagtgaaaagattatcatctcttctgcaaattgtccctggtggagatttgattatatgcttaggggccaccttcctgtcttttagaattttctggagcagctgtcattataattactgaggacctttatgtgaccttgtcatcttgggcaggtagctcctaaagggatttctgaagaagacaattcatattttctgtgcacctgccttctcaatattttttgttttcacttagtgtccctgaaactctttctctcttcacatttcactctctgcatcactaatgaggcttccatttacctctttaattaattaattaattcaatatttatttggcacctattaggccccctgtaggataataacaccttaagctctggtctcatttaggagaatttgcatttatgacaagactctagaagacttaaacttttaaggccccaagaggtaaatttctaatggttggccacccctgagttgggaggcactaatgtggactatgaactggatcatcagcatgtagaaccccagaggcagatttctcctgaagttaataaagctccagcctcggggtctcacactgacacagccttttttttttttttttttggctgtacacaagtgttttcggtcgctttatttataattgccccaagctagaaaaaacccaaatggcttccaacagagcaatagttaaacatccatatgatggaatactacacaacaataaaaaagccaacttttgatacatgcaactacttgtatgaattttgaaggtattatgcagaatgaaagaagcccgtctcatattctatgaagccgttgatataatattaacaaaaagacagaaatataataatggagaacagatgagtgactgccaggggttaggtgttaggggaggatgtgactgtaaagggagttttttgaggttatggaactgttctgcatcctgattatagtggtggttacatgaacctatttgtgtgttaaaattcataaaactgtacaacaaaggacaaaagtcaattttacaatacaataacctaaagataaaattaaaaaaataccttttgggcaaaaatataaattttgggaacggtattagagcttcttagctgcctctgtcatcagttctgtctttggtgcctctcgtgcttgatctttatgtactagaaataccagaatatttatagtaccccaaacacactatgcaatcttgcctccatgttgagccttctgccttcctgatatggaaaactccttttcatccttcaaaaccttactcagagcatgcctcctctgtgcagctattttttctgatttcttctcaccaccagatttaagcacacccttttcggttctacttctgcttcttgtaaattatttcactactgtgtcttacaacttattataatgacataggctagtttttgtaattgtttcttcttttcagtaaattggatctccaaaactgtgtaagcttcaggccccacaaaatctagaccccaaatgaccaatctctctctcaatttgttctagctgctgtaacagaataccataaatgggtggcttatatacaacccagatttctcacagttctggaggttgggaattccaagatcaaagcactagcagatttggcttctggtgagggtacaatcccttgttcatagaaagcatcctcttgccttgtcctcaagtggtagaaagggtgaggcatctgtctggggcctattttagaagggcgctaatcccattcatagaggctccactctcatgacctaattaccttccagaggccctacctcctaataccatcaacttggcgattaagtttcaacctatgaattttgtggggacacaaacattcaggccatagcagacaatctctttccaaaaacagaagatttgtgagatcaaaagccatgtctatcttatttaccagtttccaaaacagcacaggcacatggtaggagcacaagaagcatttgttagatgttgaataagcaattatacgtataatgtgcatagctcttttcctgacatgtagtatgggctcaataaatctttgttaaaagaaggattactttgatgaatgaatgaatatgaagtgaaaggtaggtgaaccctacatttctacacaaggagatgttctctctgccttactcttccctattcatctatggtagcaggcaagctgatttccctaccctaagaccagtgatagtccagcatgggtgaagccatccaggaatagttaaggcaccgtgctacctacacgtggttaataaacaggctcttgttaacaagaaacagttatgtggaaatacttcatttccatctgtaaagttctagatttcaaagtggagagctgggatctcttcccacttcacccactcctaacatttataataaagcattgcctaacacagaattatatttttagagaaaaatgaaacacatgcttgagaactcaatcctattaacacaattttttcagtagtggtaaccattaaacagttatgtatttaacctttgtattctttaagtctgctaaaatgtctaattagttaatcaggaaaataattatttgctaaaaaagggaaatttgaaaattgtgtacagatgcataaaactgagttcaaaataaacttctattttgaggctttagtgcaatcccaatgtattagcattttatgattctttgtattcattaaaatgtttttcacaaaaatattggaaagtttcccaaagtcctcctcatgttcctcctggtgtatatcaaacagaatattggactcatctactcaaatcatagttagaattgtattttgtaagaggctatttccttggaagttattcaaaagatacatgtagggaaatattctgatttataaggtcaatctttctctgtcacaaatcaattataagtaaactgttttcagaactgtcttttttgctatttataatagtcaacttgtgaagcacttaacacacagaaatgtgtctgacaccaagattattgttaagggctgttctttcctttttattcagcattgtacgcatgtaccatttacatttattacgtggataatgggaattcatggtcttgaaggcatagagtgaagaaattacttctgaatacagtatgcaagctgaaaagtagggagtgatcatttcaaggttatagtgagggcaactaattttttccaatttggggagtaaaacaattttataatgcatttccaaataaagtctattttatatggaatagtctacagttgccaatcaacctgcccatccaatgcccctttccattggctcccactatcctaatcctaattagtctcgacttgtcctggtgcttttggcaggaagaattacgtttgctcatgctgttcccttgaccatgacatctcttaaaggcaattcactatattgtctgagattctaaaaattaaacttccctactgggatgggtaatactgagtgtcaacttgattggattgaaggatacaaggtattgatcccaggtgtgtctatgaggatgttgccaaaagagattaacatttgagtcagtgggctggggaaggcagatccacccttaatctgatgggcacaatctaatcagctgccaacgaatataaaacaggcagaaaaaggtaaaaaggagagactggccaagcctccgagcctacatatttttcctgtgctggatacttcctgccctcaaacattggactccaatttttcagtttggtgactcggactggctctccttgctccttggcttacagacagcctactgtgggaccttgtgagcatgtttaatacttactaaactcccctccatatatatatatatatatgaaggatatatacatatatgttctgtccctctagagaaccctgactaatacacctacccaagctaatgctttctctacaatgaattgcaaagaaaatgaaagctaacaaagaagatgagtttggctttttaagaaaacagttgaccagacataaaagatctcagggtgaggaaaaggcagttttcttctgaaggcctacagatggaagggacagtatgggtagctaaggtgactgaattcccctctgcacttagtgtgtctggatacaattattggctctggcaatttgggtgctgtgctttcaggacatagtgtatggtgaatggtgggagaattcaaatcatagactctgacaaaaagtatgctccaattctgtttccccatctaataactacaactgtggacaatgtatttcattaccctgagctttggtttctttatctgtgaactggaaatactaatacctacctggccaggttgtcaggattgaagatagtatataccaagtacttatcacagtggtttgttagcaaataagcactaaacaacagtagctattattgtaatgacgactacatggtccttatccttctattcagggtgaggtgagctaagatagttctaagagtttaatgaagcagcattgcctcatgactggtaagaataagaagacatggggaaaggtgtttatcatttaaggaactaaggtgaacagaatcaaaaaggggttgtattgtatcttaggaaactaagataagactggaatacagccatcaggatctatttgtaataggatgagagctcagttgcaaatacaagttccattcatttgatgaaagagtctggcctgactgaggctgtgttttgaactcattacagttagactcctgtggctcaatacccatttgtgctggggctgtattgttcttcatttcaacagacatatgcaaatggttctgagaaatgttagagcctgttcttctaaagtgaagttagtctttctcctggttcttactctagaaacaataacattgttgggtgccccctgtctttcacctcacatctatttcatccccaactaatgtcagtggtgctaccagtgcgacagtagactaacgtcctctggtaggaaggactcaactattctaacactcttccacatttctcttaagttgtgctggaagcagaagtgattgagtttcattcattcagtaggtattcaacgcctaccatgtgttaggtgctctcctttgtgctgaggtaaaataagtaaagcagacaccgtccttgacttcattgagctcagggactgagaaagatgaacactaatcaaataatcacagaaataaaaaattttaatggcacattgtgataattgaaacagaggacaaattgagaatgttctgagtttttaaggggcctctgacctatcctggaagtttgaggaaaggcttcctggaagaagtaccactggagatgaggtgtggagctataagtgggcctataggagtggggtggcgaggcgtgaggcatattctaggcagtgtgggacaaagtccttagacaagaagcagcccagggtatccaataattgaaaaaggaggctggggtgactgggggtgggggaggtgctaaagggtgaagaattaggctagatgatcccatagggaacttgtaaaagttaactatgcccagacccactcctagacattctgctttaattggcatgggatgggtccatggcattgccatattttatttaaaaaccaaactaaaccacaaacacacaaacaacaacaaaaacaaacaaacaaacaaaaacaacctcccaggtcattttaacatacagtcaaagctgagaaattctgaggtacaacatgcagcaccttgtagccatagttttcatcctaacaacaatggggagtcctttgaagattttaaggaggggggtaattagtattaacattatcagatttgcttttgagaagagccctctggctgaaatatggcaatggatatccatggcatctaacaaatcttgctgtgcacccggtaaacatatagtggtagactcaaagtagactgggcatcaaatttactgcatgtgaagactctagatcaaaatgcaacttggtggtgatagatcctcctctgttgaataagcggatcatttcattcaagactgtaatttctaggtggaatgcaagcacagactttcaaggaagcttgaaattcctgacttggtttgggtccatttagagagatttacaaagagaagaagcgatatttagggcacaaagctatatctggcacaggtgacttgtgttagacctggagactcaggcctgtctcttagcattgaaggttcctgagctcccagcaggccatgtgtggctcccaaatctccagtgggaaatatggaaacactttgaactcccttcactatcactgaaggaaacagaacccgatttcagcatggatattgatttttaaaatgcacttcaaatgcacagaaacttgtagtgggaatgcaaggagaaagcagggcatcctgagaaccatgttacatttaggtcattaatcaatacgggatcagaaattgaggaggtgggtgttacaaaacttttcttaatagaatatcatatatgtgacgtaaaaagtcaattaaaaatctcattgatgaggctggttgcggtagctcatgcctgtagtcccagcactttgggaggccgaggcgggcggatcacaaggtcaggagatcgagaccatcctggctaacacggtgaaaccccatctctactaaaaatacaagaaattagctgggcatggtggcaggcgcctgtagtcccggctactcgggaggctgaggtaggagaagggcgtgaacccgggaggcggagcttgcagtgagccgagattgtgccactgcactctggcctgggcgacagagagagactccctctcaaaaaaataaaaaaataaaaaaatctcattgatcacctttgctaagaactaacttaactagttatttgaaaacttttacaaaatattaattatgtttccaaatgaccaagattgaaaaacaggaaagatgagtaagtcttaccataaagttatcaggaggctacacaaaaactaacaagtaattacacgaaaatacggggccctttcttctctcaacttcgcagtttcactcttcctggtctctcacctactctctatggtgtattttcagtataaatcaaatataattatctaaaaagaatgaaagcatatatatttcaaaatagttcacagaaaataaaagatagcagatgagaatagagggagaaagatgtggaagagaagaggtgatggaagacaaaactttgccagaagagacaaaagaactttaaagtctaatttataaattgctaatctgaacaaactaatagtctttcaatgcactcagtgattggcgtaatttatcttggctttaacaaacatgctgatattgcttcttgtaacacatttattaccagaagaaaaatataattggtatcagtgtgaatgcctttggctgcaagtaacatcccaagtcagctagcttcaacgttaagcaaaatttgttacctcaaagagcaaggaatcttgagatggggtggctttgacaacttccgtatttcctccctgccattttcaaccagttagatttgcccctggcaaccatcccatcatggttgcaagatggctgccatagttcctatcatcttaagacactgtaatatctactggtagaagacatacagtttcttcctatatgattcattataaaaagcaagaaatcctttccccaaggtcctcagcagacctctctgatgtctcattgtgaaaaacttgatcaaaagccgacctgcctgtgatccatttaccagcaaaataaataagatctctctgattgaaggattggtgctgatgaatgaggttttaaccttgaataatgtaggggatgggtgaaccaacagagttcttctgggtagcaagaaagattgaatatttcttaaataggttgctataacctgcaccagtgtttctcaaacttaatgtttggaatcacctgtgatcttgtgaaaatacagattctggttcagaagttctaggctggggcctgagatcctgcatttctaacaagctctctggtgattctgatgctgctggtccacagacaacactttggatagaggatctagaccctagacaatcagatgagaagcagtctagtataatatgattgaatacagcttatattagactgtctagctgggtgatttggggtatgttacttaaattatctaagcctcagaaaaaggaaggaattggggaagaagaaagaaagggagagagggaggagaaaagaggtgtgtgtggggaggtgagtcgcagactcattgatgagaatctccaaagcagtggtgtttctgttcgcttttctaattcattaagatccctctgtggtgatgaattagagaacttggaagaaaataaacagcgtagtgtttaatatgagcattcaggaagaaaataaataaactatactaataaaattctgggaatggtaacaaatgtatatgtatagcagaataaaaaacctcagggtcccagtgatagcaaggtatattgaaatactgcagtgatgttacagttacaaaacatactctgcctttctgatgcctaacaatgcatatattatgttctgagctatggagttctgaaggataaagctttttgcccctgagtcatacccagaaaggaactgtggcagacttagggataggttatgaggaaggagtaaaggaagaggaatcctcattatgaaataagaccaaatgacacacctaacccaacttcagggggagataggtccttacttgacagggagaggcaaatggctgtttcctgtcttgacagatcagatagaaaagtgaacaggatgcagtagcagaatgagggtatgtggaaagatttgagcaggacccctgagtctagatccctcccagtcctgcttttcactagccctgagtcgttgggaagttggcttaacttatcctagtctcaggtgtcttccaagagctactgaaatagtaatagaagtcaacgtacacatgataaaacaggtagcaatggagatccattatctcacctactacctccctgataatcccataatattggcatcatgattatgtgttattaactctctggggaggggtggtgttctataaacacatatgatttcgcttactctccgtaccaagtctactgactcctttctgccttcaatagcaatattataatagcagaagaacactttgcatcagttattttgttggtcttcattaggcattaaattcagtcaaatgaagtagtgattttgattccaaaacacttagtgtgacagtccttacctctgaccttgttttgcatgtgtcacagtgttttgtaaacttttcctgaatgtgaaatggatgcctcgcgtgccctgctttcgccttgcagtctgactattccatttctgtgcacttgaagtgcattcaaaataggcaatatctgtgctgaaatagagttctgtttcttcaatgataataaaaaagaatgtcagttttttgcttaaaacccacaacaggtagttagtggaaacttgaaggtacgagttatgagcgactttaaaatatattttcttctgtgttgttaatggcttacatatggggcttcttgcagggtgtaggaaacttctaaatagtcctaggagacacacatgaacaaaaaggtcatggcattttgaaccctcactgctgccttctttacaattacccatatgacctttggagaggcatctcggagaacaccagggatttgcaggaaagccgggctgcttggcctggctactttctacagaagccatgactgctaaaatggactctcagtcatccccaggctgagaagttagggctgcagcttgatttcaaagaatgcagatctaaggtccaaggtgcaattcattgtccacacatcaattaataatgcaataccagactccaagaatacaagacagcagtgtttttcaaatataataacttgaggaagttggtgagaaattgatacaaaaaagtaaaatatgagttcatatagcaattcccaatcatgataatacttctactgggatatatccatttgaatttactgagaaccttcttatattggggtagtttagaattagttctatctacaaatagtaattcataatgactgtggtattggtgaagatgatgataatggtaagtggtaacatcttttaagcatctaccgtatgccagaccctatgctaagggctttgtaggtatcatcttatttaacccagtgcaaaaaaattgacaaattctaggcttaggatcaacatgaggataataaaattttcttttggtaattacatctaaggacataagtacaattcacaaaccttgaggtcaaggacttcacctttcatcttttgatggtgctgcacagtgcctagcagagaaaagactccacaaatatttgttgaaatgaaagaagcaaggaggaaagttttcaaagcccagaaatctgaattatatttgtaaaactaactcagtttaataaaatgtgtcagtgttaactacatcatttaaatgattattactttattttctaaatttttataacaaggagtttaacaatgctgccttagggaaataacagcacaaatgcataaagatggttgggtaagaatatttgtttcagcactgcgtggtacagcaaacataaaacagagccatttaaatgtgtgaatagagaggcaaaaagaaaacaaggatgcaaacttttttttttattttatataattaaaagattaaatgttggggtaatagtcacagactaaatatcttatattcattctgcagacatctcagttaagcatttggaattatgcatgattttttatttatttccctttttctgtaattttaataccacaaatctttttgcaaaatgaagagtccatatttttgctacagaaaccaggagatcagagttgccaatgtggaattatggacattggtgtgtctttctgaagagaaatctaaggctgctacgtgtaccagctgggatcctttcacattaggataattttaatggtagagcacttggcacaagttatttccttggtcttcattaggcataaaattcagccaagttaactactgatgcttatcccaaaacactttcactctaagacttcttaccttggaccttgttttcaaatatatcccattcagatttttcctaaatatctcccatccaagtactaatcagggcagaccttgcttagcttccaagattagatgagactgggcacatttagggtggcatggcctctgtattagtctgttctcatgctgctataaagcaatacctaagactgggtaattgataaaggaaagaggtttaattaactcatagttttgcattgctagggaggcctcagaaaacttacaatcatggcagaaggcacaggagaagtaggcactttcttcacagggtggcaggacagagtgagtgcaagcaagagaaacactagacgcttataaaactgtcagatcttgtgagaactcactcactatcacaagaacagtgtgggggaactgccaccatgatccaattacctccacttggtcccccacttgacatgtagggattgtaggtattacaactttgggtgagatttgggtggggacaaagagccaaaccatattattctgcccctggcagaatctcatgtcttttcacatttcaaaaccaatcatatcttcccaacagtcccccaaagtctcaactaatttcagcattaactcaaaaatccacagtttaaagtctcatctgagacaaggcaagtcccttctgcctatgagcctgtaaaatcaaaagcaagttagttacttcctagatacaatgggggtacaggcattggataaatgcacccattccaaatgggagaaattggccaaaacaaagaggctacaggctccatgcaagtctgaaatccaatagagccctcattaaacctcaaagttccaaaattatctcctttaactccatgtctcacacccaggtcatgctgatgcaagaggtgggctcccaaggccttgggcagctacagccctatgcctttgcagggtacagcgtcccacccagctgctttcatgggctggcgttgagtgtctgtggcttctccaggcccacagtgcaagctgtcagtggatctaccattctggggtctggagaatggtggtcctcttctcacagctccattagacagtgccccagtggggactctggagactctaaccccacatttcccttccatactgccctaacagaggatctccatgagggctctacccctgcagcagatttctgcctggacatccaggcatttccatacaccctgtgaaatctaggcagaggttcccaaactcaattcttgacttttatgtacctgcaggcccaacaccatgtgtaagcttccaaccaaggcttggggcttgcaccctctgaaacaatggcctgagctgtacattggccccttttagccatggctgggactcaaggcaccaagtccaaagattgcacaaagcagcaaggccctgggcccagcccatgaaaccatgttttcctcctaggcctctgtgttgtttgtgatgggaggggctgctgtgacaacctctgacatgttctggagacgttttccccattgtcttggtgattaacatttggctcctcgttacttatgcaaatttctgcagccaacttgaatttcttttcagaaaataggtttctcttttttatcgtattgtcaggctgcaaatttttctaacttttatgctctgcttccctgtaaacataagttccaattccaaaccacatctttgtgaatgcataaaactgaatgcttttaagagcacccaagtcatatcttcaatgctttgttggttagaaatttcttctgccagattccctaactcatttctctcaagatcaaaattccagaaatttctggggcagaggcaaaatgcagccagtctctttgctaaagcatagcaagaatcacctttattccaattcccaaaaagttactcatttccacctcagcctggacttcattgtccatatcactatcaactttttggtcaaaacccattcaacaagtctctaggaagtttcaaactttcccacatcttcctgtcttcttctgagccctccaaactattccaacctctgcctgttacccagttccaaaggtgcttccacattctgggtatctttattagcagtgccccactctcagtaccaattaactgtatcagtcctttcttatgccgctatgaagaaatacctaaaactgggtaatttataaaggaaagaggtttaattgactcacagttctgcattgttgggaggcctcaggaaacttacaatcatggtagcaaagaagaagcagacaccttcttcacagggcagcaggacgaaataagtgcaagcaggagaaatgccagacacttataaaataatcagatctcatgagaactcactcactatcacaagaacagaatgggggaactgcccatatgatccaactacctccccttggtactgcttttgacacattgggattatggggattacatttgagatgagatttgggtggggacacagagccaaaccatatcagccccagaccctaattaatcttgaacctgaaataattttagtgttgcctctctaaccatttgtgacaaagaatgagtttggtaagacttagttcaaactttaagttaacagatattctttatagaagagaaaaggctctagctgcctctcttagaaaaatacatatcaaggccaggcacagtggctcacatctgtaatccctgccctttgggaggccgaggtgagtggatcacctgaggtcaggagttcaagaccagcctggccaacatggtgaaactccatctctactaaaaacaaaaaattagctgggcatggtggcaggtgcctgtaatcccagctactcaagaggctgaggcaggggaattgcttgaacctgggaggcagaggttgcagtgagccgagttcacgccattgcactccagcctgggcaacaagagtgaaactctgtctcaaaacaaacaaacaaaaaacaaacaaaaacaaaaaagaaaaagaaaaagaaaaatacatatcaaaaataattataaaaattacttcattgctttacttgtttttctgtacacaacccagtgagttctcttccaacattttatcatggaaaatgccaactatgtgcacaagtagaaacaataggataataaactcccatatacccattatatagcttcaacaatggtcatctcctttcctaaatggctttatctgtaccctatcccttattttcccagtccctggattattctgaagcaattctcagtatatcatttgacctgtaaatatcaccgtatatatatttctaaaatatagaatagtttaaaaataatactaatacaacactgaaaatttaatattaaatttcttttccttgatataataagttattattcatttttaaattgtaacttttttacatagtttgtttgaatcaagatatcttgtgccttttttaatctgtaggtttctgtctgtgctttctctcattctccagcctccctccctgtatcatcgctatgattgctgtttatttattgaataaatcagattgttttcctgccaaatttcctctatctagatttagggattaaatatctcgtctgtccatttagagtcagctcattgtattcctgtattgtcattgaatatgttcccttttttcttgtatttttcctaaattaatagttttgtagctaatggactaatcacatcaattcaggtgaggtttaaattttttgtgtgggggaggtggggagtttgtttccataggtaaaagtgttcttctgtgaggaaaatacatgaaatctatttttctctctttctgtgatatttgcagtctttgataatgtcatcttttcccctgtgtatttttgggtctgggatgaaattttgtctttggctacattacctgtctagggattatcagagtcctggccccttcattttgctgagaaaattttgcgagttgcctatgaaatgtatgctgtaggtaacccagtagttactccgatagaacgaagtaaggagataagtggaaagtgagttaataattctaccactggctgtatacccttgcctaggttaagccccatgactgccattttcatcatctgtaaaatgggaataactatacctatggtttttatatacaaacatatatggcacaaaaacaatgtttaataaatgatagttattttgttgctatttaaataatagtactttgataatgatatcttgatgaaataataatatagtttagtctgtcatattttaacactggtttgctgacggcagcaggtttggtccatttcttctatttttatgactaatgttaagaaaataatattacaaaacttggaaataggtaaaagaatgactacaagttctttcaatgtcacactggagtattagttaacagtcctgcccaatgataatttcattttctctggatagctattttactattttcctttggtttagatattttatatttctctaaaggtaaagactggattgcagaaaattaacagtcacataaataattttgtctaatagaaatgtaagtgaagtttgtctggtagaagagataacctcaaaggttattgtttaattatccattagagcaaaagctagttttttatctatcttagctatctacttccacatttccttagagccaatgcaaactcagtctctcaaattttctttgaactagctttatcatcgtgctagttctatcagtgagttaaatcaatcttggacacatgcaatttatattcgtatgacagcaatgtatttaaatttttgaaaatcgtacttcaatatgaagttttcaatctcattggtgaattttgctggtctgtttgatattaattatagattctaactacgctgttgccatttctctagaactcatgggagggtacatattaaacctcattaacacatcatgagctagaacctgtactggttttaggtatgtagccaaagactaaatatccttattaatatcaaataacttttatttcgatgtatggcagtggtcatgcattatgatgttttgaatttgtcaatatattctgtttagaaaaacagaagttcctactatgaaagttagctttctttggctctttatttttaaagtgctttaaggtgtagatttccattttttgggggggttgcatttattcatacatatgtggcaattctaaatgattaatcaaaaagtatcataaattattttttcattcctccaaagactatcctgtaatttccagcccaatacctaccccatctccacctctttcacctgagtaaaggaaggagtctttcttgcttggaaaaaaaaatgtaaaattcaactatattttaaaatgctgagagagaaaggggtggggaaacagatggaggcaagaaattcatcagagttgaggaaggcgaagaagagaaattttgtagggtttttgagaggagattatatgagtgttgtggattgaaaagaaaaagaaaatttaataaaatcagtgagtaatgtgttggatctttaaatatcttcgagaagcttgggtatagaatgaaattaccatgaaattagtttataaatatggtttgaccctaaaccatgcttcttgaataaggaagtacttgggaactaacaacatgattctccaggtttatcatatcatgtctttagtctgaaaatatttattgaatactaatgatgcactaggctctcttctaaagtctggggacatacacaaagacagagagcctgcccttggggaacttacattctcactggaggtggggaggagaacagagaataaacaaagggataaagataagatatgttttatatgccaggtggagacgagggctacaaagatataacacagggtgagcaggctggagagagagaagtgggttctgttttatatagtggggtgaagtaaggtcgccatttagtaaatagcacatttatttctagccaagaagacacagttcatcagattgagatcatctaagtagacatcagattgagtaaaagtttcttagatctggattctggtggcccagagtactgaatctgcagtatttcacatccctcagaagctagtgctgctattatatttttcttggtaaatttgtagaacccagaattattttgaggggtaggcatgggttggagatacatattagagaagagagaactagagtgaactctccctaaaatcactttttatttagaaaaaaaaagagacgctacactgcatttccctagtcaaggtttgtacagttccatgccatattcctacaacatgtttgctcatcagagaaatgaaatgtgaagcagttctcttgtatcagtttagagctcctttgtcaagggagggttattttccataaattcaatgtaaaaggaaggaaacataattcactttcaaggtcattaaaagaataagaaaagttagatcctatcaataaaactttaatatgctaaactaactggcagcaagaaagagagctattttctcaataaatattgtatacatgtgctttgtcaattaactttttttgactgtgaacaaaatgtaaatgtcatggataaatgatagctttaatgatgtttttcagcgttgtactgcctgttaccacggcttcttaacaaagatgttaaatcattaggagtcatatttcatgataattaactacaaatctggtaatattaccacttttcatttggcatgaaatgacgagggagaaccatgaggtttattggaggtacatgacaaaggacagagagacttaatgtatgtgtataaatcttataaaactacctattggacagcattttatgatggacataaattcccattcactctctgctagtgatagacagggaagtctgcagtggaagcagaaagctgagatgggaagtcaccctagagaataaagggggcgtatgggtttatttctttgtcttacttgctcgctcttgcaacagctaaacagatcctcattctcgcctaagttttgaacaattagagtatgcactgttattaattctcttattaaatgtattttattataaagtttgcaaagatgcttttatgattaaggagctattggcatttgccattttacactactaatcttccatctgcttttctttgaaccttttaaaatgttcagcaaggtcactcaagattttattgtagggaaataaaagatcaggaacactctgccttgttaatattttcattccagcctgttgttaatatagagagatagtgatatagggcggaaaggacacttcttatagagttaggtaacctgatttgattttgcttattttgttaattttgatattgaccactgtatcagtcaaggctttttctgttgcaagtgactgaaatccaatgcaaagtagctttagaaaaggagaagacactatgttggttgacatagttgaaattttgaagaattctggcacagctctcaagaacaaatcgccccaacagggccatctgtaccaggctctccatgcctctgctttgctttccttggtgcaagcttcattttcaggcaggctgtctccatggtgagcagaacggcagttccagactcattaatcttgatgcctagagatcccagaagaagactgcagtggctaattttaggtctcaaattgactggactaagggatacccacctaattggtagaacgttatttctaggtatatctttgagagtgtttccaggagagactggcatttgaatcagtagattgagtaagaaagatccacccttattaagtgtgggcagttaccatctaattggtcgaaggcttagatagaacaaaaaggcagaagaaaggtgaatttgctcctttttctcttccggaactaggatcccgttttctcctgtccttgcacattggaactctgggttctctggtcttcggactctggaacttgcaccagcagtctgcctgattctcaggcctttggatttgtactgagtcatgctactgacttccctggttctctagcttgcagaaagcttatggtgggacttttaagcctccataatcaagtgggacaattcctcttataaatctcctctctgtctctctatatgtctgtctgtctgtctatctatctatctatctatctatctatctatctatctatctcctctccatcctattggttctgtttttctggagaaccctgatacaaagactgtttctgacactattgaccaatatccacatcaagggtctggttggtccaactgttcaccttagagttcatctatgaagctaggaagagagaacatcatgctttgattgtccaggcctgagcctgtgcctgcccgcctcacccatgggatggatgctaatcacatggtcttaaaagaattaatatgaagtggaagaggagtggttatctgaagaaggaaatgtcaagcagtcaagtagcatggatccactgcttggcattcattcactcatttttttctaactaacttttaaaaattatttaaaatgtttagtcctccttcaagcattgtgctggtagtgacacaaggatttagaaagggagaacgagcttctaggaatttaaattttagagggaaatagttatgtaagaaacatatataatgcaatgagataaagtattcaaagtcaatgatatattaaaggaaggatcttatgggtttgcttgttagagtcagggaaaccttcaaagaacaaacttaaactgttgtttgatttcctctatgagaaccgggtgcacatcggggctagagtggttcgcacttcaggatgaaacaaccgtgaagaacaaggaagtggcaggagatggagctaaacaggtcatcagaggtagatcttgaaaagcccttcatgtgatcaaatgaaattttattattttttctttctgtgagattggtgatattgatcagatgaataatatatatcaaatgtgtacactaaaaagagcacttttatgggcatgtagaggatcatttgaaagagtaacctccccagcctcagaggactttctggctcactcactcagcaaatattcattgagtgcctgctgtgtactgggtactgtgtgagtcaaaatgtaaggcaatgacaatggaggtagaaaaggagacaaatgtgaaagcaatttcacaaagagtaacacatttgatgtcaaatagctatggtagggaagacacaagactttctggttttccagtctgagctattgggaggaggcaataacattccctgagccagggattctctgaatctgtttactcatacataacatgacaacaataacaagaagccagaatcacaggactattatgagaatgaaatgaaataatacaaatttaaaaggattttgtaagctttgaaacataaaatgagggtaaggtgttattttaaaatatatgtaacatatttaaaaataatctctggttgcttttgattccatgatgatgtaattttctccccataagaagtatctattgggcagaataaattaaacaaaatggctttgctatctaactaaaataagcattatttatctcaaaatgccagtctttaccagcctcactttctatattctggcttttttcccattatgcagagtgttgatttggaggggggagtaaaagccagttgagtttctcataaagtttcacactgcagacttgggcgacagtggttttgtttaaagctgattcattgggatttcctaagagatgctattgtataggtacaataactgtttagtgaggttctttatgagacactcaggattatggatccataatttgcattcattgcaaacattgtaacaacttcttttgagccattaaaatgaaggtattgaaaggctgttaagaactccaccaagccgtgaaatcacaacaggttcatttattggagaaaatatcattaagatacaagccagcattacaaatccagatctcttctacgcagttgtcacatttaacttttttccagcctctctgggcaaaggaaggagctgttatttgagtaagttggggccctgaaatcattttgcaatgcacccatccaggcagccatccattcatccactcattcatttcaattcctaggtgctggggcagacgctgaagaaaataacatgctattcctacagagcttaattgtagagacagacacataaaatatatttgcaataaaatgaaaacatgaaatgataggctaagtgtggggtgctttggatgctgctgagaagacagggcggtaggagaaagaagcaattgctgaaacaaaaagaaaaagaaaggctgttccaggcagccaaattaataaatgagcattgtgttgcaaatttgtgaattctgctccctgggaatcagtaattctatcagctagccttttcacttccattttcagaatttctgatttaaagacaaattaagctaaatgcttagttgctccataaggagtctgatgtgaaaaacccatctatgccatcactgggggttctcattgtttctcatctgtaaagtcttttgggatttagatggatcagctggctgacctttgctgctgtcctatgagacataaagataatattcctcatatacctaaatcatctagcagaaaacctgagacacagtaggcccacaataaacagcagatattatccattgacagaatggtggcttggcaaagtattttaaattgaaaagaagaaatatgaattgcattcccaattcctttaaataattgcattttcttccatcttgtaattaaggtctcatctgaattttgccccatacctataagacattaacaacatagattcatttaaacaaattaaaaataatttcaaatttatttttaacaaatggttagactgtcttttgcaggtgcacaggaaatgaagtattattattagtttaaagaaaaatcatgacagtttcatgactaaaaaagggaaaaaattgtggaggacacagctgcacctgatatatatcaataattagttcctaatctcatgtgtttgtaacatataaatcatctttgtttccaaaaataagagcatagtagaatatctatgaattaaaaatgactagttttattactactactaataaccaatgcattgtaatccaaataaagctatctttgggttgtaaataagcaaacagaatcacaggaaggtacaaaacatccctgtgattgttgcattaagtaccaggtctcttaagtctaaatagattgtctcttgttttttcttctctttgttttgttgttgctttgttttttgtttttagagatagaggtctcgctttgctgcccaggctgaactcggactcctgggctcaagtgatcctcccatctcagcctcctgaatagctgggactacaggtgtgagccaccatccctggccttttgtcatatttcaattgaaataatctgggctagttttacaatagaggtaaaaaattccaactctggtgctttggaattgtataactgtaaacaagctaattaacttatctaatctataaaaaaaagggatgatattaatggccactcatgcagttactgtgagaataaataaaggtccagcatatgacccagtctggaggaggtatttagtaaaaaattgttgcacctatctttttcttagcttatcactcaccccgtattagcttttgcaatgctttccaatttgtaacaacccatggggattatgggagctacaattcaagatgagattttggtggggacacagccaaaccctataacaaagtacactcctgatttggaatatgtaacaattcaaatgcataataaaagaaacgtggctcagagtcgaagtgctgacttctaattcatgatgaaaatgctaactgccttatgaccttaggctagtcacttagccctggggcctctagctatacaattagctacagttaaaaaatgctacatcattattataaagtatggtaagtaactgaaataatggatgttacttaaaacgttatactaatttatataatgactgttttttcttggtttaatgcttccattcaactgtattttttttcatttcctacttctttattactgttagtggaagattttctttgccttgtttatgaattttaatctcatcaaattcttaacatcaggtttggaagggaacttgcatattatctgatggagtgaggtccctgaggtgctatttcctgcttccataccatggtagatgtcatttgaatctctttagtgacagagaactcactgcttcttgaagcagtgtgttcctgtgtttgagaagtactgctatgagattctttctaacaccaatccatttctcagctacttcttgccaaaattctacctttaagggctacatagaataagtcgataatccctgccacatggcatctcttcagaaatttgaaaatgggtaacatacgtattcctagactctatttattcgtcatatgcaatgatttaggtatttcagaagtatccattttacccaagatttataattagtatggtattataacacactgccatatctttgaatgaattaagttttagaatattgcgttattcatatatctatatgcactgcttaaatatagagtttttctattttttctaaagttacaggaaccttatgttccaatccatatataacatcagcacttcggacacttctgctgaatataggaaaaaaatcttcaatccaaaacaactaaacaaaaaaagaacatgttgaagcttgctaggtcaacgttcaaagcagaaaaagtttgcatgattgtgcctgagggcacatgaaatggaaataactatttcctaatcaataagtgtgatcatacctggaggtgaggtcaggggaatagggagcaggtatccagggccctgtctaaaggacaccttgtaggccccagggaaagagaccaaacctctgatgcaaagaaaacaacatggaggccaagagggccaaatctgtctatagatgtactgtttgcatggcacaatgttacaaaaaatacaggaggctgcttttaaaaatcaggagatttggccaggcgcagtggctcatgcctgtaatcccagcactttgggaggccgaggcagatggatcacctgaggtcaggagttcaagaccagcctggccaacatggtgaaactccatctcaaataaaaatacaaaaaaattagctgggcgtggtgatgggcacctgtaaccccagctacttcgggaggctgaggcaggagaattgcttgaacacaggaggtggaggttgcagtgagccgagatcaggccattgcactccagcctgggtgacaagagcaaaactctgtctaaaaaaaaaaaaaaaaaaaaattcaggagtttttatataaactctagattgcaacttctcttgaagacttggaagtcctggcaatattgggcctgcatttccactaatcaagcatcggatgataaagctgatgggatgggacatctccaggtgacctctttcccaccttttcctatgtgtaatgtactgaacccactgccaccatctttattgtttgcctgattcctgtgggcattcaaacccccagttattaggtacctggggctatgcctgcctttattatttcagccacatccttctttcttctaaacctcccgttttctttaattatttactcaacccaagatagcacatgtatgtgcaagctttctcaagtgtaattcttcagacaacacagggtggcttggtgctcagatctcctcctctgacaaatgttgagacttctccccttcaccttttcacctgtaatccagtgggtctccagtattttttcctgccatgctgcctgataaatggtattctcctgtgggctacattctcacttttaacaatgctcacttgggctgccacaaggccaaaaggagctgcagctatgtgcccagatgtaacctttgtctcttccttcccccaactgtgtggaattgacgttcttggtttttagtgacagaaaaccagaagccagttaaaatatctttacctggcctataaacccattaaaaaacaaacaaagaaacaaaacaaaacaaaaacactctctttaggcatcagggagaggcaaattaaaaccatggtgagaagtttctagacatcggattgcttattgtattactctttgtaactttgtgatatggtttggctgtgtccccactgaaatctcatcttgaattatagctcccataatccccacatgttgtgggagggacccagtgggaggtaattgaatcatgggggcaaattttcccatgctgtttcatggtagtgaataagtcttatgagatctgatggtttcagaaagggcagttcccctgcacattctctcttgcctgctgccatgtgagacatgcctttgctcttccttcaccttctgctataattgtgagtcctccccagtcatgtggaactgtgagaccattaaacctctttttctttagaaatctcccagtctcgggtatttcttcatatcaatatgaaaatagactaatacactttgactatctaatatagttcctaataacaaaaattggaaaaaggaaaaacacaattcttcctgcctttcctttcttgctaagtgcacagtctgttgagatgagaaagagaatgtgttgatgtggctttgaaaaagaggtgctgggtctggtaaccaaagactagatggagggaagtttctgtgtataagtgaaatagcgatgatagaatgccattttgcaaacctaattaattcaaggatctatgcaatacttatcaatgtctgtcatcacacacacacacacacacacacacacacacacatgcacacaccccagaccttaagtgtgtcttatacatcatcacttataaagtactttagccaccactcacaccccccaactcaccaatcctccagacataattgtggagtcctaataaggaaaaagaagtcaggctggtgggaccaggggaaagtataaagaaagagcagataagctacaagcctgcctttcttcatggtccaggacatgcagccctcctgtacagatagctcataatcttcctgcacctgacttatcacgagaccctcggctaatagaaaaatgcaagttagctcactgccacattggcattatcaatactgcatgtagccctctccagcatgagcacaatcctataaaatccccagcaagcttttgtctcctggcagtcagctcctctcttgatgatctgcctgttgcacccttgcaacatattttcatactttctctaataaatgtgccttttgttacctacaactgtcttggtaaatttctttaccacctacaccaccagccccagttagccgctacccacaacaataactattgattaggaagtgcagagaagagaggaacatgttaaattataccatagagccagcaaaattcctactggaaaattctacagatcaaatgacccagctttttcaacataaaaattagaagagagggggatagaaagagagagacagaaaaagaatctatttaaaatatgacttaaaagacatccacctgaagcaaatgtaacaaaatgatcacttattaattctgtttgatgactacaagggtattacacagaattgttctccatacttctgtagcttagttttcataattatatgatgtttctgtggtcaaaaacaaacataaagaccaaatttggttcaaaaaataacagagagagggaagtgagtagaggcatacatggcattttaattttgtgtatattggaaatactccatattaaaatttgaaaaacaaacagaagcagagatgccaatctcccccactgcactctcacatacctgactgctagagggtaatgttctgtcctaataagactgtatctacccagtctggaaaggaatttggttgtttctgatccctaagaagaatatctcatttgcctttttctatggtgttatcagaaaatgctttgcagcaaataaatggcaactccataagtggatgttaatgaaattttaatgaatctgaggtgctggcaccatatattcctgcagagctcagttttttaaaaatgctgctttaatgctgaaagtttacagaagaaaacagcaacattaaggccaaaatgaaggtagcctcggttggggagatttttcccagcgtagtaaattgtttggccttcatttccctggtcccctggaggtctgcaagccccatggtcagataccctgtggtttccagtgctgggcggcttacacaggagaaaggatccatgatttctgctttcgtcctctgctgcctcttgatattgagggcccctgcatcacttaaaatgtttattgcagattgttcctttttgcccttctaagtagtctgtaaactctattccaggcaggggctgggagagttattgcctgttgatacactcacccaaataagtgctgagtgttctttgctacacacatatggactttggctcagggcccagaatacctgagtcaatttcagaatccaattgttacagcgggcttgtatttttagagaagaaaaaggtgtgcatcctaagatccaaaagctgtctacatttacattccaactttctttttaattaagaagatcacaaaaatcaatagagaatttactagcaaagagggccatactggaatgatttggggaaagaattttgctgcattgacagaaagagggcaggggaggtgtttaccaaaccatctgtaactggctgggtttttctcatttatttcagattccattctctctattcattctccatcccatcccatccttggaccccatctcttccagaatgttaactatgccccatagctatgaaatgaattttccataagagaacaatttcctacttttatggtgctagaacaattgtgtgcattgttagagacccctatatgactttgacttcgtcagaagagaatagtaactctccattgacaggtcctggtgaccgaaagtataatcaaagtcagtgcattattaatgactcttctttttaatgactcaatcacagtgtgaaatgtttttcaaacattttattttatataatttttccacttgggaaagtctgcccacaaattaagggaacacaatagctgaataaaaccagaaatattgtgctggatgttctccaaacaaattgtccttcaaagagatggccagaagttctgatcaattttttcatgacaagtgggggccagataaaggatatacctggatcaggttacctgagaacacagattgagaactgggctttggaatctgacagccctgatacacctggctttattatatactaatgatatgatctttggctccttttgaaaaagctctcagggttggtttcttcctctgtaaaatgagcctactgaagcctctggaacaggggttgtgtgaagatcctatgagataatgcatgtaaagtgtatctccctgggccttgggttgttgactccttattctgttccaagcacccagagtggagaaaaaggcagggagagcaattccagccgctggctgtccatactgctctgagctctgtgacaggtaccaggagaagaaacagtggcatggggatgggcagggaagagaaatggaagcaagagagagagagactggctggcataagaagagtaagggttacattcagcacaattacctttgagatgtaaacaccaaacaacctccaagggtaaaagaagttcaagaattccagacattggtcaagtttatgtagttatgtatgaatgactttaaaagactttgaaactagtgtgtgtttgtatttttagtaacttactttttaaaaatttgcattttaggtgggggtcacaccaatggttgttggttacattctgcattccctttaacactttattttatatattaaaagagtatttatggggtgcagtcatgaaaatggctaccagttaccaggtgcctcctatatgccaggccttatgttttgcactcttcacatatgagctcatttaatctttctgcaatctctcaatgtattattatcctcattttactgacaaagaagcagaggcccagaagactaggcaatttcccccaggtcacaaagctattaaatggcaaaggtgagaatttgaatttaagtttttgatccataatctctgttttgactccaaaacccattatacaccaccaccaaaataatggatgaggctactattttgatattgctaataactggaagtgataaactaagacacagaaccatattttaaccagggtttgctgtctggttatttttctaacactgttgcctctgaagaaaaggcaggtaaataatgtgtgggtgtgtgtgtgtaaactagtaaatttcacctaatttatttgcatcctttctactgctatttctaacccccatttttgagactatcttaagagtcattgtctagggatgcagctacttaaggagcaaaacggtcagggtcatttaaaatctcttaagcagagaacatttaaattttcttgtttctggctactggtaacaaatcttcattaaatcttaaacacagaataaacaaagcatgaacagattgtgactgcttcctaattcaacaaagagagattacggttttgcagatactgttaaatgttggaacagaccctgtggaagtcattttaaggcccagagtattttcatgtattttggcctctctaaatcagtttttcccagaggaactgacattgccaaaaaatatgcattttgtttaaagttgtctggacaaagatttatgcttctgtgaccatctgcattatcacccatgcaaggcaatcaatactgtcctaatccagtcatatgcctactgatgctttatgtatatttcacatacctatctgcacaagagaaggaagtaattgcacagataaggaaaagcaaaagtagcaggacccagtttgagattagatcctttgactgctgggtccagacatggatgggtatgggaacccacctggggtctacttgaatgagggagaaaacttacccagagagaatccaaattagaatgtgcaagtgtcaaagcctcattctactgagaagagaggaagctttgagtagaaacatctagcttttctttggacaggtcttagatttatttggagacatctgttatggccccttcttgctttattttatggttccctattcacttgacgtagtccatgataccaatatccctcttaaaatatagccatcctccaaactgaacttgatacgtaggtacagccagagtatgatggcaattactgacttttttttttaacttacaaaatttactgttattaatgtagcttaagaccttggctttgcttttgtctccatagagagttttagttacctaaagcctccacgtatttgtaattcatatttaggccttgcaaagatgctcattgttctcaaaccatgattccaaacttagctgcatattggaatcacctgggaagtttcaaaatagtttcctgtatctcactgccagagagggattttgtaggttcagagtgtggcctgggtttggggatttttaaaagactccagatgattccaaagtgcagggaaatttgggaaccactgttctaaccttccaattcaaagtgtggtccatggcactggcatcacttgggagcttgctagaaatgcagatgcttgggctctactcagacctactgaactagactctgaattttaacaggctagctaggtgattcatgtgcatattcaaaaactattaatataatcctgattacaagacttactttgaaattttattaaattccactttttttcttgagcttcaagaagaagctacagtttcatcactggggctcagaccacatgtgaagcaactgggttgggtgtcctcaagtgggtagggttaaggctggtcaatgataaacctggcatcagtattagacattcaggctaattctggatcaaagtgaacacaggaatcagaagaagattaaaatatagttttagctctttgcttgcaaagctgggctgaagacccggatggaatgggctgttccttgtcctttgatttcccccgtctcagctagttagtttcttgagaggggagagaacagaggcctctgctatgaagtggggaggtcctgcctgcaccttggtgagcttgcccccacatggcaccactggcagagaggagaacgtgttctgcttaagaacaacttcagaggaaggacagcgagcaaggtgacagctagctgtagaagtcagtgaccattcgcctgccttactggcccactgagtcactccttccactgggagggtgggcatgtagtttcctggcagctgttgctattctagggggcacagtggaaatgtaggaagaggatataagtcttttacctcatccctttttgttgattgggaccagagagcagttacctggcaggcctgcccaggaggactggtcagaaggcctcagaggaggaatgagacagaagagtgagccagcacggggcctggttgatgggttcagagaatcagagaaagcagctcaaagagcagctgggctcatggtcaccaacttgccttgttcccaaatgatgttagcttcctagtgtcttcttttactcagagagttgagagttgagatttcctttggtttcttgaatttcagacaggtcactgaaggtatttaagaatcttacttatcaatgggtggaagttagtaagatggtaggtggcctttttttttttttttttttttttgtagagacaagagtattgaagtgcccaggctgttcttgaacatctggcctcaagcaatcctcctgcctcagcctctgaaagtgttgggatcacaggcatgagccaatgcacctgcctaaaattatatctcttaaagaagtgatttgtctttcagagatactacctagagaggcgccaggagagaaagggcaataggcagttatttagctttccccttccatcagttctggaacttagtcattctctcgcgtctcatttttcctctaactttcagatgtgcaaaggatgtcttaaactcaacaagacaggagaacagaaaatcccaaacaacccaccagtataaaacacacaaatgtaacaaacacaagaaaactcaatactagctcctctttctccagccaaactgacaatctgcttgttggcagatctctgaaacgtggtcggtgctcactggcactacttcctcaccacagccttgctctttggctcccagcatctggcccctcccaaagggctcaattgaaacctgtctcccaaagggaacatgtggcgtcctcattgccaaatccaaagccgtttcttagctcccgctccatttaatgtctttctgaaggtcattcctttgacatcgttgactatatttcatttctttctcttctggtgatcaaatgcatgagcttaggaatcagacagatctgaacataaatcctaactactgctagtaatgtgaccctgggcagataaaatacacacacacacacacacacatacacacatacagatgtgtatcttttattttgctctatagaaacgggatcatattttatactcttgtctgctgtttgccttactcacttaacagttcattgtggaactccttccaaaagagttggtgtagaactcactcattcttaaatattatggatgtatcacaaattattcaaccattcctctgttgatggatattccatttgcttcagacattttctactctgggttggtgatttcatcttatgggataaatccccagttgggggatggctggatcaaaggacacatgtatatttaatttacatttagtgggtatatttaattttaatagatgttgccagatggccttctaaaaaaactgtaccatttcacattccaccggcagtgtatgagtagctcttcctcaaagcattatagtcctgtttaattttttacaaacctggtgcatttcctcaactactatagaaattgagcatctttacaaacgtttattagccatatttggatgttgtgttctgtgaacctgctacttatatccttattcaagttacttaacctccctaagcttcagtccctttacaaagttattatgaagattaaataaaatatttatgtgaaggctttgcccaaagcctggcacaagtgacatgcttggtaaatagtagctgctgttaattcttttaaattcctttttccttatttagttaatcttcatcttcatacctttaaacatgtatctataagcattttccaaaattctgcaaactaatttttctctttgacatcttgcattctttctttctgaacatttcaattttacagtctctattctgttaaaagaccaatttgaacctctaatcttgacttgtcttttaacagcagaattgacggtttcaataccttgctggaccccacagatttatcttaccatctactccctgccccagcagcaaactctgcctcacaggaacacaacattcccatctgtgctcctgtattcctaaaggcacccttttctccaagacctatgggcttgagatcataaagtcatcatgccgccttgccctagacgttcatgtcagtagaaaagctccataaatcccctttacaatggctcttatagccatcctctctttcattgtttttactctagttcactccatcaacaacaatcaaaatagctaactaaccagtttttcctctgccagcgtctcactttttcaatctatttgttacattccagggaaaatcttctaaaacaataacagaatcatgtcactcactcagaaccatttatcagtttcttctattacagagtaacattctcactggccttggagaacactgccccaattcctttatgcaccgtatttttttcatgcccccagtctctttagtttctaccaacacgccagttctgatcactcacaagtgttttttgctcttctggcctaacagcctacaattcctcttccttctccatctgttggaattttatttattttcagagcctctcactctgttaagatcttccacgtttactcacctagaatgaatcaagtattctagcagtttcctatagtatcccccaatttaattattctgtaatatttattattatagtaggtcattttcacaattcttcttggcctttcctcaccacaagcttcttgaaggccagaatttactttttgttccttataatattttctttcttttctgtgtttcccaatctatttcttatctagtaacttttaagtgctcctttatttatttattttaattttggaataaatgcatgactggggttggagattagggaaaattgaatctggtgaaagaaaggagcgagttgtcttagattctcagaggtagcaatgggaccatgggactggtagcaatggtggccatgggactggtccatcccatagttgtcttttatttgcttcccatacagtagtaagtgaacacatgttttataagttggtcaacatttaccaatcaggatgttttatataagcatctggcttctcttgaaataaggaacatcagcaagactggattggcattcctggacggtatatggatggatgtgaggtatgacaaggtttctcttcaaacagcctgatcaaccttttgttctttaattcccagtacccctccccatctctttcttcttctttccttctttctgcctttactacatgcccaggcatgccacagcaccagtggcgttatcagcaccagctcatattcctttccttatttggaaaaggactggctctctagctcactgcagacgaccccttcccgctctcccctctctcccttacgtgcctgccttatctaaaaaaaaaagtttaaatatttagccaatcgggtctagcttagattgtgaggtctgatcccagccaatggggaaaggacacaggggcaggatttgcatcaggaataaaaacttccactctcctttggtctgtgtgccctcatggcaactggccatacgggaggcacccctctccacagaagtaaatttgctttgctgaaaaatcctttgtctgagtgctcgtttgcttacaactctgagctttatttctaacaatggagatgagcaactgtagccttccttgggttggcacagtctctcatccttgctatagcccccacctacatctcatacccatgaatattacctacgtgacacctatgggcatctgagtctgtaatcacagcactaactccatgtgtgaccctgggctggccaatggatccttgggcctcgtgttctcatctgttcatactttataattacacaactttagtttatcaagagttccttttatttgttttttttttcccatggatctcatgtttaagatattttctccatgaaacagcgcacctattgaacatatttacattgtttcacttacactgtcctctttttccaaaatgattcagattttaaacaatagtccagaattatctggttataattatattatgaaatctcataatttttatcatgtttattttgctaactaagcaacagttaaggcacacaaataaatgcttatgcactgtttgttgctattgtttgctggggtttttttagttcactgccttctatcccaatcacaagtccagtcgagttactgtgacagcctgacatgggcctctggtatcaatggctgggtccaccaggtctgacaattcctgtgataccattaggagccagtcagagctattacaatgctgagttgataaaattgtgtgtgtgtgtgtgtgcgcgcacacatgtgtgtatagagacttgagtagcatgtgtggtagccttgtcgtgaatgtatggataatgcttattattgaaataaccaaataaacaactatagaccgtaacatataaggtaaaatttgaaccctttccactctcaatctcattcccagttatttctttattgttttgaatgtaatggtctaacctttttctttcccttgtgtgcatttaaagaaactgtgaacatactataaattctatcttttgatttgctcttttctcattacttcacaatgtgaattggatatcctttcattccaggacattttcatctgcctcattcttcttaattgcttcctatcattccagtgaaggcgagtatcaaaaagtatttagctagtttcctgctgatagacatttagtttgtttccaatcctctttccaatttaatgatcagttttcttgatgaagaaggtggaggtaaaatagttattacctgacagtgtttctggccaaaatgctaactactgataggtatttgaaagttgactccctgtattcttgcaatatcctctgaattattctgtattctgaattatttgtaactgaattattctgtagtttactttttcctaaatgagaatctggacttaatattggctaccctttttattcataaagctaataactcaggttctgagcacttattatgtgccatgcgcatgctaaatactttacatacattatcccatttaatccttccagtagtcctaaaggcaaatactatactattatgtcaattttacagaaatgtagacaactaatttgcccaaagtatcataggtgtttaaggggggagagtttgaatacacacaaacccaagctagaagctatgctcttaactttgattgatgagagcacagggtctgttttctcagggtctattttcttccctgaatcctcgtgtatgtgaaactctaacagcagagtgaggaagagaagaaaggacttccctgtgtgctgggctaagagtgtaatcaggagcagactgttcctaaaaacagggttgtaggagcagcagtaaaagctcatttctgttacaactttggagacccctgtaatgctttcaaattagaaacttttattagtccatgttgtgttgctataaaggagtaaccgagactggataatttattaaaaaaagaggtttacttgactcatggctctgcagaatgtccaagcatggcaacagcatctgctcagcttctggagaggccacaggaagatttaacttatggcagaaggcagaggggagcaggcatgtcacatcgtgagagagggaggaatgagaaacaggggtctcttttaaacaaccaggaaagggcacaaactcatccataaggcaccccaccccatgacccaaacacctcccactaggcccccactccaacactggggatcacatttcaacatgagatttggagagcaaatattcaagctatatcaaagctctgcaccaaagctctatgctgatctcttgagaacaaatttatgcttgttgcagaaacacaggctatagtagggaaagctttggactctgaagctatagatttgctgtggaccagctatgaccacggtttcctccaccagaggataaggcttggatcttttggtctctgacgaaggtttttattttgaaataatttcagaattacagaaaatgttcaaaaatagtgcaaataattcccatttccatttaccttccacacagaatcctcaagtgtttacattgttccatgtttgttatgttgttctgtctcctctctccttacacacacacgtatgtgtttgagtttagtaaatgtcattatcatgttatttctatttcccaacttttggggaataagatatgaacataatgccctttacccctaaatatttcactgtatattaagaaacagagacactctcatatataactgtagtttaattattaacattaataatagtaatcttatctaatttatgcaccttgttcaaattttgccagttgtcctactaatgtcctttaaaataaaataattttcttttttttctggtctaggatccaatacaagataacatattacattttttgtcatttctttatagtcttctaaaatatggaaaagttcctcacaaaacgtatgtttgtcttttgtgactttgacatttttgaagtgtataagccagttattttctggaatatccctaattttgatcttaggatatccctaattttgatctgttcagtttttctcatggttagactcaggttatgcattttttcagggaatatcacagagcaatgttgtgtccatcttggtatatgacatcaggaggcaggcaatggatgtttatttatctcattacaggtaatggtaagtttcaagacatgatatggatggtatctgctcaatttctttcttataaagctattattatctttttgtaattaatttatatctttgcagacatactgtggagacataatgtaaatatcctgtttgtcatcaaactttttacccaatagttttagcaacaattgatgattcttatgtgaaacattatttctgtgttgcttatcaaatgagtgctgagactcttgctttacaacttttacttacaaagcgcttactgaacaataataaaaaaattttagtcacttcagtgccatgtagataagttcatcattcaacttggattagccatatttaactttgcaaggtctaattatggataccatttattaccgagattaagagtaaatatataagaaagatatagttcttaacatactgttactttaaatagatttgattagaaattttgctttgtgaaaaactactcaaacttccagtgttaaagatgaaggtcattcacattggaatttacactcttttaatggcttatgtatagttgaggtccacttacttgccaaattcaaacatttagattcaaggaagaagtccaactgaatttcatgattgttctcaaggggacaaataaaagaaatatagacattcagcacttcttggctacaaagttaaccctagggattaactttccacagcacacgtagcctgtgctctctccagcccggctttcatggtccctactcagagctcagcaactccactgaagtcttcaggaaaccactgaatcatttgggtcagactggcttgactgggcctccttgtgctttgctgttctcccaaagcatggaaagttttaatctaaacaatcattctttaactcatgagcagcttttcacctccccctttggattttgggtctgtcgcttctctgtcctatacaaagcaatgtggtaacaggcgtacccattaaaactcgtccatatctctacacatttagctgttatcattcctaccttacaaacagatggaaaactgcaggagataacttgtgtgcattggaagccttttctataacttctacaaagttatttttcatacaaactcatgtgttcaacaaccagttgagaaaaatcttatagattaaatgtgaaatcaaaagcaatgcagaatttctagaatttgcttcattgattttgtcaagttatacatctccaaggaaaagggggtggccattatcttttcctccaggtcctctcttcattctctcttccctctagcagggggaaaggcaggacttaattagggagggcactgatagctgatgattaccaaactaatgctggcatcaccctaattggcacctagcaccttgtgttgctgagtaggagaaatttcttcctctaatttgtgcttctgaagcatctacagatctggcaatttgccttgtcttcttttagtgccagcaagcactaattactttattatttgatttacttcttaatgaattggtgacttgatttaaaaaatacttattatatatttgcttggtatcaagaactaagctatagagtggaatacaataacaagacagaatatctctgccttaggaggaaacagacatgagacaaataaaatattataatattctatatagagtattacgggaccatggagaaaagaacgatttattctgtctgcaaaaataagagaaggcttcaaagagaaagtgatatttttgctaggtattgaagaacaagaggagttcctcagaataagaagcgaataaagattttaagtatgtacttagaggtatataaaagtatagtgtattcagacaaaggtttagagtccaatgtggcttaagctaatgccatttggagactactcaaagcagtaaggatagttaggtagagtgtagaatcagaatcaagactaatgcaggtttccatttaatgtctgtgttttactagcatagtatggccagattaatttatttagtctttctaaccctgtattatctcatctgtaaaatgaagataatactcatttctcagggttgttgtacagattcaatgggaatatttataaggtgcctggcagaaagcctgggaaagagtaactttttaaattattttattttatttttcttttactatgctttggtctacttcccctaccaggtagaaaggtaagaatggcaactgacgagcctggaagtagaattggggcccaatgttgaaagcctaaaatgccttgctctggggtgtagatttcatgcgtctggtcagctttctttcaacaaattagatttgcttgaagctccaaaagtctactcatttggtttcactccaacccaaacaaattccatttccctgagagctgccaatcatggctaagtgtatatctgatatctaaataaaatggttcactggaaggcatgactatagtaaaaaagagaatgatgcaactcagaaaagaaaaaagaatcttcaacaacaatttaaggaagtgttaatcagcattcaggaagtgaggattgagaaaatacatattgccacacacatgcatgaacttgaaggacaaaattgtgttagacaaattgagttagatcctcagtgattccaagatcttgcagaaacagagaagtcctcagataagggaaaggtgaaatccagtcaagcagagaaggggcttggtgagtgactttccttttacatcgcactcagataacagaaaggaaatttcatccaaacaggaagatcaactatggctagcccgtttgcactatatcccaaaggaacccatatgtagtttatgtgatcaaagacattcaggggaaatattagaatcttttaataaagaatgaccaataaatagtggtcggcattgtttcactttccatatgttttactgcccaataaaccaaagagaaaaatatattttcagagcagaaaggggataatagaataggtaaagacttagtaaagtaggtaaagtaggtaaagacttagaagaaaattgtaagaaatccaggtggtaaataaaatctatattttaaattgttttcttatgcatattttaggatccatgataaaaactatgcagtaatggttaacctgtagtattaatgatgaaaaaaaaggcataatttttaagaacgtgcagagaatagtaatgtttgatagcaaaaacataagcaaaaacaaaacaaaacaacaataacaaaaacccctttgcagataataacaggaaaatagttaagtaaattactatctctcatttggtagaattgcatgctggtattcaaatatgttttgcagagctaccatttgacccagcaattccattactggatatatatccgaaagaaaacaactagttctgccaaaatgacacatgcactcgcatgttcataacagcactattcacaaaagtaaagacataaaatcaacctaggtgcccatcagtggtggattggataaagaaaacgtggtacgtatataccatagaatactatggagccacaaaggagaacaaaatcatgtctcttgcagcaacatggatggagctggaggtgattatcctaagcgtattaactcagttacagaaaaccaaatactgcatgttctcacatataagtgggagctaaatatcgagtactcacaaacataaagatgacacaatcgacactggggactactagagtggggagggaaagggggacaggagttgaaaaactaactgttgggtactgtgctcagtacctggtgattggatcatttgtttctcaaacctcagcgtcatgcaatatactcaggcagcaaacctgtacatgtatcccctgaatctaaaataaaagttgaaaacaaaaccaaagtgaaattttaaaaaaaaattgttttggaaagtaatattttagtagccaaagagaatatcatcaaataatctaaataaacaaaaaaaattaaagagagataaagtgactacatataaatgaaaaacatgcatcatagaaaatgtaacaacgttaaaggaaaagtgtcagactagagagactatctttgaactattctttgaactatttattaaaactacttgtaggaatttatcctatatacatactttcatatggtcttaaaaacacatatgcacactcacacttttgagaagattgaacactggatatttgacatgtagaaattggtgttaatttgttaagatgtgatggtgctatttggctttgatttttaaagtccttttttagggatataatcagacatatttgtagataaaataatacgatgactgggatttgcttcaaaataacccagtgttttaagggcttggggagaagctggtaagttcatagatcagatgatttgatgattgttgaagctttgtgataggcacagaatggtttagtactatgtatgctttttctacgtttgtgtatgttggaagtgtcctataatagaattgtttaaagaaatatacagaaccgtgtatatagtatgcttctgtttacataaattaaaggaaatgtatgttgtgtatgtattttttcatttatgcttatgtttatataaaaacatagctgtaaggatagacaagaaagtaggaacagcagttgcctatcaggaagatagttatttgacttggaggtgttttaggaaggaaacttattgttcatggtatatatacatctactatttaaattttctaccagtatctgtattccattatatgtgtgtgtatatatgtgtgtgtatatgtatgtatatgtgatacactgacttgaatatacagacacacatacatatataataaaaaatgatttattcaagatattaatttactgattttctctagtacatgtattcatctatctatgcctttagtataaatatttgcatatatgcatgtttgtatttatacacatttatatatttatatgtttgcatatatggtgaaatttgtgtataaaacttttaaatattctcagttaagatcagaaaaaattttgtaatctgcttttatcattttctccttaatatatcagtcaaaacctgattttctgaaaagcataaatttcaaaagttttcactgaaaaaatggagaaattttgccttttaaaaaatgatatgcggccgtgtgcggtggctcacacctgtaatcccagcactttgggaggccgaggcgggtggatcacgaggtcaggagatcgagaccatcctggctaacacgatgaaatcctgtctctactaaaactacaaaaaaattagccaggcatggtggcgggcgcctgtagtcccagctactcgggaggctgaggcaggagaatggcatgatcctgggagacggatcttgcagtgagccaagatcacaccactgcactccagcctgggcgacagagcgagactccgtctcaaaaaaaaaaaaaaaaaaaaaatgacatgcaataactgaagttgatttcttactggagtaatgtgtggaatgtttctcttctgttttgtggaatccctcctagtgctctcaccttctctgggggttttcttctcatttctcttaatgaacaagtcaaggaataaggtgtgtgttgttgctcactatacttctgcctaccaccacctcttccactgggtgtagtggatggggaggctttgaaagagataaatgaatgtctatgtgtatgttggatactctaaagctcaaattcctgaatgtggcatttttccaaccaaaaacgcatatgagcagactaatacattttaaaatatcaattttcaaaaatattttttatttcatgactaaaactcttctgaaaatctgtcccataattgtgttattattttttcactcatcccacttattttgtgggtctaatgagatgatatttgtgatgcattagttaagttggtaataatgggtagctcttcatggaaataatgaatatctaggacaaaggtaaaatatcattaaaaggtaaaatatcattaggaccagtaagttttacccagtgtcctgttgaaatttacatggtgagtgatgtcagcaaaaatggtggaaaaagtagtttcaagggcctgttgcttttggaaaccaagaaatcaagtaaaagctgtcagaatcaactttgtcagcacgctggaaaacagtcaaatgtttacagcaaccaagtgaatgcttaatcgaaaaagaaaaaaaaaaggcaactttaaaaatgagcggacaggcacagtggctcatgcctgtaatctcggcactttgggaggccaaggtgggaaaattgcttaaggtcagcagtttgagatcaacctgggcaacatggcaagacaccatctttacttaaaataaaataattgttaaaaaatgatataaaaacttcaaggtacttttacataccctttctatactcccctacccggcttggtagaatttttgaagcccatgttcccagtgtgagaccgtgtccctgattttgtagggagaaagcaagactttatctattcaaacaaatcttggggcttgcctgagggactgatgcaagttgtttgtctttattttgcctaaacttgaactcattcagggtgaaaaagcagtgggtatttcttgaaaatattatagggtcaatgaacaacctccagccacctggggcaaaaggttgtagttgaggcaaataatgaagaactgaaatcctgggaggaaaaactggaaagatagtttatctgggaaactaaatcattcaaaagtgtctgtatatactggagagattaaaaaccacatgcacacccagtgcaggacacctgttagaaatgacatgagaagaccttgagctatcaactcatgctgattgctaggccaatgcaagcaggaagtgaaggttaagacagaattttaaatagcatggctaagcaatcaaggagtgccctaacacagagctaatttcaccagatgatttcaataaaagattcaagtaggtagaagaaagaatcagcaaactggaagtgggtcaattaaaatgatctcatttgaaaatcagagagaaataagaatgaagaaaagtgaacagagcctaaaaaacctgtaatatgtatgtatatgtaatacactgacttgtatatacacctaaagcatattatcatgtgcatgattggaattacagaaaaataggagagagaaaaagaggcaaaagaatagccaaagaaataatggccaaagctctccatatttggtaagatgtaaaaatccacacatataagaagctcaatgaatcccgagaaggatcgacacaaagagactcacggtgagacacattataaccaaactgttaaacactagaaacaaagaaactctgaaaagcaacaagggagcagtgacttgtgtccaagagatgctcaacaagattaaaagcagatttctcattccatggaagccagagagagcaaaatgatatatttaaagtactcaaatgaaaagacagaaacaacaacaatcaaccaagaattctatatctgacaaaattatccctcaaaaatggagaaattaagacatttacagatggacaaaatctgaggaagttaatagtagacctgccctataggaaatgttaaacagaattattcaggctaaaatgacagtaagttgaagtcatatgtagaaataatgaactctggtgaaggtaaatgcataggtaaatgtaaaagccagtattattttatctttggttaataactcctcttttgatttcttatatgatttaaaaggcaaatgcacaaaaagtataaatatatggttaattgcctcacagtgcataaagatgtaatttgtaacaataacaacataaagcaggcaaaagctgcatttggacactctttttatctattgaagctaaattgatatcaattcaaaatagattactgtaaatttaggatgctaattataattcccacagtaaccactgagaaaatatctttaaaaaacacacaaaaagaaataaggaagaagtaataatggcacactaaaaaaaaaaaaagtcagttaaccccaaaagaaagcaataatgaaggaaataaggaacaaaaaaagtataacatatacagaaaacaaatagcaaaatgacagaattaagaacttccttatcagtaattattttaaatgctcatggataaaattttcccaaaggcagaaatggtcagacagataaaaacacgattccagagattactttagatctaaagataaatgtgggttcaaagcaaaaatatggataaagatattccatgcaagtagtaaccaaaagaaagccagggtggctctactaatatcaggcaaaatgatcttttagtcaaaagctattaaaagagagaaagaaggacattaaatattaataaaagagtctattctttaagaagccatagcatttataaacatataggcaacaaacaacagagccaaaagatatgaagcaaacactgatggacttcaagggagaaatagatagttctacagtaactattagagatttaaatatcccactttcagtaatggatagaacactgaaatggagaccaagaaggacatagagaacttgaatagcaccatacaccaactagacctgacagagattttgaacactccattccacaacagctgaatacacattcttctcaatttcttctgggcctgtttccagaatagaccatacggtaggccacaaaaacaattttcaattaatttgaaaagactgaaatcatgtaagtgatcttctctgaccacaatgacatgaagttagaaaccaataacaacaacaacaaaaaatactggaaagtccacaaatatgtgaaaaataaaattaaataacacactctttaataccaataaaccaaagaagaaatcactctggtaaattgcaaaattcctaaacatgaatgaaaataaaaacacacatacacaaacttacaggatgcagaaaaagcagtgctcagagggtgacttatagctgtaaatgccaacattaaaaataaagatctcaaatcaataatccaattttgcactttaagaaagtagaaaacaataagcaaactaagcccaaggcttgtattaaaaaaggaaataataattattagagcagagataaatgaaatagaggatagaaaaacatcagagtaaacctggaggaccttgactaattcccctgactaaacgaaaatggtgatatttctatagacctacaacaaaaatatcataagagaatattcgaactattacagaacagagataaaattgacaagtctctagaaacatacaatgtagcaaaactgactcaagaagaaacattagtattagtgttctccagtgaaacagagctaagaagatatctatatctctgtccatccatctaatctatctatctatctatctatctatctatctatctatctatctgtctatctatctctatcaagatatttattataaagaattggttcacttgataatggaggctgaaaagatccaagatctggagaaccaaaaaagttgagaatataagttccagtccaatggctttttgagtctggcaggcttcagactcaaaaacaaccagtgtttcagtttgagtctaaaggcagaaaaatagcaatgtttcagctaaaggtagtcaagcagaagggtttctttttatttagttttttttgtactgttgaggttttcagttaactggttgaagcccaagcacattagggaggaaggacagtctgcattactcagtctactaattcaaatgttaatctcatccagagacactgttacaaaaacacccagaatgatgtttggccaaatgtctgggaccagtcaagctgatacataaaattagccatcagagatatagttaataaaactaaaagttagatccttgaaaagatcaacaaaattgtcaaatctttagcaagacgaagaaaaaaacagaagttgcacttaattgaaatcagaagaaaacagaagttgcacttaactgaaatcagaaaaaaatagaagttgcacttaactaaaatcagaaatgaaagtggtgacatttctatagaccttctaccacgaaaagatcataagagaatatttgaactattgtatgctaacaaattacaaaacatggatgaaattgacaattctctagaagcatacaaggtagcaaaactgactcatgaagaaacaaaatttgaacagatttatataacaagaaattatatcagtaattaaacacttcccaacaaagaaaagcctaagaccagatggttttactggtgaatctactcaacatttaagcaattaacagcaatccttctcaaacttttccaaaaaatggaagagggaacatgttctaactcattctatgtggccagcttatcctgataccaaagccagacaaagacatcactagaaataagaaaattatggaccaaaatcccttatgattatagatgaagaaatcctcaagaaatactagcaaactcaatttaatagcatattaaaaggattatacattataactaaatgggatttatcacagaaatgccagagtcattcaataagataacagcaatcaatgtaatacaccatattaatagaacaaaggaaaaaataattatcttaaccagtgcagaaaaagaatttgacacaatccaaaacctttcatgagaaaaatactcaaaaactagaaatgggagaaactttctcaacatgttaaaggacatttatgaaaacctgatgattaataccatggtcaatggtgaaagactgaaacctttctctttaaaattaagaacaagacaaggatgtttgctttcaatattgctgttcaacattgtactaaaagttccagacagaggatgtaggcaagaaaaaataaggagcattaaaattggaaaggaagaagtaaaactatttctaatggcagataacatgattctctatattaaaaattccaaaaatccacaaaaagagaaaactgctagtgttagtaaacaaagtcagcaaagttgcagggcacaacatcaatacacacaaatcagttgcttctatataccagtaattaacaaactgaaaagaaaattaagaatatacttttctttagaataagagcaaaggaataatatatgcaggaataaatttaaataataaatgaattgtacacttaaaacaataaaacattgctgaaagtaattcaagaagctataaataaatggaaggcatctaatgcttatgaattagaagacttaaaattgttaagatggcaaaaatacccaatgctatgtatagattctatgaaatccctctcacaattccaattgtccttttttgcagaaatgagaaagtcacctactagaatagcattaatccaaaatctgaaaatagcaagtgttggtgaagatgtggagaaactggaacctttatgcaatgctaatgggaatgtaaaatggtacagcctccgtaggaaacagtttggcagttccttaaaaggctaaatatagaattacatcatcccctagaattttcacttctaggtaaataccccaaagagtgaacaacaggaactcaatcaatacatgtgcattgaagcactacgcacaatagccaaactgtggaaatgcatgaatggagaaattaattgtggtatacaatggaatattttttagccataaaaaggaatgaaatactgaacatgctatactgtgggtgaacctcaaaaaagttatgctaagtgaatgaagccagacacaataggtcccatattgtataatctcaattatatgaaatatctagaattggtaaatccatagttatagaaattagttttttcattgccagggggctgtaatcccagcactttgggagaccgaggtgggcggatcacctcaggtcaggagttcgagaccagcctggccaacatggtgaaaccccatctctactaaaaataaattgctgagcgtggtgactcatgcctgtaatcccagctaatcaggaagctgaggcaggagaatcgcttgaacccaagaggtggaggttgcggtgagccaagattttgccactgcactccagcctggcaacagggcaagactccatctcaaaaaaaacaaaacaaaacaaaaaacattgtcaggggtttagaggagggggaaatagctaatgaaattattacttattgagtaaggaattccctttggggtgacaaaaatgttttggaactagatagatgttcacatagttgcacacattttgagtatactaaacgccattgaatccttcactcaaaatggttaattcatgttcttgaatttatctgaattgatacaaaagtaaacacaatacatgtcttctttacttcagcttctgtttaccagactacttggtgagaggaaatagattcttagagtctgacagacctgggttcaaattcctcattcattcattttatccatttgataagttaagatataaatatcaccacaacaaattgttgtagggattaaataagataaacaggtgcattaatgaagggtaagtaatactagcttcaattgctagtgtttctttctaatgcagcagtccattgtgggtattcctgagtagggaaacattatctatggtcatcaggcacttactccttaggtccctgtagtattcttctatcaaccagcaagcagagaaagacatggtagatctcttatggaaagttgttatgagatggtactggataatggaatacatcacttcttttcaaactccactgatggtaactcagtgtcattgccctgcctagccacagcagaggctgagacatgtagactgtgtttcaggaagaagaaaaagatttgggtgaggaaaaaaacaactcttgaggtatcgtacttgtatgaagcttcttgttcagtttgtgataagcacttaataaatatgaactctcttctttgtgggtaagtgagaatccctggcagcttctgcaaagttgtttcaaaatgcatgccatcctgatgacaggccactcgttgtggccttatggcaaagtcagttgatagggctgccaggcagacagtgagcagaattctttctggactctgttcctgcttgttctttttttcttttgtgttttggaacttcccttgactttggtcccatttagtttcccaatgtctaacttgcatttacccttctttcacagcttgctcacctttagcttctatctgactaggtctttgtgttttcattttgccctctcaacaaactatttctagtccttagctcagtagcttcactgagcaggcccataaactcccttttgccatttccacttcccagtcatatcttgaagacttccaacttaaacacattaatttatgcttgggatgattgttaaaatttctctattcctacatcttgtaattagcttagctgatttttaaaacaaatcctctaagaattatttttatgaaggccatctggtaaaacaaattaatctccaaggaatgttaatcagactaattgctaattaggtgtcctccttgattctattagttatagattggaaagtgtttgtcatatacattaatttttgcaaagatagtgagaaaacattattttttgccctgcaagagaacaagtgaatccatttgcatgtataatgtatgtgtgtggtgatattaaaagatatccattttttgttgttgttgtttttttgagacagagtctcactctgttgcccaggctggagtgcagttgcatgatctcgactcactgcaacctctgcctcctgggttcaagtaattctcctacctcagcctcccaagtatctgggactacaggcacatgccaccatgcccagctaattattgtatttttagtagagacaggtattcaccatgttggccaggatggtctcaatctcttgaccttgtgatctgcccgcctcggcctcccaaagtgctgggattacaggcatgagccactgcacccggccactacacacagtctttaaacttaaggggttgaaatttattctaattgttagtgtctcagcttcattattcctcaaatggttttgtggttcatggagcttcagaaatatgtttttaaacatacaaaaaaaatgccagtggattcaactcaatgaaagatggcaaatgagtttaattttatataccaatggtctgataggaattaccttgagtatattgtagagaatgcctgggtgggacggggatatttaccatgcactcactatgctcctctgtaatggactgagtagtgattcacaaaaatggagccacaaataataaaaaatcatttgtgctgaccctgaaaatgtgagcctcaaaataagacaaaattaatcagaaccagacaaactttaagggaaaccctagttctttattgaaatgtctttgtgccaaggtagttaagtgaaagaatggatgaaaaccaaaattcgtactctcccccgctcaactatttagcctgaggtaattattcacttatggaaaggagtgagtatttttggtcaaagtaatttaggttttatgaatgatttcttcctgtggttttatacatatttgtagagagtatgaatgacattctccctgaatttgtcttctatttagtggtggattggtttcacagttgtatgagacttcagggatcttcctttttcctcttttgttgtgaattctctttttataatagaagcatgaaaaaagtctgcctattagaaatgtgaccttggaatccatgaatccatgaatccatatttggaatccatatttataagaaatgaaatgtggtatcaaggaaggaattttgtctggaaagtcagatctgaattctggtcctgcctctctgtcagtgagccctgtggttgtggctaagttgttccatggtctctaatgacctcaactatgaaataagagcttggggttcagtttttaggtagaataatgctgtatgttgatgttgacattctgccattctgcagtgatatattgcttaatttgcctttgccagttattgagcacgagggggcagtaattggcagattgccccctttatttcttcttgacaaacagccaaattttttggcagctgggaattgttattcttcaccatcctgccatcactgacagatgcatttgacaggaccattggcttgcaatgccattccactcttacaagtaaagtctataatgcttaaagaaaaataaaaacatatgatattcaacttttacaaaagagtacatataatattctttatctgtcaatgtaaaaatggtcagaaacttttcagatatatttgattttcctttccatgaaggcttcatttttgtaaggatttttaaaaattaatagagaaaaaaaccccataaggactctcaaaccagtggtctaaaatggaattaattttgtccccatcaattgctatttctttgcaaatatttcttatcttggtgaatgatgaaccatttagcctctgacccaagccataaacctgttagttgtcccccttagcttttcttttcccacacccctccatcatcttgcattctgtctaattgattcagtaaatctggttgattctacttcttgtgtatttttattatttttcctttcttctccactggaaacttttatgactctagtttatactctcatctaggtcactgcctatgtccctaagttgtatccccagtgtctaatgccatcacactccctcctttaccctcaccccaggctacacttgaacaggtagagcagggaatgccatgtagacctcatgtagccaagttggaggccctttccagttcatccccttgactttattttaaataatacatgaataggattgcagaacttttttttttgttttctgtgatgctcatgcttgtgcttcttctgttcaatgtgacaaggaacaagatctctacaatgaattgtaccaatgctccaggaaatacttgccccatttttttttaattttagtttggtttaattcctctaaagtaacatcaagcaatgtgctataaaacagaaatatgtcttgagagatagttattctctctttctctctctcaatttaaaaagggttcaattttttactgcttcaggcaagtacaattttcacatactctgacatctcatgaaacctatagccaaagatttaggtataacctgaattcttccccttcagctcagtctttgattgtatacatgctcatccctatcctcaagaagaagtttacatcttatctcctctctgaaacccgtatacaacaccccaattcagtaattttgctggggactcctaatgctcttcttgtttatatatatcagcagctaacgcctgttttgtatgagctttctctatatgtatcatgatttgccaaaaacattgtcaactctttgatggcatagaccctgcaattaagccctcagattcccttgtttaactgatggcccagatagcaaatgcttgaaattgaagtaacgttctccttagcctctaacctgtgtcatcacattagctgaccttaatcagggcattaaaaacacctaaatagagactggtggccttcgaaggaggtcttttttgtccttagaatttttaaataaatcccactgtcaaagtcatcaaccacaagggaagtagaaaaggtggtgttggtctttagcacaattaaagaacctattagctaaatccctggcaggccaaatatgaaggcaatataggtaagtcttattacactctgaaaatcaggattaaatatttacaagtttgcataacttgacctttcttgcaaagagtattaaaactgtttttaaagaattccttctgctcctatgtaaaagggcattcataaggcctccttccacaggtggacaaagtgttcatctttggacttactgataaaaattttggctcttctgaggtagtagcagagacagggtagtcagggtagacagggtagaatgctaactgtatcctcaccacctgacaatagaagtttaaagatgtaaaagtatgataacatacaatctttcaccccattggtccttgttgtcaatagctctggatagctaggaatgtatttacttccttcttttgccagggttcattatttgtaccttgcaaatctgaacatttggccaaagtctatgaccttttgaggtacaaggaaatggatttttagttaagaatatttacaaaattaaaattacaaaaccttgtcccagctaaagcttgaaacacatctgtgtttgttcacagcttgtaacatttgaggctccccatcatgttaaatccttcctttttattttaaagtttgccttctcatatgccattgttctcctttatatttgagatgatggtctaggttttcagacagctctgggaaggcaggtgttaaattttaagctagtgcttggtaacctccatggtgaaatatgccactgtttaacagatgactactgtgctgtggacagcagtgccccaggagagaggaggtgtttgttccagaatctaatcaagctatggcctgtctgcatcctaacttatgcagtgtaatcacttgtatcattcgtggcatgtcttccattaatcagagctagtgcaggtaccaagggaacaggggttccattagcatgacatatggtggccttcccaaagttttggatgttttggaagatggttgcagggtttgtaccagtcatacaagagctgcttaatgacttagatattagtaaactttttcccaggcatttaatatcttccccgtttcctcttagtaatcgtagttaggttcttgatgtcccctgtgacatttttatatccatcaccttcaggtccaaactgtttgatttgctgcttcatcttggactcctcatatgtgcttctagagaacaagtatataaaaaagaaagtatgttttcttaattgcaaaagtgatgaatgaggtaggcaatcaggactgtttttcatattttcagagatgctgaaaatacatttagatttgttttcagaacaaaatgagaaaattgttttggaaaaaatgttataagtttggttactttggaaatgtcttcataaatactcatcttgataatataatttatctttgctagtctcatataacaatattgttgcctttaaaatggaaatttgtaagaagtttaaaattccagctttacatacagccccctttaaacctccccaggcattcatagatatgttaaaatatatctaaaataatactaaagcattacatttttttaccttattggataagctaatataaaagatgttttatccatttcacataattttaaattttaaaaatatgaagaccttatgttatttaaaatttattaacaatttatacactcccttctcctgacaagtccccatatattcttaaagataaattccctataaccattttttaaagtaaatggtatatgcttctatctgtcttggctatcacgcatctatcttggaagaaaattgttgggttccaggactgaatattgtactcacatttggataagacaaggatggggctctaagaaaaaaagcaagagagagttgtgtgcatcacaaagatgatgcctctcccgtgtccccatctccaagaccaagcatatacagaaatagccacaggtggctagagaaggaagaccagaagacatccaggagcatatggcaaggcaggaactattccacattgcagggtgagggaagagttaaactggtggagagcaaatcagaaatgcggtgaattcccaaaatattgggacaacaacaacatgactttggctattgtaggggatgaaaataccttttccacactcatcttaggttcatggctgaagcccctacaacaaaatacagattaataagagaaatgtgtatgaatttatttaatatacattttacgtaatacagaagccttcataaggaaatgaagacctgaagaaatcataaatgtttgtatttttttgctaggtttgacaaagagtggacactcacgggcatgtatgattggaggaaaaaatgttttaatctaataataacaaactgggagaaacttagaaaggcctatttgttcagattactttctgtgtccttgtgtcttctgagataagaatattccctttttctgggtacagggattgcacctctcacatgatggtcacgtgacttcacaaaggcgaggagaaggtgagagtgatccccttatttgtccattctcatgctgctaataaagacatatctgccactggataatttctaaaggaaagagatttaactgatttacagtttggcatgactggaatcctcaggaaacttaaaatcatggcagaaggggaagcaaacacgtccttcttcatatggtggcagcaaggagaagtgccaagcaaaagggggaaaagccccttataaaaccctcagatctcacgagaactcactcactatcatgagaacagcatgggggtaactgcccccatgattaaattacctcccacaacacatgggggttatgggaactacaattcaagatgaaatttgggtggggacatagccaaactatatcactgccccctacttctgctgttttctcatacaccagcatgccatattttggggtagtgtgtcctgaaccccatcactatcatgtgatggatgattgggttatatattctatccagcccttactctcaacctgagatagctaaagttcattaaaatagatttttgcttctactatgtatcagggactggtctaggtacttgacacatatcagttaatgaaacagaattatcactatccttgtggagtttacagaaaataagcagtaaacttaacaaataactaaattatatagtatgttaaaattgataagtagaatatatatttttataaaatgaagatgagaaggatcagaagggtcaaataattggggccaaggtccaaggtggggatgtcactgcacagtatttaatggggtggttggttaggacaggcctcattaggaaggtaatagttagataaatttttgagagcagttagggaatttgacaagcagatacctgtggcaagagcattccaggaagtcagaacagtaataacaaagactcaggaaggaggccagtctggctggacactgtggccagagggagagaggaggggatgagtgccgaggtgcaataccacatctgatcatgtaagtccatgcaatgaccttgacttttactctgagtgaaacaaagcagttttagcattttcagcagaggagaaaaacactctgatttatgttttcaaatgaatccttctggcagttaaatgagaatagacatagagagatttttgacatcattgctacttgtctggagttctcattaagacacagacctagaattgtccccataaatatttaaatcagagtcaccaaacatgacctggtgtcaaaccacaacctggacagaaattaattgcattgcacagctaaacctggggtctccctgctggccatatcagtggacttgccctgatcattttcttaatcttacattaacacaccacattatatgcaattgaattccttagatgccacttattattttatggcagttttactgaatgtatcgaaacccttaaagatgttctttttctttgacataacaattacactcttagaaatttccttaaagaaaattatctaaaattcagaaaagaatgccaaaagatatttaccaaagtataatagtatataatagtgtgcgtatatatgtatatataaaatagtgataaattagaaatgatctaaatatacagcgatgaagaaatggttaaaatactatggtgtatttataaggtaaaacactatacaccattgaaaacaatgttaattattggaaaattcttatgaaataatgcaaataaaagtaggaaacaaaacatacagaaaaaatctaaaaggaaatgcagcagatgttagcagagtctattcgattgtgtaaaatattcttctttatgttcctctgtatttacccttcttccatccaccattttcaaattattttatgaagttttctccagaagataccataatgaaaaagcttagagacaatcccaaggtcaagttcagagtgtatgatagaggccctttggacttgttcagggtgagagtggtgtatctgtaggtgatttagggtgacgtttggaatctggagatctcagtctacatgaatacattgctcatctggcacttgggtaggttatactttcccaggtagttcagctttaaagaaatgatcatatcctttaaaaacaataccagtcaggtgcagtggctcatgtctgtaatcccagcacttaggaaggcagaggtgagaggactgtttgaacccaggagctcaggaccagcctgggcaacatagcaagaccccattcttcacacagaaaaaataaagtacataaaaataaaagtaatatcaaaaaatgaaaatacaatattttaaaacaaaatcttgaagtgaattcacaaatttttcagatgtgtgtttaaatacacatctttctccttgagagtctagcttctatgctagtggttctcaaagggggcttaaacttgttagtaatgcagataattttaggattctatccccgacctactgaaacagaaacgctgatggcaatctattggtggggctcaggcgtgctaccccaaaatgctgcacctttggcatttgagaaaacagcagacacagaggagggtcactcttactttttcctctcccttgtaaaatcataagacccttatttgagaggtgccttcgctatacccagaagaaacatccttatctctgaagacaccgggacatagaagaatctgagcaaacaggccttgctaagtttccccgagtttatcacctcctttgtccagtcatacttctccgggactgtccactcttcaaacctaagcataaaagtacacaagctaatctgtttctttgggtcttcattttctcatgaagtctcctatgtcatgtaaaacttatattaaataaatctgcatttatttaatatcttctttgtatggagcctccaccatgaaccgagcaatgggccaggaaaagacatcttttcctcccctacaacgtgttttaacaagccctccatgtgattgtcaggcagggctctaaatttggcaagcactgcttggtgttgagtattcagaagtgacagactttggtagactccaggctcagcaggcagccctgccttcagagcatccgtccatgaaaacggatggaaaatgcagaagggcctctccctatcagaaggagaactgagccccaatcaaggtgtagattagtggttgggcatgtagaggagggctgatggaagattataagcagaccatttccagagcaacaaaaaatgtaggactgcttcctatttcaagttctatttctagtaacccaaactgatgttagatgatcacagcaagaaaaaaaaatgtgccaaagctaattcaggaaactgccacctgtttggggtggggtagtcaatatcacaggtagaatggaagacttcctttgcacttctgactaatggattaaagtgacaaaattcaaactgggctgttaagtcattctctataatattgtggaatcgctaggttttataagctcagaaggcatctcaagtttagaatccaagagtaaaattctgttctcagcaagcttcttactgccctgaagtaatttctcagatgggcccacgtgtcttctgcccctggctatctcttacttgtggcttgcataaaagcctctacgtgcactgctgtcgttatttttttctttgaaaacggaggcaaaaatacttcagctttgatgccttatgaaaagagaaaatcgtgacatcttcttaatatgaaaaactagacaaggttgttaatatttaattgtctaagccagatgcagtaacacatgcgaatgtgttcataagtttggaacaggggatgcatttgatttactcttctacaactttccaagtgtattttcattattttacagaagctcatataaataactgataaaatcgacttgttaaaaaattaattggatttgtaatataaagaattctttttacccatagtaatatttgttcgttatagattttatctttaatttttaaacttctgttattttgaacctggtgaggtctacttggttgaactattaatgaaccacatgccaactaaagttgatgtgattctttcataaatcagtatatgcatttataatgcacatcaattttttttctagaagatactatgtgtgaaaatgtattaatttaaaagaattagttaacttcaaagagatgccttggaaattttatcttaaaaattaaaaaagaaaagaaaataaataactgagcttcagacaatttatgctcagtcctcagaacataagctctaaaccatataaaactttatttggtcagttgctcaaaatagtatcaaatgggaccatcttcccaaccagactttcttctcttctcttgcaaaacttctcttctcatgtcattttcaagaacttgctttatgaataccttttcttgtactttctgagagtatcagattgcaaatacatatccatacatgtatgcatatatgcaaacatacacacacatgcacacacacataaaacttctctagggtaattttcagatggcaaaacaaagcaactcttcctctgctcttcactctatacataattttttaaaatgtgttattcctgcaatagtagttaaaaagaaaatagtatatatcgacctgaaagtgtatctccccagctcacagaggggtcttatttcactatgataaaaacaaaattaaggttatagttaataggtgaaagcaaagatcttaatcaggatgagttcaaaatgctaaagaaatgggtattgtgtaggaaatgggaaaagtttgaactgatagtgtgggctctccagtgctgttgacatgggcatatcatttttgtccaggttaaaagaatatttaaatattcttttaatgcaaaatgcaaaaaatgcatttgctgctaaagtaatgtattatttaacatagctgaataaatccagttcaatcatttgagaagtgcacataataaaataatgcttcagcctaatcaatctaaggcttttatttactctagatctatacttcatacgcttaggaggaaggttttttgctctaaaaattaggcgcaagtaaaatttttcctaaagtatgaaatagggatctaaatttgggcctcacaggccagcattacaattataatatatgtgatgaattaatgtgattaatttataattgatttagataaaaacaagctttaaatatgggattcctaatacaaatgtacagtattcacattttactaaggaaagaggctgttcttacagcccctttgaaagaggccgttcctacagcccctttgaaagaggcctttcatgagacgatatatgacgtgaatattgttattatttattttggtcttcttacgtcagcatttcagctatcctttatagttgctttgatatatgtttcttctatcagtttgtgtaaagaagccatccctccatgacctttgtatgaatatgagtgtccttttctgttggggatagaagctgagaccacagatttctttgcacagcaactcagatcactagtccatgaagttagaatggaggagaaattactggcaggaaactcagaagtctgcctttagcaaggaggaagaggaagctcagcttctccctcttggcaccatttctgttagtctgagacctgtaatgtgtggttagaggtggtaaaacccaatgggtagatgctctttaggcttgagtaatatagaactcttgaataattggaagaaatgaaagtagagttctttcaagtaggaacacaaagctatttacctagagcaatggttcccagagtgcagtcctcagatcggcatcttctacatcaacctgatcttcttagaagtgcaaaattttcagccccactccaagcccagtgcatgagaaactccaggtatgggacccagcaatttgttttggtaaactctccaggtgattctgatgcatacttatatttgaaaatcatattctttagagggtcagtagcctcttttctgctgcctctttcagctaaagagcattcagcctcttaagctcagtttcatttcctttctcctcgaaagcgaattgtttccttgacaggtaggtagtttagatttttgaaatgcagaattgagagaaaggggaagagaattggatcagaactgagagagaaattttctcaagagcttggagaagatcagcgctggaagaagagtttcaggtaggggaaaatagacatgtagccatcgagtctgaagtcatctggggtttgaatcttggttctgccacttagatgatgcagggctttggtccacttatggggcttctctaggactcagtttcctcatatgtacaatggagataaaacaacagtaatttcctcaaaggcgtgttaggaggttcaattagttaatgtattatatggagtatgacacgatgttcaatatccattaggtatcattgctggatgaagtatattctattaattgtgttcagaaaaaagggagcaacgaatcacagtgatttgaactttactttttgattgctggactggttactttgcttaaaaaaatgctttctgagaacagaccacatgggtcacagcttcaagaaaatttcaaaaggaatatatttttccaagtagagcaatgttaaaagacattcagaatccaagacaaataaaatgctctgttattacaaagctattgtaggtcctcagttatcattctctctgctccaactctttgaaaagctcttcccaaaacagagggacacaagttctttgtcccctgttccctcatgagcaaactgaaggcttctttgcctcctagtatatgggtcttttatttctaaaactgacttcttaaagatgtcaactagctttcttgtgtgcaggtcttaaaacatgattccttcagcactggattgaatatccagtgaagatttctgtaataactttctaagttctttttttcctctatcatagagttccattggccaataagaagagcattttgactcaccaacatagatttttatttttgacctcttcactctattaatggcaaatagtaaaagattacatagtgtggtggaaacagcaagatatttggagccagacaaggtagttctgactcaacctctaattagctttttgacttaggaaagtcatttatcttcttggatcaattttctcacttagttcagctttcaactaggacaatagaaccttacagggatgaagagacaatcaagtgggggaaaaatgattttttttaaaaaaaaactgcaaagtgccattcaaatgttagctattgagagttaatgataattaacattcactgagtgtggatgaagagctgggcaccatggaaagtctcatatatacatatctatatttatttacaaatagatataagattattgcaatgtatattatgttcaatttgttaaatttacacagctagtaaataaaacttagaaaatgtaattttcttagctcatgtttaaacatttaaacctcgattagaaacatgatcagctttggtctgaaaataagagaaaactctgacacaatctgatgaaaccaataaggatacttgctatcgctcataacgtgaagttcagagagacagtggacgccagagtgtctttaaccatattcttatagttaccatcttttatgacaatcatcacagtaggctgtgttagaaatttctaaagctgggaaaggcttcagcagtcagagtctagactgttttcttacagcagggaaaatcaagattggagtttcaaggagctaactcatgatagcaccaggggatggtcccttcatccaatccctgattggaaaacaaccctaggccatgacagtggcagggacttagtttgcttagtgacttgctctttataatttctagataaatctgcattttgcttcactcttctctcatcagagaggttgagttcttcaaacacttttgttgttatttctcaattcaaagagcaacataagaaagacatgctcttactaggtcattccaaggtttttttttccatctattatatgtaatcagatttgtatctctgttgtagaaagtcttatttttctttatgtctgttaaaataccagtaggttctctattctgctaatgtaatatttcttttttttgctgttcctttgagctggggcacattttattgttttgtgttaattctgtgattttaagtctgtatatcaaaattgtagtcctactaggcatgtaaatattataataaatacattagtaatgcagacagcctacaaaatagtttgctagtttgctctaaagatatttctggctgtgataatgattaatttcagataccctgcatcataattttcttgaaatatgtaaattacttccctctcaaaatttcttatgtagaaacacacacacgcacagacacacatacacacacatatttagcaggtcgaaatgaggttcttgaatctgcacaaaagttgttgatgccaagcccaaacagtacaattgtgagtgcagctggtcaggtcttcaataccgttcccttctcctcaccattcttcatgcccaaggggtctatttgcatttcctagaacatgccttgcgctttctagccttcagaccttttctcccagtttgtccttcacttaggatgtcttcttttagtatctccaactaaatgaaccccaccctttcaccaatagggttgaaaatacattttctcaatatctcagacaatcccaggccagacaaaaccccaagggccagttatcttttgcatttcttgagcactggttgagcatcgtgttagtaaaattaaatgttaatctcaaacacagagtttgagaggaaggcattcctgttttgcaagtcattgtaatttcccccgcaggtagcactgtgcttttagatgaagctcagtaggtggaggcttaataaactgttttttggattgatggtatgattagaagtaagaagacaattttggcttaactaagagaaaattacaaactagaattaattgtgtgttttaaccaaaaaaaaaaaagaaaaaaaaaggtgtggaattgatcttttgtttactgtaaacatgttttccttttaaaacctttcacagagactgagtaattttgtgctatctctttgacccatcttttgcctgcaccctctcatctctttctgcatcaccctcatgaggggccaagctttctttttaggttgctctcttccttttcaatgtgtttatgtatttttcttcttagaagttttgggaagaattcagttacatttcaaaagtcttgctcttcagaattaaacctttagccctgtgccttttgattggctctaaaagtgcgtgtgtggcctgcggggacagttgtcagcgtggcatctttcttccagtgtgcccctctcctgcccttaagcattccatttttccttttaaccgtaacactgttgctttaagttgattttcaacaggtcttttgactttgatgatttcccaagatattgcatgtgtgaggtgaggagggtgtatgcggacttgttctttcctgggttagtgactagcctgagagagtttaaggagctaaacacaactatttccttgagtatgagaattatgattgaatatagctctatttttctccacccttgtctttgacatagtcttctcactttctgcatctttctgaaacatctataatagttttgaccctgaactttattctcttaaccagtcctatcaatattgtaccgttttgaagttaggaggtcataaagccattaactaatttggaagattcatcaatggctttgaagagctttacaaaatatgctgagtattctcaaaaatcaaatcagatcaagttagaattttaagaatttattgggcatataaagaacagtttgtgttttgttttgtttgttcggttggttttgattttttttcctggagaaaggttagtggctcccagagagtctagggcaaaaggctagtagggcctgatctaggaaagacttcttgacatttacttgagaggggcatgcaaaggtaaatcaaaccatttttttacacagttttagggctacttagtttttcttttaagattttctttaaacgtctgcataaaggttttatttatgttttaattgactaataaaaattacatatatttgttgtttacaatatgatgtcttgaaatatctttacattgtagaatgggttaatcaagctaaggaatgcatacattaccacacatacttatttattatggtgagaacacttaaaatttactctcaactttcaagaatacaacatattgttagtaactatagtcaccatgttgtaatgtacaataggtcaaaaaaaaagagaacagttcatgaattgggagactttgacatggaaacatgacatgagtctcaatattacaacaattacagtacagcttgtagaacatatagaaggaaggattttgatcttttttcatgattggttatatcatttttgaaggccattagggctgtttaagctcatttctctgtagctgtattggtttagttacactgaatcatgttagtaaaggactaaaagcttacgtttgtgttttgtttacatttcacgttagcctttcagggaaatcaggatgatataagttttggttacttgactataggcagttggccttggggtaggtaaatggtggccttcatttttatttatttatttattaacagtaccctctctttttcaggtgagctaaactatttatccaagcaatgcttatttctccctatctgcctctctcttctcttctcctcgctaaacacagacacaaaccccaattagactgtaatattacggtatagttttgattctacccatcgtgacttatgagacattgcttaaatacacgctcttattttttattcatccaaatctcctcatccagcttttcacccatgtttttcttcatatgctgatgaattcctttcccagagaatctagccaattcttttgaggctggctgctagctccctccccaaggcctccacttcaaagtgccctgctgccatagcggaaccaccaacaatctttttcaaaacaacctggatttttttttttctccttaggtctgggtatcaatcagacacagaggagctgatgagaactggtaacctaaaacaggatgctaagaagcatcactgacatttatctgggccttaatgtgtggcaggaatttttctaaggacttttccttatgtgatttcatttaatcatctgaataactccataaagtattattattattatcctcatttttcagatgaagaaacaggcctaggggggtaagttacttgcctaacgtcttttagtacaagatggggcttggattatgaacacagaggatcagcctccagaatttcagttcttaagcactctgccaaatggtgcattatacaagtaggtacacacccctattttcaaaccttgactggaaacacaagcattatggttcattttaaaatacaatgttaacttttcagtttataagcatgatgttcacaatttagatgatacactttggaatggtacactctgtatatttgggacatttcatttggcagccactgaagcttgttaatatcaacaactggcttcattggctccttcaaataaacccgtttaatctattatagctggcctctagcaaatatgccataagtagaaataaattttgagttaaagaatattcaccgtgattagaagctcaaaagaagtattttaaatgtgtgtgtctgtatttgggtatgtataaatagataggtagatagacagatgggtacatgatagatacctttgaaaacctttttcagttatgaaagcatttagtatatagtgttaatagaattttatctatcataggttaggtgtattctgatgttcagtttatgtttttaaaataatttggcagaaataaaagtattgacaggtggattgccactttggcaattttcactctaagacatcaatcgacaaagcaccaaacagcaaaacatattactcattgactggtaagtcataagccccagaggctgttgatcatcctggatgctggatgcttgcctactgtaggacagatggaagaactggctgctaaatcgtttctagcacttgacgcccagcatgattggggatcctgagcactgctggaaaaatatttctctagtaacttatcttgtgcttatcagtgaatttgcaagcccaagagagatctgttttgttgagatggcttctgaacaagtcaaactcatgtttccaagccaatttctaatactacacttgttattggatattacttgaaccagtttctgtttatggaacacttagaaaatttaattggaaatattcattttgtgattcaaagattatttattgtacttttgctggaaaggctgaaggtaaaagtatggctacatatcatttggcctgattttatgattcaaaaccaaaaaaagaatatgtcctgtaatatcttttccattgcaatgtagttttaataatgctgcagtgagtggattattgaccaacatttcctagtcctggagccacagagagaaataagtcatgtaggaaagccagcatggcctcactggctcccattatcttgattagtaaggtaggattgagggttaggttttctttcttttatttttcaccaggccccaatatgtgctttttcgtcctttgtcaacttttctttttcttttttctttctttctttctttcttttttttttttttttttttttttttgagatggagtctggctctgtcacccaggctggagtgcagtggcatgatctcggctcactgcaacctctgcctcccaggttcaagcaattctctgcctcagcctcctgagtagctggcattacaggtgcccaccaccacgcctggctaatttttgtatttttagtagagatggggtttcaccatcttggccaggctggtcttgaactcctgacctcatgatccatccgcctcggactcccaaagtcctgagattacaggcgtggaccactgcgcccagctgtcaacttttctttttaactctcctttgaatagacctaacccacattgttgtgttgaattttgatgatcaacagtactctgctcgggcttcctggatccagagccctgcaagagataaagtagcaacaggtaattacttggtgaacaggagatattgaaattgaatcaaatgtcctagagctctttccgccagactaacctatccccagcttactatggaacacacatagactttggcttttagcacccttccgatgcagtgcctttcttccctgattgcactgtataaaagctacaaatcatgcttctctgtctacactccaccccgcaaacacacacttttttttttttgccctccatgcttactattctccttctgttcacatggtctttcttcaaaatacagttatttatttatatatggtaaattttttgtaaagatagggtctcattatgttgcccaggctggtctcaaactcctgggctcaagcaatcctcctgccttggcctcccaaaaagcataaaattattttgaatagagagttgggaatgaaaggaattcttggattttaagtttatagtatttgggcttcttctataaatagctgatcccatatattatggaaagagaggttacttgttttattctgtaatgatgcatagacgaacaccacaccggacccatttcacaaagcacgtcctgcaaaaaccctcacatccacactcattcatattttctttggtacataaaacggttagaaagtattgacaagtagttttcacattttgattatgtgatttgctctttgtaacttttttttattattgctcacaaaataattaaacacattcctattcatgcagacaccattatcaattcatgttagattaaataattttaaaattaattaacttattaacaaaataatattatagtatcttatgaattgcctagatatggcattgttttgataagccaaagactaccccatgataacatgtatttaggagcaaccaagagaagaatataggaagtctccagagaattctatatacttgggcttaactatggtcaaagtattgccctgaggccacttttaaagcacatttctgattcaaataatggttttgacatatgttaaggaaaatgttggcaacaaatctagagatgaattgaagacttattcactttacaaaaatatttcttcaacatgcaaaagcatacacctctggaagtctatatttcagctttccctagtattgactagtagattcttactgagaaaaaaaatgaaagaagtaaaagtagatacatttaaaattaaggcattaagactatgcatggtggctcatgcctgtaatcccagctattaaggaagccaaggagagagaatggcttgaggccaggagttcaagaccagcctagacaacatggcaacaacctgtctctacaaaaattttttaaaaaattagctaggtgcggtggtgtgcacttgtaatcttacctatttgggaagctgaggcaggagaataatttaagcctaggagtttgaggctgcagtgagctttgatcacaccactgtacttcagcctgggcaacaaagcgagaccctgcccctgaaaaaaacccagtaataggaaaaaaaatacaattaaggcatcaaaagtgattgatagtttaacatgcctttaacctaaaagtaaaaaatctattacattataatgtaaatcaatagaaacatgtcatataatttacaaaatgttggtgaacatacacccttttgagacacatgttttctgcagatcaacgcaagttgcacaggtataactactgacaaatggcctccagaagttagagcaggcattgttaatttagggctatatgggttccaagagtcccagccaatgtcagactaggatcggtcaactcctggagttacgacttggcttgtattttgacattttttgtgttcattagttggaggatttgggtggcagtaggaatggaatctctagggtcagcatccctgtagtaggaatttgagtctgaaggaatccttgaatggatatcagtggatctataaaaactttaaaatcacggacaaaaatgtatgggatggggacaagccaataatatggtttaaatatttctaatcttttattttctggtcagggaaggtcttttattagcttctgttagattacgaccaaggatactcgattgaattgcaaataccagaggactaaattactgtaatatagtaaaaatgtgacttaaaacattaaatggattaaggagaaagcaagaaaagagtgaaagtggggaggggagttttcggaggggtggaacttcattggtggtacgggaatatatgtgaccttattatggaaatattctctatcacacacccaccttgaatctgtgtgaagagcagagggcgctttgctttactattatcttttttgctgtgcgatttccaccgtatcacttaatatcttccagttgtttcttcatttgtgttccttgtgttttgctactgacctcccttggagggatgttgtaaggcataaatcattaatgattataaagtgctttggaaatagaaagtattgcttcagtgatagcccagatgcacctaggaattgcagcatgaacagtacaaagcaaaaggcatgttgtcagaattccttttggggctccggatcagccaggccttccgctcacatcagggtgaattagggccatgaatctgaaagtacatctgatactgcttggcttgtacgtgctcttgttacaacattattttgacattttttgtgttcatttgttggaggactttaaacccttttctaaccaaaggaaaccaaagtgcctactgcaagcatttttcaaagatggtgtcactctgattgaggataaaaaattgatctactaaataaaaatgttggaatggcatgtttatcttacttgtttggccagatataagtaaggcagtgattcagaagaaggcttcattagaatgcaccatttatctaatactttgacagtcagtgatatcttctctctccctctgctgtctctctttatgaaaccaaacactgacctgtctttagcctacaatatcagatacaagaaaacagagaccaatggaagtaaataatccatcaagttagtgttaaagataagactagaaactgggtgtttcatctcccagttcagtacttctatatatctgagtattctttgatcatttctaagaagataccaagcagctttaatcaaacattcatccttcctaaaaggacctgagatttttattcaaagattccagaataccagttattcataaagctgcctgtccatgcatttagagtgtgatagagatcaactgtaacatccgtcatgttactacactccaagattgatttctgtggtctacttggtttgatggaaagtcccttcttcccttacagtctacatatctcctttaaatatgacttttatagatcgaggtgaatacatgattaactacattttcctcctattcatttatctatgtatagaaaaatgtgagaaaggagcaggaatctaaataaactcctaaattttcagtcgttgaggtatgcacagttcaaaagagatacttgtagactaaattatccagatgatagtaaaaattccctattttacattccagatgcagatccagcctcagtgatgaatacctaaatataattcccagtccttttatttcttatctttctccccaaggaacaggctcttcctcctactttggaggctcttctctctaatcgttttactagttcatgctcttttctccttggtactgtccaatctatatactctgttagattagaccatcccaactgagaaagcacagtgggatggagaagggagaaggcatggttcatttttgtatggacagttctgagtgattggtagggccagaaaaagctcttctgtgctacaggcttagggacaaacaaacactatgattgttaaaagatgttaaatagagcaatcaggggtttgaccgctcaaatgtagctgcaaccaggaccaatttgatgtgagctctgaggcccagtttttttcgtatagaaacaattatttttttttatgttctcccagagaacatcagccttgaaaacctgtttgtgctaaccagactcacagaggactgatttctgaatgtgagtgccactttattcaactgtaatgccactaatctagttttgcagccaccatggccctgccttttcacactttcttggtgttaatggatccaagatgtagaattagtgactagaagataagtagccatagaaaaagaattggaacagttagtgagttattcaatctgacctgtaatagagcctagaaaattattcctattcctctctgattgcccccttatgtcttagttggtcaggctgctgtaacaaactaccatgaactgagtggcttatgaacaacagaaatgtattcatcacagttccagaggctggaagcctgagattagggtgctggcgtggttgaactctggtgagagctcttttctgagttgcagactgctctcttgtatcatcacaaagtggagaacagagggatggagagctttctctggggtctcttttataagaacattaattaatgagagctctatccttatggccttgtctaatcttgattaccgccgaaagggcccgccttctaatgccatcacgttaggggaagggtttcaacatatgaattttgggatgacatagttatttaggctgtaacaccttataattaactgaaccatgtgtgttcattcatttaatatgggtttactatacttctcttatgtgccaattactgtcctaggttcttgtatttatcagtgaacaaaatagacaatgatctctgattttaattgtctgtatccagcagcccatgctgtaagagtattagaatattagttccattagggataggaccagcataatggatattgggcacactcctgttagtttcatgaatgaatcaaggctggctcctactggccaaatctgtgccctttgacatttcatttccaggctgtatatcagtgctattcaatagattattcagtgataatggaaatagtctctgtgctgtccaatatggtagccactggaaatatgtggctttgagaactttaaatgtggctaacgcgactgaggaattacattttaaactttacttaactttaattaattgaaatgtaaattgaattagctacacagagctagtggccattgtactggaaggtgcagtcctggctgatccacagcgccccagtgtctctgtgagattagagactgctgcttttgaaaagttgctgctcagaagacagtgcaatggaccattctggttgtttaggcatccagaaaccagactgttcctatgtcaatgagtaggagcacttgcttataataaataggaagttgcatagccaagtagggagacctagattcctggagatgatgtcaataggtggccacttatgcagatgtttactacttaggagatcttcaagggctcctaatgggatttcagctgtttgggaggtctgaaaagatgccatacataatcagaggtcacgaggcctggcctaaggtaaaaattttttttttttttaaacaggccacagtgcagtggcataatcatagcttgctcactgcatcctcaaacttctgggctcaagcaatcctccagcctcagccacccaaagtgctgaaattataggcatgaaccaaaaggtagatatctttaaacactaggttgggttttgggagcagaattcctgttcctggaaagactgttaagaaggaggcaagaccctcatctttgagaaattgtgacggggtggattttgagccctgggaacccatgcaggcaacttcccagagactagaactgagggatcaggaaagaggaagatttccagataaaggaacttattctcaaaagtatacagtgaacagcagcgaagttcacatattgttgagtccagtgagctgaactaggctctttccattcttcgttcatagagctggctgggctgggacctgggaatcagattgttccatctgttgccagggaaggaatgtgtgtgccgggggaaggaggaggtcacaatgtgttctctttgtgtttttagcaatttggtgtttctccttaaggatatttagcagaaggacatcatttcttgaaaaacactgcaatataaaacatgttataaatcctatcaaggtagcttataccttcagaggttaataggttaattctctccgtttacgatgactgtcctaagctttagttccttgacaccaaccacggtgaagtccagcagagatggaaacctgtagtgtgctgagtcaggagattccaatgggagtatatttagtctgaaatctctggggctgaaaatttaacattcaaagcaagtaggcaaagctggcttgggtagctgagtgcatggtcaggtgctagagagaaaagcagagattcagtttaggagaaccctgagaagttcattccagttctttccttgctgccttcacaactttttattggaccagttctatgccaggtgactctgtactgagtcattgtaaagtctttcaaggctacaggtaatttggaacttgcagctctctacatacttcaaattatttctcaaaaatctttagacttaaatgagttctttttctcaatctaccatttatatagccttattgtccaagatctttaatgacccttggcttgagtaccttcacatagcaaaggattctgctggagtatatgagttccaaggtatttttttctgatgaaaaatatctatcttggtttttacttattagaaatggaaatgtaagcactttgtactcactatataggccactggataatcaccaggttggtgcaggtgtgagggtgagtgtcagaaccccagagaactggttatgttttgaggatccatattcaggaacatataaatttatattgggaaaatgtaaatcaaaccacttgtactgaatgcttgactacactttcccatggtacacatcatcatttccttttaagacatgatcactccacttaaaattgtaagccattccttcatgtagtggcattccctgcctctcttctctgttttctccaagttttaatcacttataatataatatgatataatgtaatacagtataatataaaattcacttctttttaaaaaattgtcttatcactctttattaaaatgcagtctccatgcagaaagggatttttgttttttccactagtacatcttctaacttcaactgcttctgacacatagtgggcacacaataattaagtgttgaatgaaagaatgaataagtgagtgaatgaattttttggctgataggaatatacaacatatagattccaagacatgaaccttgtagatggcaccctgtatgagaatttctcaggattttccttgcaagtatgtcaaagactacaacgtactcaccaaccccatttcgccttccttctgggcatccaaccacacaatctttccatctacctctacatttgatgacactatgtgatagtgttctggccaattacatgtggatgcaagtgatggttgccacatcctggcctgaccatgagaacctgactccatggtccaccatgcttctcctctcctattaggcttgaatgaagctgagacccagggcatacttacatctctgtgatgaaggtggccaagtgcacaagaaggaaggttctgagtccctgggaagaaccatccaaccaggagcgctgccccctgccttgacacacacaattgagttttagcattagcattgttgtaataatgcaagaggtaaacttgtactgtattaagcctctgaaatttgaggtttgatcttttctagcagcaattaatgtttccttaacctccagcatgaaattttcatgttgattaaaagaagaaatcaagttttggaaaaaacactgctaaagaatatgagtgtgtatattagtctgttctcatgctgctaataaagacgtactcaaaactgggtaatttataaaggaaagaggtttaattgactcacagttccacatggctggggaggcctcacaatcatggcggaaggcaaaggaggagcaaaatcacatcttacatggtgggaagcaagagagagcttgtgcagggaaactcccttttataaaaccataagatctcgtgagacttattcattatcacgagaacagcacaggaaagacctgcccccgtgtttcagttaccttccaccaggtaggtaattgaattcccactacatgtgggaattatgggagctacaattcaagataagatttgggcggggtcacagccaaacaatatcattgtgttaccgaaataatctcagtgccctggtcacagcccattgtgtcagtttaaggaaaaaaagaattaactttaaaatacagagaaaaaaacattctgctttttctaatcagttaactgacatgctttcatttttatttttttaatgggttaatttccttcacaggacagaagcattaggctctggagaattttagcatgcacccagataatttcttttttaacttggccttcatattgctttcagaaaccacccagtgcgttgtgttataggaatgttttaaactcatggaatgttcgtgtcaactctttcaaatcaagtgtgccctcaagagagaaccaaaaatcataatcttttttcagtgtatttgctagaaatgtatcctttttcattcatctgctggagttttttatatttctctttgatataagtagtgtaacctgtgggccatgtgttattacctaggtaagctggcacactgtttttgtggggacactaatcttttacagttttttctctcccattagtttgaaatttgtagttctagcaatatctttcttggaacacacattaaggaaaattatgggccaggcgtggtggctcacgcctgtaatcccaggactttgggaggccaaggtgggtggatcacgaggtcaggagtttgagaacaccctgaccaacatggtgaaaccccatctacactaaaaataaaaaaaattagctgggcatgggggcacactcctgtaatcccagctactcaggaggctaaggcaggagaatcgcttgaacctgggaggcggaggttgcagtgagctgagatcgcaccattgcactccatcctggatgacagagaaaaactcagtctcaaaaaaaaaaaaaacacaccacgaaaaattatggtgaaataatggatcttaattatggagaatggaagggtcacagtagagaaactttcgaagaatctgttttcttcccctggaggtttcttttggggggacctcatcttggctggagcgagatgttataaggcagtgtccattcccctgcagccactcccaccctcttccatcctgaagcagtgttctcattgctgatagatgaaagaaaactgggacctccttgtccataaacttgaagtgagtctaaacgtgtaagattttcagcctgggtttcaaaaatgcatgtgaagaaaagtctagtgaacctgactgtggttaacttggagatttaattacctgagagaagagagagagtgaatacctttggctgccagaggcttggtacgccttgcttttggcatttgttttttcgtcattatagctttggttgctagtcttcaataaggctgcagtgatcataatgataatgttgttcacaggcaccctgtaagacctcatttacataggctaatagggctggagaagctcaagcaaaaattaataatgattaactgtgtttttatttgactttcaattgtgattttcttttttaattgccgatgcacttccataaatagagtcaacttttagttctcacctgagtgtaggtaaatgggaggaagtggtgagtggaaggggaaagccaaattgatattaaatattcccataacctttaatcacaaatgcaaattcgtgtttactcagatagggaattgaaagttcttgatgtcatatgggatcacgtattaggatttgagcattatgcagagtaatttgaatttgtattcatcaaaatactgtgaactaaatatatttaattgtatattattccagaaaccttcattttaaatctgtaggtacctaaggacaacatgttaaaatattcttgcattatgataaaaaatggtattctaggaatttctaaatagttttcattgaagcaacttagacttattactgattcttgatatcacagaaaaattaatgtgtataatagttgagattattattctttacatttctcccttgaactaattaactggtaacttaatttttcttctcctatcctctccatacattgaattccagaaatttataataatagcaaaacaaaaacaaaaacaaaaaaacctcatctgtaacatgagtaccatctagaataatgaaagaaattttacctgtatgatttaagtatttgccttcttgtaaatattattatggaaagtgttaacagaaatgatttctgatgtctaagcaaggactggttttctactttttcaccttgtagggtgggggtgggggcagtggtacaggggaagatgttaataagttagggttaagcaactcttttacagttacactatgacacaagagggcacaacaacacccctaaatctctaaggctggttgttgccataggctggagagcagagaggaaaaataactagttttagagacagataaactggagtttgaattccattttggcatttgcaagctatatgattgtgtgaaaattagttaccctttataacctttattgtattcatttgtataatagaaaaaaatattttaccagattgatgtgaatattaaatgaatgagaatttccagttgtctacctctgtgtgttgttacatatcaattccatgagagtaacacaacctgactccacaggaaagaacagtggaaacctcctgtttgagatctcccaggctcctccctatgcatcacttcaatgggttgagtttgatcagtgtcctttccctctaaaaagtcatagctgtgaggatagtagctttcagtgagctccgtgagtcctactagcaaattatcaacctgaaggtgtttttggggacccctcttcccaaacatgcagttggtattagaagtgaggaccttcttggagaatgtgcccacaaacatggctatctggctaacttttagcacaaatgaaaaccaaggttcttcactgtaccctctactaggcatgccaaacatttttttaggccaattccacagacttttcttggagaaacttgccaaaggtttagaagggactaataatctcaaataacatgtggcttcagaaccctgatacatctggtacaaacaggtggaagacattttagtgcagtgaaaatggtctaatgtgatttggaatataggcacagagaaaaagagactctgttagttggtgttgggtgcttaaattaggagatcatctggccttgaagctgaagctcaaactgaggcagccataatggtccatgtgcagcagagtgtagaaacagagaacatgaagaagaaaagcaacttgaagggagaaacagaaccagaagccaaggcttggcaggatgagagcagtgcagaattgatcactttacaggacttgcaagacccattatttctccctgtgtttccttatcataattttcctctgtctcttccaaacaccctgtacctaagcataagtgtgagggttttctcatttcttgtaatcaagagagtgttaatgaagacattctgaatgaggcttatgtgatttaaaaattgctacaaaagagaatgtgttaatatttatattcaaattgctaaaacacgtatcaaaatatctatatatatattccaaagatatcagaaataatttagaatgggggattcttttttcttaagtgaaaaatttaacttcagaagtatttaaaagaatgtaagaaatgcatagtaatacagcaagaatatgccattttacatatttttaaataatacattgcattgaaatactggtaatatcctttgttaaagaggttgtggtaaaaacataactctcaggatacaaaatcaatgtgcaaaaatcacaagcattcttatacaccaataagagacaaacagagagccaaatcatgagtgaactcccagtcacagttgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctgagccagaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgacaaaaacaagaaatggcgaaaggattccctatttaataaatggtgctggcaaaactggctagccatatgtagaaagctgaaactggatcccttccttacaccttatacaaaaattaattccagatggattaaagacttaaatgttagacctaaaaccataaaaaccctggaagaaaacctaggcaataccattcaggacataggcatgggcaaggacttcttgtctaaaacaccaaaagcaatggcaacaaaagccaaaattgacaaatgggatctaattaaactaaagagcttctgcacagcaaaagaaactagcatcacagtgaacaggcaacctacaaaatgggagaaaatttttgcaatctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacatgacaaaatgctcatcatcactggccatcagagaaatgcaaatcaaaaccacaatgagatatcatctcacaccagttataatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgtggcactattcacaatagcaaagacttggaaccaacccaaatgtccatcaatgatagactggattaagaaaatgtggcacatatacaccatggaatactatgcagccataaaaaatgatgagttcatgtcctttgtagggacgtggatgaagctggaaaccatcattctcagcaaactatcgcaaggacaaaaaaccaaacaccacacgttctcactcttaggtgggaattgaacaatgagaacacatggacacaggaaggggaacatcacacaccggggcctgttgtggggtgggggtagcggggagggatagcattaggagatatacctaatgttaaatgatgagttaatgggtgcagtacaccaacatggcacatgtatacatatgtaacaaacctgcacattgtgcacatgtaccctaaaacttaaagtataataaacaaaatacactcattcagtattggagattgtaatatgacactattcttttggaaaacaatttgacaacatgttttaagctgtaaataaaattatatctatcggcccagtaatcccactcctaggaacttaaatgtaaattttaaaaaagaaaaagttttaggcataaagacatacaatttaaatacaaaaatatgaagctactttattctcagaagggactagaggaataagttactttcactgaaattgatggattattatgcagccattacatgagaattattaagattatgtagcaacaagaaaaattgcttatattcatgacacaaaatgaaaaataatggagaatataaagttgtatctgtaccatgatagaactacatagtaatatgtactagtactaatttatcaattgtgcactagttttgtactttaggtgcatgatttactcaagtttcacaaccacactaacaggtgacactaatattattccattttacaaatgagaaatttagacacagacagtttaagtgacctgaagtttcatagttgggactgatgttctgtttcaacccaactgatctaatgccaactggagtactataatacaattctgatgcattaacccactggagttgacatcagactccacaagttaaaggctcagtcatccgcaagactctctttaattcagatgccatttgtactttgccatctgtacttgagcctgggaaggccacttgcacttataaccaactggctataaatatcgaggttcccacaaccccctcatgtatgttaatttggtagatcaactcagataattgctacacctataattacagtttattataaaaaatacagatgagaaacagccaaatgaagagacatacaggataaggttgggtggagggaccaagagcttccatgccctctccttgtaaaatctgggtgcatcttcccagcacatcaatgcatacaccacctggaaagctccaatgaaccttagtgtccataatttttattgaggtttcattacatagacaagattgattaaataattggccacatgattaaactcaatctctagtccttgccccttcttggagattaggctggtccaaagtttcaactctttaatcatgtggttggccttcctggtgaccagtcccctgaaataatctagcagctcagcatgagtgactttatcattaataataacaaagacaatactatcacttacgaaattccaagggcttcaaaagtttcaagccaagaactggggacaaataccatttatattctctattataccacaagtccctttcaggaattaggaaaatttattttttattcttgtgcaagcattaggcccctataaaataattatgatctaataaacaaacaaacaaacaaaaacactgggttctaactctgttctaacctttccaagctctagttctagtaatttacaagcactggtgttctcaccttcctgggctcagacttttcttctgtaatgactccttaaatgatattaggtgttgcttcaacttcctatcttccatcactcttggttttttttttctttgagcatggcttacattataattggatttagcccagatatcaggagtcactgggttcaaaccttatcttcatcatttgtaacctttgtgatcttgagccagttacttaacctcttggtgcctcagttttctcatttgtaaaaatgtgagaataatagtgcttccttcacagtattgctgagagaataagatgtaattatgcaggtaaagactttatcacttattctggcataagtatagtaaggactcaataaatgttctcaaaagtaatttataatgtatcaaaattttataggattttaagtcaaatctctccagtataaaagttgaatatatcaagggtctatagaacttcattcttgataaaaataccaggcatattaacaatgacctataatttaaacaatagccaggtgtgatggctcatgtccgtaatcccaacactttgggaggctgaggtgggcagatcacttgaggtcaggagttttgagaccagcctgaccaatatggctaaactctgtctctactgaaagtacaaaaattagctgggcatgatggtgtacacctgtaatcccagctcctcaggaggctgaggcatgagaatcacttgaacctgggaggcagagattgtagtgagctgcgactgcaccactgcactccaacctgggccaaaaagcgagactatctcaaaaaaaatttttactgtaaatacatatatacaaaattttcagtaggaaaataatgataatttgtcctgtagccaaatactgttaattcaggttacctaagtttctgtgaagaagaacatgttatggatgtttttgctgtcatgaaagtattacaaactgaattcagaatataacaaacttacttttgtatataggtcagaaaaggataacttggaaaatcccttatatgaacctttatatgaatagaaagaagatctgagctagtgactatccaattagtctagatgcacatgtgtacctacttaatgaaaccatctcatcaaagagtaaaaaaaaaagtagatttgtcttagaacaattctagttttatcgttatccagccatgagactttgacttctgtaacaaacaagttagaaataacagctaacataaaatatgtgacttgtgactaagtgagaaagattatactatatgatgctatccttaaaattcaattatttctttttttctatttgcttgactgtatgctataaatacaattaaaagtttgtcttaaaattcaattttttaaaaataaccaagagaacaagaatatggtagctttaatagaaatttcatttaaagcattccttttgctttttgaaattttgacctaaaacaaccagtgttcctattgtggcaggtacacaatttttaaatttttcttcacttgtgtctatgagatattaacagtatttataatatagaaataatcatcataaatataatatgaccaatatccagataattaataataattcctacacacattacatgtttatccagtacatataaggtacactatctttgtacttttatttcttcttatccacgtttcttagaatgtaatacatacaacacttggataaacatagcagtaatcctaataagcctaaacacaatatttttctgatgttgagataagttgatctatcaaggtaaaaatgatgaccacattcttactgttcattcattctttttttttttttttttttttttttcaagacagagtcttgctgtgtcgcccaggctggagtgcagtggcgcgatctcagcttactgcaagctccgcctcccgggttcatgccattctcctgcctcagcctcccgattagctgggactacaggaacccaccaccacgcccggctaattttttttgtatttttagtagagacggggtttcaccgtgttagccaggatggtctctatctcctgaccgcgtgatccgcccgctttggcctcccaaagtgctgggattacaggggtgagccaccgcgcccggccctcagtcattttttcttgtgttcattcagctaattcaaaatgagtgctccaccttcatgattttggacaaagcagaatattagttctgtgagaagttactgagcatagagattaccagttggtaggagagataagtagtatatttacacggctctaatcaaagatagaatgcattaaaagatgtaagtacaaagtgttgtaggaatttgaacatgaaggagacttagggggcttaagtgattagtaaagatatctcaattattgaatgactgacaagggagtttttaagtgacattctagaataatcctaactgttcctggacaagtgttttatcaattttttttttaagtttttaacgttttataacattaatacttgatcaacaaataaatatattgtcaatctctccaaatttaatggccaataaggaaagaaaatgcttaacagttagttatcattttgttcatataattatatatattcttctgcaagagatgctaattacttaaaagttatcttagcttgggcttctaaaacaaaatactacagactgggtgacttaaacaacattcatttctcacagttctgagggctaagaagtccaagatcaagatgtcagcagatttagttcttggtactggcctgcagacggttgacttctccctgtgccctccagatggcgaagaagaagagctcttgttcctttttttttttacaagggcattaattccaacatgaatgtgccaccctcattatttaatctaaccctaattacctcccgaaggccccacctccagtactctcccactggggattagggcttcaagatatgaattttggggtgacacaaacatttagtccatagcaaaggttaaggatcatttattcctcttcaacgtgctattctcttagtatggatatgaaataattttatgttaggggcctacggaagtgaaagctttattagcaacagccaccgacctgatttttcacttagaaaaactatacagttggtcttagaatttaattaaattacatttataacttaatgtaatttaattcaatcttagagtctacacaaagaagaaactgctcatcttccatagtcgtttctttattatttacttgctgactcattcattccactgtacatgcattgatgacttgatcttatgaatcagaaccttcaactgaagaaactgcttactcagaatggtagataatttgggagattttttaatttttattttcttggccatctaggagaatcaattatattaaataatactctggcagccataaaattatctgtagctcccaaagtagtcagcttaaggattgtttaaaagaaatgcaatctaaatattttcttattgtgtatatatttatgtgttaatatatacacaataatttcttaatttattaatttataagaaattaataaattttattaatttctttcctgctctcaagacttggaagattttaggtcaagttatagttatccaaagactatataaatcatatatatgctttggtatatatctatcatctctttctctatatatgcacatgtaaaacttacatcccttgtcactaattaaaagagaatttaatttttttaactttctattttgaaataactataaattcacaggaagttgcaaaaatatgagaggttctatgtattcttcagccggtttccttgactgattcattttgcgtaactaggtttctttaccaaaactaggaaattgacattggtaaaatgtgtttacatagttccgtgtcctttgatcacatgggtagattcctgtaaccactactaaacagacacagaaccattacattaccaccagtacctacctcatgctacccattcatagtcaaactcactcccacccacaccatctctaacacctgacaatcacaaatctatctaccctctctataatttggccatttttagaatgttatatataaatggaatcataaagcatgtgattttttattttggcttttctccactcggtataatgacagagagatccatccaagatgttccacatatcagtagtttgtttcttttattgcagagtggtagtcaatagtatgggcatatcatagtatccttaaccagtcacctattgaaggacagttttgttgtttccactttttgactattacaaataaaagttactgtgaacatttatgtgcaggtttttgtgaagatgtaaattttcatttatctggcataaatgctttatgaaccagcaatcatgtgattgctgtaacatatgcaatgtatggcttttgtaacaagttagaaataagagctaacataaaataagtcactaaatgagaaagaatactatattatactatacttaaaatgtcaattatgtctattttttctatttgcttgactatatgttataaatacaattaaaagtttatcttaacttttaattgtcttaacttttggttgctgcttcatatgataagttcatggtgcattttctaagaaactgccacacagttttccagcatgcatgtacaattttacactcccttcagcaatgcataaaaggtctagtttctctacatccttgccagcgttcttccccctacctgttctaataggtatgtagtactctctcctcaatagtcttaatttgtgtttccctaataactagtgatgttgcacagtttttttttcgtgtgtttaatttaccatccaaatatactcttcagtgagatatctctttatgtcctttgcccattttctagttggaccatttgtatttttactgttgagtttcaagagttctttttggatactagatatcggacctttgtcatatatatggtttgcaaatattttctctcagtctgtgtgttttctcctcatcttttaatagggtctttcacagagcaaaaattttacattttgataaagtttaatttatagatttttttcttttacagatcatgcttttgctgtcatgtctaagaacttttcacaagctctataccttgatacttttcttctacattttctactaaaaatttcatagttttatattttatacttaaatctacaatctatttgagttcacttttgtataggatgtgaagttgaggttgagatgatttatttatttactttatctatggatagccaactgctatagcaacatttgttgaaaaggttatccttactctattgaattgcttttgtacttctgtcaagaaatcggttggccatacatgtatggatctacttttgggttcactattacgatgtattgatcttgtgtcagcccctctgtcaataccacagagttttgattgatgttgctatataataagatttaaaatcaagtagagtgattcttcccactttattcttctctttcatcattgtctattctagttcctttgtcatagaaattttggaataacgttttctgtagctacaaataatcttgccagaatttttattggaattgtgttaaacttctatgtcatttagaaggaaattgatatccttattatgtcgattcttttaatctatgagcacagtatgcttcttctgtttttagatattctttgattttttttcattggtgttttatagttttcagcacagaagtcctgtatatattttattaggcttatacttaatgatgtcatttttgaggtgatcataaatgagattatatttcaacttttggggtccacatgttcatttatagcatgcagaataaaattgatttttttgttactcttgtatcttgtgactgctgaactcactcatcctaggaaaattttggagattccttggaattttctatacaccatcatctcctctcaaataaggacagtcttatttcttccttttttttttttttcttttttgagacggagtctcgctctgttgcccaggctggagtgcagtggtgtgatctcagctcactgcaacctccgcctcccgggttcaagcgattcttatgcctcagccttccgagtagctgggattacaggcgcacaccaccacacccagtgagtttttatatttttagtagagacggggtttcacctagaactcctgacctcaggtgatccacccaccccggcctcccaaagtactggaattacaggcatgaaccaccgtgcccagcctatttcttccttattgatctgtatgctttttattgcacatgccatgagtggtgagagcggacatccttaccttatttcagtcttaggaaaaactgttcagtctttcaccattaagcatgatgttagctgtaggttttttttataggtatactgtattaagttgaagttctcctctatattcagttttttgagtttttaaaaaatattatgaatagatgtcgaattttgtcaaattcttttcctgcatcgatacaatttttttttctttagcctattaacatggtgattacactgattggtaaatcagttctattaaaaagaacattttaaatagttattcaattcattattagaaattagtcattcttacataataaccatttaatgtagtgatcaaataaattgttgaatgtataggaaaaaatttaaaaagatatttaaagctatggaatctgatatagtgttgatatgattattcattattaaaaattagtcattcttgcataataaacaaccatttaatctggtgatcaaataaattgttgaatatataggaaaaaaatttaaaaatatatttaaagctaaggaatctgatatagtgttgatatgagagaagaaaggaaaggaaatgagagaagagaagaggggaaaggggaggggaggggaggagcaggaaaggaaggaaggaaagaaagaaggaagaaaggaaagaaggaagggagaaagggaggaagggaggaagccccttaggaattcatggtagtacacagttaagttgatttagtttctattcagctacctgtctccctgttattccttcgtttgtttgttttctgctaccacctcccacttcctttttctttgtaaagctgggtgttccctcccttgagaattcccacaggattcagatgcaggagacaagtgaccatctgcttacttagtggtgacacatgaaatcgtgtggtgtgcaggtagaaccatcctgttaaaaaatctaggagtctccaattcagcagtctgttaaatagacaagagtagagtaaaagcaagatgaacaatgagggtgaaatagtataatcacgtaaacctatgcatggtggaaaacagacatttaaaacccataagagaaagtttcgaaaggcaccatggcaatatattgcttttatagaaagatgctatgagttggtggcagaagtgaccaactgggagggctttctcactccatcagtttttaccaaatggaagaaataagacagtgcccactgagattgatcaggaaagccagctgcactgtgcatcatttgacctgcactatataaactcttctgcaggcaaacgttgcctccctccagcactgacctgcctgacatgctcagattgtattgctgcaagaggtagggaaagaaatttggacccacagactcatttggagcaactaaagctcaaatttagtgtaatataaataaatactatagaaatggaaggcaagatgaattatcattattatccagtatttttatagcactttatattttgcaaacggcttcacgatcccatataatgaatctgtggggggctagcggatgcatatgttacaagctacaaggaatagcagttagcacatccattcattatgttttgcttacgtttttattgtctgatttgtttacatgagctatccactcttcctttctttatactgatttttggaaactttgggtaattaataaataattataatagatacatttagatgtatttggatttaaatttccagatgtgagcctgactttatgtgaatatacggctgcatagaatgcaagcatgagaactgagttaaactaagaatatttgtattcttcataaaacaaccaacatggacttcatgattgtgcttcttattctttaaagattttccgcctttcttactcttgctgcattcctccatcccccttcctacttagttaagcactggatgccctgcagcagtgtattttaaaggccttgtgtgtattggccatctgtccagtttactacaaagtagctcctcttcgaagattcctgccctattgttcctgtgaactcacctgtgtttgtcagtacctgtgctttggctttttgtatagacccaggtatgcccctctgtccttccctctgtaaatattgtctagtttattaagcacctagtgttggagaaatggtttcccatggttctgttactctggttcttattgactatctttccataaaccagatcaaagtcttaatcctcacaggagtggaattcaaaactttctagggatttatttaataccaaattgatggctgatttgtgagtaatgtgaatggtctctcaaatctaccttttgatcagagctttacaagcctgtatataggcacgttatctcctccttttccaatgagataatagatagcttagagccagcacatagtaggcccttaatcactctgtgctcaccaatgaagggagcccctactgggatccttctatgaagtggaggttgtgaaagcattaccctcaaggttaaaacctagtgtagacaatgtgacatataattgtgtgacctcaaaaatacatttgatccaattctagtagctgcagaacaggaaaaaagagaagtctaaagtgagtcatgagagaaaagttcaaaatcccaaagtttaatttgttcacagctgttttactgtcaaaggcagaaagaacttcaacagtgcatttgttggaaagaatcacattttactctgattaagaatatgctgagacttgctttttaggtcaactttataattgtaccacacattagtttttaaataactggaaaaatgttctgtacttttaaattattctttggggcggggcgggggtcagaaatttaaggcagatgttttaaattaaagttagtgttttatagtgaatatagttatatttctgaatattgaaagatctatgtaaagatggtgtaataaggaaagaaaaaatcttgttcttcgttcagtaagccacaaacttggagcctctctatccaaacttcaaaatcctaagcctttttaataaaaatattggaagaggccaggcatggtggctcacacctgtaatcccagccctttgggaggccaaggcgggtggatcacgaggtctggagattgagatcatcctggctaacaggatgaaaccctgtactaaaaatacagaaaattagccgggcatggtggcatgtgcctgtaatcccaggtacttaggaggctgaggcaggagaatcgcttgaacccaagaggcagaggttgcagtgagccgagatcgcaccactgcactccagcctgggcgacagagcgaggctctgtctcaaaaaaaaaaaaaattggaagaaaaatattgtttgtaatcagaaagatcactaatcttatgctaatttttaattatatcaaaagagtttttaaatttgatttgataaattacatttctttaaaaaagagaaaattgattacataattaaaaatttaacctgattgcagttaaaggaagacaaaatggtctaaaattatatctactaggaaaagcagttgaatatatttctcttacctttagcttattctaagatgaaggaaaataaggagaagtaattgaaatgtcagattccagagtgattgttcatttcaagtggacaaaaacctttacttgctttaaacttaagagggaactactcaagtaatagagatataggaatgtaagatgatgactgacatgtagccaaaggtggaggcagaagagaacagagagggattattattattttttaaatttcagccatctctggaacagagtattcatcttcccactcttgaacattttccagcttgggccaactgtgtgtatccagtgaggtcttgtttaagacattcagaagaaaattaagttatggaagtttccaatctcctttttttcagtaatttttccccccactagtatccttccaaaagcctctaccatgctctgggctttctgctattaatatcatctaccagaaaaataaggtgacactttttgtggagaattaacattttgatagagacatttaaaaaatgttcacatattgttaaaataacattgacacatctttttaaagaaaagaaatcaaaatcatccatattctcagtatcaaaattcaactgttgtcctttctttctggcccttattgttatagtgttatctgagcaaagaagtaattgtgagatctaattttttgtttttaatagatagggtcttactctgttgcccaggctggggagtatggtggtgcaatcatagctcactgcagtctataactcttagtctcaatcaatcctcctgcctcagcctcccaagtagctgggactcaggcacctgccaccatgcctggctattttttttttttatttcttagtttctgtagagaaggtgtcttgctatgttgcccaggctggcatcaaactcctgggttcaaacaatcctccagcctccacctcccagtgtgctgacatgagccaccatgcccagcctgaggtttatttttgaatatagcattattatgtaaatgcctcccatgttgtcccatccttcataactttcctgttttgtcttgacacactaatccatccatttaatgtctataatctattaacagtttccttgtttggagacatttaacaacttgtttaaatttttttaaaattactgatttttttttttttttgagagggagtctcactctgttgcccaggctggagtgcagtggcatgatctcggctcactgtaacctccgcctctttggttcaagtgattctcctgccacagcctcctgggtagctgggactacaagcacgtgccaccatgcccggctaatttttgtatttttagtagagacagggtttcaccatcttggccaggctggtctcaaactcctgaccttgtgatccgcctgccttagcctcccaaagtgctgggattacaggcgtgagccaccgtgcccggccccaaaaattactgattttatcagaaatagtttctactcattttttttcttctgaattatttaattgtaataaattctcttgggagaatcaaagcatgatgaatattattcatttttaccattttattttcttcagtggtatcaatttgcagaactactaggtgttcactgacataagtatctttaaatgaacaaattttcaaacaccttcacagcaagcccaaagagctgatgtactcttcaaagatttctaccaagaaaaaacaaattcaggatcttctaagtatagaagggttttacatttttttttctaattctatcttctcctatgaaagccctgattataaaattataaaagcaaagatttttttgtttgctttgttttttttaaacaatatatattgtggacctgaggaatctgacattcccttatgtccacgaagaaattatgtcatttatttgttactctgattcttctgcattaaaaataccacatgtatacgttagaagcaatttcagtattttttgtcataattgcaatgagaagataaatacctttttaaactatattttatatatttttttcaattttagaggtctcacagtttttctaaaatgtcctattagaagtgaagggatcactttggtcctcatttgtttccacagcattttttcaacctaaggttttctttcagccagaggaccataaaacacatttctcaaaatatattgtagggaacactactagtatcttgagatgaaattgtcatatggaaaagaaaaagatccaatggaactataaaatgcattcataaactcattggttctgaaaatgtggttgctggaccatcagaatccatatcccttgggaacttcttaggaatgcagactctcaggcccacccccgcctactgagtaagaacactaaggaggcagagccatcaattggtgttctttaacaaccctccaggtagttatgcttttctaagtaatttgtaatgccattatcttaaaaaagtttctgagaagttccttaggggagagaaaaaacactacaacacgacaaaaacctctaaaccttgtttgcccaaaaagttgaccaaagaatatctattttctcttctaccaatcacaaacttttttttttttttttttgagacagggtctcgctctgttacccaggctggagtgcagtggcatgatcttggctcagtgcaacctctgcctcccaggttcacaagattatcctgccttagcctccggagtagctgggattacaggagcgcaccaccatgccctgactagtttttgtatttttagtagagacagggtttccccatgttggccaggctggtccctaactcctgacctcaagtgatccaccctccttgtcctcccaaaatgctgggattacaggcgtgagccaccacgcccggcccaatcacaaactttttttttaatagagatacagtctttgtgtctaggctcaagcggcagttgctagtttcaacctgagttgttaatacatttaacgtgggttcattagtgtttgatatatttcttgtggctagaccatgggaagaactgctgtccttttggtagcgggatacgtcattgcctgatgagttgattaatctttgttattctgcaatacctgtttgtcatgcatatcttagtatatgtgaatagagtatatgtctggtatgaattgtgccattataatggttcctgataggagagattctattttcatttgctaggtatttgagataacatatttactcactagagaggagtaaaaattaagtattaatatttaatgaacggatactaagtgagaaaaaaattagagcctttggactaaatatttattatcttacaagagcaaatagctatgttataaaatgagaatatgcaaataataaaatggaaaattgaaagtaattatctttacatgtgctgtaaagttgctagttgaatttattgcctattctttttaccagttcaaaggttagtgggaaaataccgttttgacagcagacttctgacagcttaataataatgatcaagctttgtgcattttatttaaacatctatagtcaacatgctctattagtagctctccttgtatcttttgcaaaaataagattttagggaaaaatgttatgttttatctcaacaaaaaagtctagtgtatgttttatatttgcatctcttaccctgtatgtttaaattacaaagaaattccttagttcaaatgagcatgaagttgtttggcaaactgagattacatagctacaaaacccttggtagatggtatctataaatagaagtgtctaacgtggaaagtgctctgaacaatataaacgggacttttgcaaaaagaagtggagaggaggaaagcctacagcgttgatttaaaagactgtaattagaattaggttccgataattagatcccagtagactgagttctttttcctcaaacaaacaaatcataaatgagtataggatgtcatttctacaggaatgaaaatagaaatggaattttaaataaagattgtgaagcaaaatgtggcattttaattcttgcacctggaatcatttcataatgaaatgcaaattaattctaaaaatctctgacctctgttttgctgattgcagcctaaaatcactcatctggttttgagaaaaagagaaaatgcatgccaagatgaaactatttagtatataccttggaattttataatgaacttagatgactgactgtggctaaataagtttacatttccatttttaagaaagatcggaaaccaagaatggaatacttggtataaattggggatgaagccactgtgattatctgaagtcattcattggcttaaaattttgttcatccttcactagtgagttcttatgggatgtgtgcttattgtatactctttagttctaaatttgcaagagaagtaaaactggaatctactttttagttttgaaaaatgtaagtctgagcttcattaactagcacttataaaaaagaagacacactccaattgacattttcacattgatgtttaatttaaataagaaccaatatttctatggtggtgagctgattgagaggtaaaagacctttaaatctccttctgaagcttactgcccaataatattttattttctatatcattttattgaccaatgttgtcatcagtttatctaacagaaaaataaaaattgcaatgtcattaaaaatatataccaccaaaaaaatacggttgatgcagttgaagaagtaaatggcaaattcacagatattcataaaacagctattgtataagactgagactagaatgaaaattttgtatctaatgaaaataagatgtcttcttctttatttatactcacatcccctttctaaaaggaatctgaagctctttacaataagaccacctagatttttttaactatgaatagagatgaaaaatcagaacacaggcaaaaagaaggaaaaaagcataaggtagggtggtaaccaagagactcaatgtaatttattataatttttatagttagtctctgagcttcctgggggcaaaagaaaatgaaacctgtatgtccatattgtcttaagttttaactgtaaatacagtgaggtttttgttagacttaatagtgtgcatatagacacacattcagtacatgttttctgatgccttccatccacaggttacctggttcaattgtcaatgcctaagtcatctttaaaattgctcagtgcttttataatattcataagtcactgaaaatagaacaaaacaaacaaaacactggcactttttcttcattttatttcactgttgaacttgataatgttggaaacctgagcagaataagatagtttgatgattggctgggctcttcatcacggcttgcctttcagtataagatattaaaatagtggttttcaaatcttatagccctagtatcatcttagaggtttcagagacaatttccaaagtaagtgggaagccagtttacccagaacaatttactcataactgctttatccagaataagttaacttttctctactttacaatgttagattgtattttgatttgctttgaaacaaagttctgctgaaagcagtttaataatcacttaaactggtggtgagtaaagaccaccaacagtgctatagtaaaaggaactgatagatgaccctcgggggtgaggtttgtgaaacctctaacaagggaatcctaactatggatggatagtttttataatgttagcaaccctctaaaattgtaagaaaatgctacatattttacaggcaattaatctagggggatagccaagagttttcttcggttcttgtattatcattaaattttagaaatggataaatattttttaaaaagcacctagaatggatttattgaatagttaataaaagaaataaaacattataggaaacattgaaatcccttttttaaaaccctccagacatatttctgttgttctcttctcaaacacaactactctttttaatttggtatgtataattcctgttttttacgctttcactacatatgtagatcctgccattaaaatacatgttgtgttaattgagtgtttatgaaaattttcataaatattttaccacaaatgtcattaaccatcttgtttcatcacattttattttattttttgtgtgaacacgtatagtttctagttcatttaattgcctgatgcagttctatattatgaatatgtcacatttaatcaattcatttcatctctatggaaaaatactaaagtactttccactcactcactaggtcaagtagcataacagggaacatctttgcacacatttttaagagttggactagactggaatgtaactaaaagtgtacttgaggctcacagagtatgcacatctccaaattgtgtttgtaaaatccaagttatcatccagaatagctgtacctgtttacattctcctcagcattgtatgaaggttcagggtttttggcatccaacagtggtactgtatattcagactttaatttttacagttgaatgggtataaaagagcatctcactgctgctttcaagtgcatttcccttatttctagtaagatatcttctcacttaatgtccattgggtttctttctgtgaattgcctttgtgttcattgctcatttttttccctagtaggttaacatctttttctagatgccatgtaggagttccttacatatttggtataataattatgtgttgccaaaatacatttattcccagtctggagctgctcttttaactttgtccatggagacagattttaaaattatgttttaaattttattgtggaaaaaatgtgcagatcttcttctttatggtttctgccattcatgtcttcacaaatccctcccaggctggatgcgataatgcatgtctgtaatcccagtcctttgggaggtgaaggtgggagaattacttgaggccaggagtcagagaacagcctgggcaacaaagcatgaccccatctctacaaaaaattaaaaaattagccatatgtggtgatgcatgcctatagtcccaattgcttgggaggttggggcagaaggattgcttgagacccagagattgaggctgcagtgagctgtgatcatgtgatcacaccactgcactccagcctgggccacaggagaaaaccctaaaaaaaaatccttttctataacaattttataaaattatcctgtcaatcctataccttcttttaaaaaggttaaaatgtttctatacctacttaggctatcaacctcacctggccagaattctgtgataggccatgtttctataaatgtacaacgctatttctgtgacctctttttgttgcattgatttaactctactccagatttaaattttcagtgactgtagttttataaccttgatgtctggaagggcaaaaccccatatatcttatttattatcttcaaaactgatttaaatattcttgagattttctcttctaggtgaattatagaattattttccttttttgttttttcttttcctttttagagacagggtgctgttctctcacccaggctgaaaggcagtggcaccatcatagctcactgcatcctggaactcctgggctccagcaatctgccagcctcagcttcccaagtagcttggactacaggcatgtcactgcacttagttagtatttttatttttagtagcaatggggtctcactttgttgcccaggatggtctcagactcctggcttcaagtgatcctcctaccttggcctctcaaagtgctgagattacagacatgagccactgcacccagctttttttgggcacttttcaagaagaaactttctggatttttattgaaatgtcattgaatttatagattaattttatgataattgttactttttgaacttgagtcctccaatccacaaacattgtatatttatgtgtattttgacattttttgtaaatatttgcagtacttttccttgtaccttttgacattttcatcttttacatgcatgtgttgtaacttcattttgccacgtctgaattttttcatttgtcttattttgatgttcattcttttgttgatttgtttattgtttgtttgttttccctctaatatgagaattcatgtcttttgtcaactctggaaaatgctcagtcattgttgcctttatctcattctctattctcattatttttgaaactcatggaagactcttgatatgcataaaatcttgcaaaagcttcagagggaaatatatgtataatttctatatatatatgcacacattatatatagatatacgcacatacacacatataagtgattttatcatatatataatcacatatgattataatacaatcccttatatataatcacatatatacacatatatgtatatatacatatgtaattacacttacatacatatataatcacttatatgattacgtatatcactgatatgtatatataatcacttatatgtgtgtatgtgtatatatagtcttatggtcgccaaattctcttttctatttttcaactacaccaagcccactttcgaccacaataatgctatttatatctttacatgtttaccttccacataagattcatttgaagaagagaacacagctttccttggtgccagctttccctgagtctatgtatttttttgttatacagttgtgttttaagattgtacagacagttgatataactgatctttggaaactctattctgaaagaatagagtgccactattcctgagcaagaaagagatgttttcaatttcatttcctgaaccttcccactctcccgttacacttaacttaaacaaatgtacgtacatcattgcatttataactatcagagatacaagtcagagaactggccaggatgttcattaatcatgtttgctggtagtaataaagggaaaatccttaaaagctatgttgtttgccttgtgggtgttagtcacataaaattcatggctttgccctaaactagtgcgcagtaaagaccagacaattgcttatcatgaggatggattgctttggcattagtgcttcctgacttaaaagaggggcttatttgttcagaaaatgggccggcattggatgagctttcattatttcctgcctctacttgtgtactcttgcattttgcaaaatattgccagtcttctgttattcaagtaaatgtttcaactgtctatataaatcatttctcttgatgcaaccaaattatttaactcagaaagtccatccatcaggtgcttcacaatttatcattattttaaagtaattggtctactcagtagcataacacttactgacataataaagtcatgtggattatagataaactcgtgagatacctggaacttggaactatcattcctatatagggccaaataatccactattgatttggaacaacaaggtgaagaaaattaagcctccccaattccagctagtattttaattgaaagagctccaagaaagactcaggtgctgtaattgtgcggtaatttggtatggcagcttctaattatgaagcacgaataagaacaaccttgggaaaaatctcggtatgccaagattcacccattgcagaagcagaatctgagccaaatggtaatttgtgaggttattaaaatgactattaaaggcttggatcagataccgctcaacttctgaactttgagttaactagaagttgatcagagttagctttctggagcttttcatttgtttctgtattttgttaaaagaaaaaaaatctgacttgcatgcttattgcatgttaagtactgtgctgggcattttatacattttagctcatttaattaaattatcataatgctatgatagttttagcatctaaactagcctaaaaagggctagttttaggccctttttacaaataataaaattgtgtttcagggaggtgagcaaatttctcaaggttatccagctaatcactattcaaaaccaggtctgtcttttcccaacgcctgtttacttccctctacaacaacagtaatgatgaatgaatgcatcgacatatgttcatctcaaggctatctcagtgctccttaagcattatctagtttgactgggaacttttttgaggccatgtggtccatgtttaccaaatgattcaggcatatctagccatccttgagaacttgtcagagcaggttaagaggttaagagacaggcaatattgttaatacttgttattaatacttgcttcagtattctccactttgtatttgtggcaattttggattggtaggtaatgaatagaagatagagttacggaatattagataattttataactctttggatgcttaagagcctagaaaagtatataaatatcagcagtgcaaggagaaggaagcaggttggatacagagagaacttggaccctttgattgctcagcaggtggttggatatcctgagatggggaagaaggacagacctcaatatctctgcattgactaactgggtcaatacagagctgcctaaagttgtatttaccgctggaaaataaaagtgaagaaatagtaatcaaaacagatttttatatgccttattgctaaaagtgagtattatagataatgccactaatttcagtaaaggcagtcttattccatattattaccttactcctaccactgggactgtgagaaaacactaaaccactagcattgtctaatttgctactacaaaaattacttctaacagaaagtgagagattaggggattataaaatgttaatgctggataagacttttgaaaccactcctgttttacggatgaagaaactaaactagagaaatgaattagctagttcaaagtcagacaactagttacccataagactaagacaaaaattcaaatgatctgacttccaactcagtgatatacccacaatatcatgccaacttctagttttattttaatgttctattcttattttttatttatttattttaagacagagtctcactctgtcgcccaggctggagtgcagtggcgcaatcttggctcactgcaagctccgcctcctgggttcacatcattctcctgcctcagcctcctgagtagctgggactacaggcacctgccaccatgcctggctaattttttgtatttttagtagagatggggtttcaccgtgttagccaggatggtctcgatctcctgacctcgtgatccgcccgcttcggcctcccaaagtgcagggattacaggcataagccaccacgtcaggcctctattcttatttttaatgttaatttctttaagtgtattacatttgaacaatgtaaaactcatttctattagaaaacagttagatttctagagtctcttcctactcactggtctccacaggggaaaaaaaggaagactgtgataaaaagaaaaagagaaaagagaaggaataaaaaggacaagaaaaaagattattttgcttcatttttagctatttatcctcagataaaattgagaactgaaatctgaaaaccgttaaactcatgacttacttttattatggaggaattagtttttccttttattatggaggaattagtatttctcatttatctttcagctctcaagtactccctgtgtgaattcgaacatttattccacttaaaaaattcacaagaaatgcccaaagtctaacatgtttccagattgggaatattttcactaatacagtactttgtcctcctgggtaagaaagaagctctctgattactggtctgaaacttagagaataagacaatgcttttcatgtaattgattcatatacatgggaacgaatgcctttgcaaagcagttatttctatgcctgacctacagagagtctgtagtgagccacgcatgtggtatcattagtcactgatgatgacaacgagaacaggaagattggagtggcaggataatcattctcagcaaactaacacaggaacagaaaaccaaacactgcacgttctcacttataagtgggagttgaacaatgagaacacatggacacagggagggaaacatcacacactggggcctgtcggtgggtgggggcctgagggaggtatagcattaggagaaacatctaattagatgatgggttaatgggtgcagcaaaccaccatggcacgtgtatacctatgtaacaaacctgcacgttctgcatatgtatcccagaacttaagctataagaaaaaaataaaagaagagagagagagagagagaaaggaacccaaagtcctagaaaaaagcatggggccagggggattcgttttcaaccttggtatgagaaaggctttctaactataactcaaaatccagaagcaataaaattgaaaaaaaaaaaaaaaaaggaaagaaagaaggaaagatgggtggtagagagacccagtagagggcagcatcagtaatccaggcatgaggagatgatactgtgctggaatggtgggggaagagaaaggtaggggcacatgctggagaaactttaaaggaaaaattgagatgtatgagtgattgaatgtattggagttaagatactgacgattataataatgtatcttgcatttatatgttatgttatgcatttatttgtgctccaataaagtctatcatatcattgatcaaaattactatatagtcttcctttgttttgagaggataatttatttcaggaagaagaaataaactgcacaaggaaagttcttctaagtcaatagcttatttaccaccaagattaatgacacacaatcactttaacagttaaaaagtatatgtgatttttatatatgtgaaactttagtgcaaatcaaactcaaacagaatagtaaaaacataagaattttttttcaaccttaactgatgcataagattatctggactataaactggaagactaccagtactcagaggagagaattcagtgcaacgcatgccagatttcataaaactgcaaagatgactgcatggtgactctcgtttcatggtgcttagctgccactgaggcatgtgaattctaaattggtcttcataaatgtgaaggaatgcctggaagtcaaaggaaagcattaaaggaaaccccttatacatgtttaattctcataatctgattggttatatcaagaggtatgactatatataaatgtattacaaatagttattgaaacacattgttacaatagttattattggttatatcaagaggtatgactatatatgaatgtgttacaaataagctatagttgctataatgtttataaattacacaacacctaaagtttaggaagtggatagcatcttctcatgagatggatagcatctttatatatctctgacttttccactgggcttcaaatgcatattaaaggacattctataaaattaccagtattccatcatttttggtctacaaaaatgtcagtttcacatagtttgacctaatatttgccactctcaacttgtcatttccacttggcatagtcttggcattacgtaggcatatgaaaatccagggtttgttttttttttccaccgaaacctgttccaaccacaggtggtccacagctgtccacatttcagcaaatgatgtgatacgatcattcactggatggctcacgtttcaaacctgggcataactctcacttcttttctccccaaactcacattcaattcatttgcaattgcttttctcttcacctggaaaatgtatgtctaatttgtctactcctctctgtctccaccattagcatcctagtttgtcattattttttattgaatttatgtaagagagtcctagctagtcacttagctttccactcttgccttcctctaactcaatctctaaacaagcacatgaagaatatttaagaatgtacattagattatgtcactcccatgctttaaacactccaagggcatcccatgacacatagaataaagtccaaactacatataatagttacaaggctctgcgtattgtgaacctaactttctgatttcttctcctactccaggattcaccatactcaaagtaaattggaaaacagatcttgggtctcttgggtcctcttgggtcctgttgttcccttttcctgaaagctcctctttatctttacataattggctccttcctgtaaatcaggtctcagcttgaatgacatatctttagagagatcttctctgacaacatattctaaatagccacccccatctgtcattctttatcataccatcatttaaaaaaaccctcagcacagcacttatcacaatctgagtgatagatgtcttattcatctatttttgtagcaggatgttagaatgaaagttttagttgggaaatattattttacaaagtgaacaagaggaaagaagctttcaaagtaggactagggagtcatgtggttgactgtaaaaattcctcatccacaaagaggaaataaaagaatcagaaaaatgaagattaggaaataacttagggaaagttttttttttttcaggtaaccattggagttccattatttaacaaattgaatgatataaacttataattaatgttatattaaaacaaagataataaatatgcaaaacgaatcacttcttaattatgttgttatgttttgttattatctatgctcttcaggtaacctaagtcaactggtaggaatactacatacacagtgatgtattacttgctgcatatcttcccaactctgtttttgataacattatattgtgcacgaaattagccatgatggaactgtttacaccaagaaattagcaaacaatatagattaaggttttattgtttgttaataatttcaacttcaaaaattgagaaaatattaataatgcagactaaacttagtgttgtgtcagtagctataacattgtgaatagcacaaaaatcaaagaaatattctagtattctaaagctagctaatataataaaaactcagtcacatcactgagaacaagtaaattcttgatacactttttcactctttcactttcatattactcattactgtaaatgaaaatacagaccaatacccacgttggaattatacatgtttatcagttccaactatagattgactacaggtacaaaaggttgacaagcataaatgtacttctataagaattaattaactatgtggaatttgcagtaaagagtattatatattttattattgactatgagttgtatgctatacctctttttattagcaaaatttataataaacttcatacatgtgtgtatccattatttttagagagctctttgttaaacatttaccagcacagcgctgtgatagacccactatctagccaagaggaggcaggttacttcttttttcaccttaaatcaagaaagggacactttactaaggccaccgagagagcacagactatatcccccacaactgggggaggggatactgtgaattggtgtcttacttcactttaaaaatctaggccaggcacagtggctcatgcttgtaatcccagcactttgggaggccgaggtgggtggatcacttgagtcccatctctacaaaaaaaaatacaaaaattagctgagtgtgatggcaagcgtctgtaataccatctacttgggaggctgaggtgggaggattgactgagccagggatgttgaggctgcagtgagccatgattgcgccactgaactccagcctgggtgacagaaggagaccctgtctcaaaaagactaaaaacaaaaaatctaaaaggtgacagatagccttgtctggctgttctaagaagaaaggctttagtgacttaccagcgtgggaagtggtgttggggcaaagtttgtgttagtgtttcctgtggaccagagatgagcctcacatgagacagattaggcacagggtgaatttagatcctctaaaaggaggctgcccagatgagtaaaatggatgtgtataaaggagctacaaatgactcctggatttctagagaagaaaagaaggtggcatcagtattactaaagggaattccaggtgacaaatccctagctgggaagggggaatctctgaagaagctttaatatgctaaaaagagaagggggcagctttgaaccgctgaaagaggagagtgtactgccagcttgtgacagtactactagtcacaataggactttgctgctccatttcctcgtgtctgttagcggattcacaagttgacgagcaggaggagaagtataaattgagaaaaaaagattaaaaacagcacttctcgccactccctcattccctagcagctgctttccacctacaacaggcctggcaatgaaaggctcctcaacttttcataacgttcactttttgaccattaaataaaactggatatcccaggagcagaggaagacccagctcccatccaataaactgaaggagatactaagagacaaaaatatgattgccttatgattaaactctacaaatcatgcttctttaatgaaagaattatatttattttccccttaaaattgaaaaatttaagaaagcagggcttcagtacataggagacacccagtaaatattaattgtatgaataaacgtagacaggaatgaatgattgctcattggttcttcctttggcacttgatgaagcagactcagagaagctgtatatataaattgcttttaatataaatattcttttggtaggaaaaggagaaagaatgagaaaattcaattctgaatgattaggagaaagacagaaatgggtggatctgaagaaagaaccactttcatgtgggaaaccaattcatatgatttctcatcagtggcatggaggaataattgttagacacttacacatccctgaaatgtgtcgtcagtaattaggacaggccctagattctagaggagggagacagaaatttggccaagaaatgaaggggttgaaaagttttctgagactgagggaaaagaagaaaggagaaacataaattcaggtatatactgcaaatatgtaagagcaaagaagacttcaggtgaactctagatttttattttcatgtgctcctctccttcaaattcagaagaaaaggacaaagctaaaactatatgaaatccttcgtctaaaatgacgaatctgaaaattccagaaggtaggagcttagtttcaatgagatgaagaaaaagcttctcattcatgaaatacattttaataagttgaaatttgaacaccaggtgtatgaaaagaactagaatttaaccatatgtgttcagaaatatttagcccacatattttccagaataatccccaaacatgtttaaggatataattggtaagtaagaaatttgaaatccctatcagagtttgccagagttgtctaagatgcattgagtactttcagtaaaccagatgctgcattttcaatccttacagcactgagaagatactgttctagttgaagttgcatgactcaagtgggtcaaagcttgcccaagttccctgagttaagaagtagaatttcaaacacaggttgaactaaccttagagtagggttttcataacaacattcgcttcccagtaggagttttaattttaacatgatgttccttttggatttaatgttattaagggacatagtggatgaggctgactataatttgctggctttcatataagcatcaaacaattgcatttccttctccctatcatttttagtcctttatgtgcagccttgcagcattgatctccaggaaagcttgtgttttctggtgcacttcccagaaacaaaatatgatatgtgttcccttttgaaaacaattgataagtttcatgttgacagaaacatttcattttccaagtcatttatctatttgtcataagaggaattataatagtatattggcttccataatccaaatccattccctttagtgtatttttttaattaatacttctctacttaaattctgatctaaaaaagtggccattaattaactcagggagcaattcagctatttttttttctaggaaatgggaaatctggtaaatggtttgtacttctactttgtcaaaaacatgtatttttccaaactgtatgagaactttaataacactccataaatttcatgcttttagtcacacttggaatggaggctttgggaactctataaccttcttaatgacatgttggcttggcctcagcactgtagcttcaacttggttcttaatggacattaacccatagtgcataggcttcaggtaacacagttggtgatttgtattttttttctggaaaggtccaagacagatccaatattatttccttttaagaatttatccctttttgagacagagtctcactctgtcacccaagcttgagtgcagtggtgcaatcttggctcactgcaacctcccccactccccaggttcaagggatcctcccacctcagcctcctgagtagttgggaccacaggtatgcaccaccatccctggctaattagttttgtatttttagtagagtcggggtctcaccatgttgcccaggctgaattaaaaatatttctcatgaactacatgaaacctcgtaagtgtgaaggcttcttgaggacaaaggttgtatcgtgcaaacctttacatatcctaaggcactaattctttgcccattcttgtaaccaataaacatttattcagctcctactatatgccgggtgttatattaacggctgggtcagggcacatacttatgaaaatagtgtatttatatatactatctttcaaataataaccagtacatttttacaattaaaatataaaataaaattattttggcttgtatgtgtgtctttcctagaaaagatttgctaacagtaaaataaactttatagaactatcattcactcttagttgcatcttggcaaatagtcaagggcccttccaaaactttgcctgtatacactttggattttaattagacacaataagacccccctccttaatctggctctgcttcttgacaagtcatcatgaaggtgtgataatatcacacaggaaattatcaaactgctaaaccaagtacagaggagacaaataaaatgttgatgcaacagctgcagagactgtcctgaaggttctgtaatcaatggtgtcttgagagtcgtatctgaggtagagtctttccaaatgcacacagtgggtggggcagtggtatctgaagtggagaaggagggcagagaacatggtatctacacatggcagattcaagttcatgcaagcaccctgaagacagagaatttgtcttgaataattttaaatttagcaagatggaactttaacctcataaagaatggaactcggtgagttttggaacaaaatgactgtttttggactcaaatcatagaaagcattctcctgcaaatgtaatatatccatttgtctttagcaggaaataaatgaatttatttcaagatggtgtcccagagaaggcctgaggcacaatcatatttaaactgtatgaatactgagtgacatgattgcatccagtgtggtctggattatttgagcaaaccatggggacatacttacctgtttatttccctacatctgtttatttccctacgtgttcttgacgttagtgtcgaaggattaccctgagacctgtctcagtgtcctcttgagaatggatatacacattgacataaattattaacttctccctagataggtccattaattttctgtgaattgttatggctttattagtttcccatcagttattcttggtctctttccattaaagagaaatccactcttacttaaatttgtgtcttgcactaaagttaaattcagccaacttcgttctgaatctatttaatcctaaaattatttatttaagtaaactttcatgtatcctcaggagcctcttttcctgaaaagaccaaagagaaactttccttaattaggcataaaataacagttctaagacttgttttataaatgacgatctgttctataaggttactgggtcacgagagctaaaatctttggtggtttttgaaaactgatacttgagggtctgaaaagctgctcggtttcagtctcacattgacaacgattaagatgttgagattccagaagtgaagaccttacacaaggagatgacagctgtcagtgtataatcagaaaagcagccatgaagtgataattcctctgtttttcttctgtgatgtcctagtagaggtgattttaagtaaaatagattacatgtcatggctattagcaaaggcaatagacttcaccacctttgccctgagctatgttatatctgcaagatcttcaacaatagttcaacttacaccaggaatatattagctcgttttcgtctatattcatacgttctactccatgtggctttctgacttttaaagttgggagggagtttaaaaataattttatataaccccttcactttaaagataaagaaagtgagacccagagaaagtaagttatcttccaaggtcaaagcacttctagcagtaaaactttaagagaccatttgggaaatttcattatgatttcaatggaagtcactaaaagtactattgagatagtcaggaccctggagtcagtgagcgatgctgaattgctgggtccagggctgatgaaaatgccactgaaactgtaatagcttagccaataattacattataatatcagaccccttgcaatttttgtgtcttgatcattgaaattgtaagaatgttagtaacagaatatgttccttccaggggtgggcctaacaccctattcatttttttccccttgtacaataaaagtggtgccacaggcatattgaccaaatcattagaaaatcaattactattgagttagagctgaacaaaatagtttgaaaagtatttaatttatcccttgtaatatctgttcttttaaagttcctgtaatctgtgatccctggctgactcctctgtgatccctgacagaaaacctcattttcaaatccttttttccccctttccccctgctatccttccaaatgagaaaatcattaaaggaaaagaaaaaagtattcagcacagtgagataagagcaaaccagctcaactattatgagagaaacgcctgtttccctaactaatcaaaattcacagtaagtgtgaggaaaacaaagccaaactggcagaaataatacagttagacttaggaaagacctagaatgcaggcatatctcataaaaaggttatttagaaataaatctgatggctgtgaggtgagaagttaatgttagcatagagcagaacctaaagtcacttgattttctgctatttctgaaaaggtcacctaggtttaatcatatattctactttcttccccttgccttccatttctcccttccttccctctctgcttctattcctctccctttcttccctctcttcctacctctctgcagtctgcacttttcccttccattctccatcctttctccttttattcctctcttctttcttccttctcttcctctttcactgtctctctttctccccttctccattccttttccccccttccccctctttatttctccctctcctttctctctcaattacatctttcttctcttttttctccccacttccttccataaaggaagctcttttgttccaccctctacaccaggtcctggagttacaaaaacacagcagccagacaccccacactcagaccttacaggcaggggcaactgacaagttttcagtactaaaatcatgtgttaagtactaaaactcagggatttttttttttttttttttgagacaggtctcactctgtcatccaagctggagtgagtggggtgatcatagctcaccgcagccttgaactccagcctcaaactcctgagatcctctagcctcagcatcctgagtaactgggactacaggtgcatgccaccatgtccagctaacttgtatttatttattttttttgtagagacagggtctccctatgtttcctaggttggtcttgaactcctgggctcaagccgtcttcctgtcatggcctcccaaagcacagggatgttttaaactgttagtggaggggaggtttcgctaaactcccccaacctagggtgatctgaaaggacttcttggaagaaataagacctcagttgtatcttaaggaagagtaagagtaagccaatgaagatgggagttgggatggaaaaggggaaggggaggctgaaaagggagagtggaggttcctgccatggtaaacagtgtgtgcaaatggggcatggaagaagggagggagggagagagggaaagaaagtaatacagagagaaaaacaccaagattcaaagacaccaagatgttttggtctggaacgtggatttcaggtccttatgctgatctgtctcccttaaatacaatgagtgccttagaaaggaaaccatattatttattactcccttaatagaaagtgcttctttacagtagtggatatgtttgacatattacatacaagatgcccggccaaatttgaatttcagataaacatcacattatttttaagtatgtctcatgtaatatttcatgtatatttgcactgaaaacatgatctattatttatctgaaattccaagataattgggtgtcctgtacagttatttgctagatcagcaaccctaattaccaagcaccagatagttaataaaagtttagtgaatgaatcactaagtcagtctaagatgtatataagaaagtgtcaggagattcaggtagacagctagtcaagttaaagtcaaatgtttaggagtcattgctggttattaaaactataggccagcatcacccaagaatgttgtgtaaagtgagagagaattaaggatgagtccctgaggaacaaaaagattcaaagagaaagcagaggaaaactggtatccaaggaagaaatccattcattaggaatagaccttggagaaagtgaggacatgaagaccaagaggagtgcacttcagaaaggaggaagtggccaacagggtcaaagaatttaggagtcaggagggtgaaaaacgtccattgatcttagccacgaaagtatcactggtggtttcatcaagtaggggaggtgtggatactagccagatttgggtgagttaaaaagttaaggatgggccaagtggagggagtagagacatggtacctgcaacctgttgcctctttcaagaacctagggttgccagatttagcaaataagagggtacccagttaaatttgaatttcagataaacagtgaataaaagtatagctgttactgaagaagagagagaggggcaatgcccatgggggcatcatttaaagatgagaagatccaggatgatcctatgtgtgaagaaggagaaggaagagtgaagaaggaagaaagaggaagaaaggaagcagaagaaagagtgaagttgaaggtctagaagaaattacagaaagaaaaatttaactctagggtcacagtctctcctctgaaaccgttgaagcctgatgccagaattttccctggaaaagtaatatggtttatattttctattagcactcccctgggggttctgtagaaaccccataatcaaatatgttaatatttttaatagaaaagtgtgaatatttttactaattaagataaaggctgtaaaatagcctcgtttcagtttagattttgctttgctgccaatgaattatattaaaagacaaacaattttggttttcagagctttttaaattttgtaattgatgataaggtattaagaatgtgctcagttctcttcttggccccaaggcaagatgaagcaataccgttaattatctcttaaatatatatcagtcaataatataactgttccttcccagtctactgtagggagttcagtgttgccttaaatgttcctggtactaatttgttttgcaaaatcagggtaaataatggaaaaacaatatttaaaacacaaagtaaagagaccagggaaccttgaggttctgtgtgggaaatggaagagagactgatgggaagataaaataatgattctcatggtaaaggggaaaagagagagagacaagcactggttgggttcaagagaagtttctgaggatcaggtcaaaagtgttccagccccagcccacaaactccttcagggtcttaagtcagatatacaagtcgtctctggaagagaatgatgaaggagctcaccgacagtccctgtcactcgtcctaggagggatgactattacggcagagtcccctcctcctgatccttctgccattaaggtcccaggtcaatgtcagcttatcaatgggatgttctccaaaccccctatgaaatacagtgccctctctccacccatccaagttcatcccccattacattcaccagtttcatttttttttcttgggcagttattaccatctaaataatgttgcatatatattgtttccttgattcatttttctctcaccactagaatctaaatctcttgagaactgacactttgtagccttcagaatctagaacagtgcttggcacatagtaggtgctcagtaaccatttaattaaacatagatgcagaatggaagtagaccacaccaacgctccatgaattaaatggatatctattacctgctcttgattcctatccattacagaaagctaaagaacttagcttccattttggggggaaaataaaagttccaacttttactaagcattaaaaaaaatctgtaggaatacaactcatttatgaatttcaaaatgtttgcattttaaatgcaaccagaaaagaactatttgaataagcaggcatttagaaatgtaactgcttctaatttgattggtcacataaattcagtttttttgcaaagcagatttatttaagtcagagaacttacaaaattgaagctcagcagtgagagttctccatcacacttcctaatccatgatatttcattgatgcattgttcatttggaagatggagatgacaccagtgtctgtgtgtggatccaaatatcccagggggttcaacagcacctcacttcatcaaaacagagaaacaacgagagagctggatgaggcacctaagatgacagctagaggtaactagatgagttgatggcaggtaaacgctatgataacaagtagaaaggagccaataaatactgggctggagcagctcaaagactcctgcctgcttctgaggtttggatgatccttctaacctttaaaagtgggactgaggaatctccctagacagtttggcacaaacatctgctcgatcagtgcaattgcttttgtgtgctgccttttaaaaagcaaaatatttaatggcagtaaaaaatgtgtaagaaatcatcctggagatacaaagttgtattctgggatttgatgattttgttatgtcacagccaagttagtatttttagttagccttgttaagcccttgaacaggtgcttggagctgtgtagaacatagaccaggtctccagtggtgaatctgactttgccaaaggcgagcaggtctcccggccacagccgtaagtctcaaggagtccatgtcttatggaagtttataaggactcatttctgccagccatggggttggatggcagttacaagaagggcatttattgggatttctgggaagtcaccaagatcttccattaacccccaaatgtccatttcttctttattttctctgattcctttgcttctttttcacctgtacaagttcttcttggaaactatgtagaattgtctgggtctcgttcattaaaagtgaaaaggccttcatcacttccagagttttgatttaggccaccgttgaagggcttcacttttatttgtaaaacttacctatcagtaagaaaaaagaattgagttttcatattaatttcttatgacaaacaaagcaaaacaaagcctagaggttatcaaactattatttaatgtaagtcagctcccacacattgcttttacatcattacctcagtacgctaggtcaagggtgctttgttgttgttgtttgtttgtttgcttgttcatttttttaagtggggaaaactatggaaatgggaagcaaagagatactcctaatggtttatttaattaattttactatttggtaaattcagataatgcacacagggccaactataagcttgaaagctggtattaaaggtaccattgcaagaagattctgacagttagaggaactacaggaaagtgtcttttcataatatgaaaaaagagatccttattcttgccagtatggtttgggttcactaatacctaattatccaccatcattgacttttattatgattggttttctaataggtgatattaatattcagtgtttgaatatgttccctattagcatgaggaaaagccaataatgtgacactaatatcatatttaatgtgatttattattttaatttttatgatggcttttgatcattccatatttttatattcacgtttcaaggttgttagacttttttttcccaattacttctgtttttgcataatcagtgtcattttacctaatagcatctctcttagatgagtaataatgctccatcatgcctctttaccaacaggaagattcagagatattaaagtgatttacctaattttttggaagttcctaacttctgttttgaggattggtgctttccttcttccttccctctatttctcccttctttttgttctctctctttcccttgctctcttccactcttcctcctgtactgttattttcctccctgtttttcttctttcctctctccctccctctctgtcttccttttctttcctccctttttattttttccttctagagtaaatagtattagaaaaattagtttctgcttttttaaaagaggaaattgtacagtgtaaagtgatcatttatattcaaggaaaatgctacctaggacatgccttatctcaccccagttctcggtgctgctaagagggtttgagaagcatgggataagggtggcggcaatgtggctgcaacagtgccaggtgagcaacccatgtccgcacgcctccactctcatttcttgtctggactcaagaccccagtctaagagtggcctataattctcctttctgattctctggcaacaggtgaatcccatgatccctgatgttgacatcaagcaaaagaagccatggtctctagccagtagattaacaacacagcatcttgggtgctacagcactaagataagcttaatcatcttccattatttcatgaggttgattggaatgagtgtgtgattggaagggaacagatggggacaaagagtaaactctacatctctaaaatctaactcaacatctttttctcaaacctgaccctttctccagatgtttttgtttctgcttcatttcagcattcttccttccagtcacgtgtgctcaaagtgccaaagttatctttgactcttctgtctttccatcccagtttcataaatttttcctttattctgtttgtgcaatccatctcttccactcaattttgcacctctatttgcttctgccctcccttcaccccacaccaactgttgaggcttttttctttctttggccctatctctggatttttcttattcaatttcatttcaatgtccgctgttagtttaatgtactatcttggccaaataagctttcactccaaatccttcagtgtttttctattagatacataataaagtaaaaatttcttagctcagagtataaggtctttgataatcattccttactcacaagtcctttggaaccatccaccttctaacaaggtaagcctgccttcttgattgctctctctctctgagcattggctattacgattatctctgcaagtcatattttcacacctgccctcttgtgtatgcatgtcccccccatgcacatatgcatgtacccttgcctctgaccttcccttcatattactctctgaattacaagttcctgataaatatcttaatagtgatgctgatgaagagaaagaatagaacagatttaaaggggaaacttctgggatggctttctggccagaggcttatcgttggaagtgtcatacttacccttttgccattcacgggagatttactaaataaatgcaagatggacaatgtcaaatcatatcaactctcctaacagtgcagcaaacgtaatataggattgtgatatagcattggtaccaaaaatgtgaaattatttatgaaaaaacattttctgtctttgagctaggagcatctattagaacaagaaaggaaaacaaatgcctacaattttgggtcttttcatatcaacttggaggcaaggacagtggcttagtcctcttgtaagatagcatctttcttccattgtttgttgcccaagctctggtagacctctcagctttttatggcctgccagcctctaccttttccccaggagttgtgatacttacagtattaaccaacaaaagggcacaatgttttacatcttaaattattcctcttgcacagtctgattaaagcttgacaatatgaaaagcagatgacagggccaaataaaccagccatcacttgaggtcacccaccattttccagtgtaagtggttctgaaggagtatcttttcttactttgaggttgctttagagacatatagctcaggtcttaatagtcagtccaaactctcattcacagagcattacacaagtgtattccaccctggtactttgttgggtttctgttgaatcccaaaacactgcttaaactcacctcaattacagggtcagcagtgcatctgcaggcaacatggcttctttgttatccctggtttgttttccctggctcagtgacagaaacttgacagtccagtgtaggttaaactgaatgagcattttgtagcataggtgctagtcccaagtctctccaaggacatagggctcaagtagagtagactttattaatgtccatcaaaggtgaacctagtcttcaaaatgctgcctgtccctccaggtgcatcaaagctactaattaccattcttccttccttccctactttggatgggcaatgaagaaaggagagagggtaaatgaaagatattctctttactctgtaatttgatatcacagtaaaatcctggaaaagatgttgttaatattcaccaatgaccattatccctgccacagtctacccactaccacatccaccaatctcagagtgctttgaacataggtttcaaacataagcagaacactggaagtatgtgccaaagaaaatgcatttgaatgtggtccattatttaggaacagtgagtttccaaccttatttgtctttctgttgtctatttttgtcatttcttttgtcctaaaacaaaaattatttttcttttttgaaacatttttaaaaattctataattatattaattcattcatttacttatttatcatttaattaacacaagggttggcaggctttatctgtaaagggccagatagaaaaaaattaaatattttaggctttgaagaccgtgcagtctctgtcacaactacttatatctactgctgagcatgaaagcagccacagatagtacataaatgaatgagcctggctgtgttccaataaaactttatttacaaaaagcaggaagtgagctgttgtttcccgacccccaaattaacatatttgactagctcctatgctttcattaccatgctagcttcaggggacacagatgaatagaactttgttcctgccttaagatgccaataggttaatgtttctggaaacaaggcaggccttcgacaaagtcacttttggtgtccttctatctctctgctgctccttttcctgccactttctcagacctagtactgtccactctgatatgccatccagatgttatgtaatgccatggtattacataaatgctctcccattcctcttctattgcaacttgctgactctcagcacattgtcttcaactaactggaagacataataaaataacgtacatcaaggagggaatcactggcagtagcttaatttgttcatccttcaggagttcttacatattaaaagaggatattttaaattcacagacatctacctctacttgtaaaattcccggcagaggactagaggaaatctttctgagcagggaagtccatgacaccatctaaatctcacagaagtgaacataaatttcctcctgtgactaatgaagataactcacatgtattgagtcactagcatagcagtcattgccctaaatcttccaggtaagatttactttgagctccctagtagctctatgagtcaggtgccattattagtatccccattttacagatgagaaaaccatagctaagaggggctacataacttgataaaagtcacacaactctcatgtgagatcgtatttgaacctaagtagtgagcagccttaatactgtaattatgaagaagcaagtcttctctaaatcagacatagttgagctctattatagaatcttagaagaggaaggacaattaaatattgcttagtataatcttattttaagaacaaggacaccagggctcagagagcgttttggatttgacaaagtagcttcagactgctggaagtaaaatgctgttcttaatgagttttttattttattttatttgtttttgtttgtttgttttggtcttagtaccacatggcctcttgacagtatagcaataaagggaacatgaattgattagaaaatgattccttcccgctgggacattagtctgtggaagactataacatgtgcgactttgctcttttatgctcccactcatctttaatcatgggcctactgggaacacctcattgcccctcattcactgggtggttgagtcttcgtgaagcaaacccacatgagttgttctatggaaggggagagcagaacggtgcattccatcattaaaatttcacatctaaacaccagtgcctgactatgctttctctgaatttcccatagggttattgaaagctctaacaaaacgtagttaaggcaaaagatagctgtctgttttataaagaatgtaaggaatttcccagtcagatggctcaaggaaaggctttacccgagcagtcctactttccatagcaaattccagttggttagagcaaacactgtgacaatatctattgttcaattaaaagtagccacaattatacaaaacataccaccatatggcatgtccttacatctcatgtatactgtagatactattttagcttcttgctttttctttttcttttttctttttaatttttttttattttgagataagagtctcactctgttgccaaggctggagtgcagtggcatgatcacagctcactgcagcctcaaccttcagggctcaggtgattctctcacctcagctcccaagtagctgggactacaggcatgtgccaccacacctggctaatgtttgttttgttttgttttgagagacaggttttcaccaagttgctcaggctggtcttgatctcctggactcaagtgatctgcctgcttggcctctcaaagttgggattacaggtgtgagccactgtgcctggcctagcctcttgcattttctatgggtgcattttcataatagctttttaaaatcaaggtagatcttagaagtgaaagaagatataagaattttatatattcttgagatataggaatctgatagtttcagttgtcataaagccagtggaaattcacagcttcaatgcgtacatcatgttgggaatttttctcctccactgtttctcatgagggtgggtttatagagttaaatagcaggggtatcttcaccaactccactgttggcattattttctttgaaaaaagtgtgcagagagatattatataaacaatatgacaaatcccttctccgtgggccaatttagtaaacttagagcagagaaaaactatagcttcttgctgctagaagtattacgcagaacacagatagctcttttcagtttcccataccgagagtcaggtaactgagtggtactcaattctcaaagcaacaagaaggctgaatattctggaaatccacaatgtagtagtaaaaatcaggtgactttggaactacatgaggaagaacaataaacaaattgctaattattccctgcctgccatcatttttatttactgagatttctattcctatctactttttgatttattgagattttaagggaatagaattttgggggaggttgttcagcaaatatactgtcaactcatatcattctcttgattttttatagaagaaattgaggtgcaaaaaggttaagtgctcagtattacattgttattaagtagtttagctggaatttgaatccatgtcttctcattccaaccaagagactttgttgactaaattaggctactctctatggtaagtatatgggcacaggtaggtgtaagagtacagttgtagtggtgttagtggtagtggtggtgaaggaagaagatactgctcatctctcctgataaatgcttacgagaatataaataacaggattattatgtcagttaagaataggcttacctgtaaacaacagttttctcacaattccagagttaagttattcagggttggtatggctcattagcattgtgaaaaaaagatctaaatatcttctctctttttgccgtcttcattgtgttggttgtggcttcatggggacaggatggctgctgcagttccagcaagcacaactgtgttcaagccatccatgtctttgctttcttgtttgtttgtttgttctgttttattttgttttgttttgtttttaagagatagggtctcactctttcacccaggttgtgcagtggtgtaatcgtacctcactgaagcctcaaattcctgggctcaagtgatccttctcgcctcagcctcccaaattactatgattacatgtgtgagccactgtgtccagcttcatattgttgcttctgataggaaaagctgatatttatctagagtccctaccaatctcttctgctttcatttcattaattatcgctgtgccatatgatcaccccagtatcatgggagtggctatctcccctggggctgggccctttgacttccccaagcagacagggttcagttaggctgaaaagggaggaaatggatattagacaggcaatacaaattgttgacacagttcctaatagaatacagtcaccctccttctacaccccaattcagaggtttggtttcattgtcaacagccaccatggttttatcctggtgattttgtcaagctgcagggaaataaaaggtagctgctctgcaaaaggtgacagaccctgatttactacctgatatgttgcttacactcctgtggtgtttttccagaaagaaaaatgaacctggccctagaagtctcactttgtggagcatatatctagcatgcaatactattctactatccctcctgtttcctcgagcatttcctgaacattcctctttggttattttattatttctctagaacatatataatttcagaagtcatctccttttatttgtgcctgttatccagtctttagcgtagctagatttgagccacccaaatgatggcactcttctttctggcacaataagcattttaagtgaaagaaagagtattagtagtctgagtggttgttttaaaactaaggttgactacataacaccatcccagatttaggccttgttgtgattggctttttcttgcactgagaaatggatatttaatgaccatctcactatgtcatagatgcacttccttaagttgaaaaggcctccaaggactcttcccaggagaaaaaagaaaatctgagttggagcttagcaacatccagttctgcatcaagcaggcctctctgctatgagaggggtcattgtttcaatcccctttgctgtggtggaccagcagctgtggaacccacccatgttcagggaccagcagcaatgaccaggaaccacgctggctgactcacacttaactgccctccaagaaaattcactataaaagaagtcaggaagttgaaaagaaagacggttttccttcacttagcttttctgcttaaggcttagaatcatcctgtatttgtctcctacattgaaacaacaaacctatttaagcaacctataaaatataaatagattttctgtagtgtagtcggtgagctttctcaggctgagttagtgtggcagctgccccagtttagcttctgcataggaaacaaggctctgctgaaaatgctgaaccccaggacaccctcttccttagtgtggctcagcacagatgcttgttgctttctgaaagcatccactgaccccatgacttagctgcctgaccctcctggaagtaccatgacacacttcacttttgttttgtctttttagaacttatgtcatcatttggggttgagcattttattgtgaaggctgcctagctcactgtggcatcctcagtgcctcctatccaatgcaaagtcaatagatatttttcaatttaaactggttttgtaagggaagccaggtatgcaggattaggataaaaacaggaataaggggacttctgggagcagttaatggttgaatggaaggggggttcaaggtgccatggctttgggtcttttctccattattttgagatgccatcatataggctacctttggttattcatcctattccattcccaataaatgaacacatttgcctttggcatatttgagcatgccctatcaaaccatgagagctttggtattaaaactctcctggtcggtgtccgggttttaccagaaagcactgactaagaaaatggagaagcatagttgcaggcctctcatttgtgccccatgagggagggaagagaaatgacagaagtctcacagctagagatctcacatctacttgtgtcccctttgttagatgtaaagccagccacatgagattacattcaccgtcggcaactcaggtaacggatctgaagggcagcttgttctttttttttttttgagacggagtcttgctctgtcgcccaggctggagtgcagtggcgccatctcagctcactgcaagctccgcctcccaggttcacgccattctcctgcctcagcctcccgagtagctgggactacaggcgcccaccaccacgcccggctaatttttttgtatttttagtggagacggggtttcactgtgttagccaggatggtctcgatctcctgaccttgtgatccgcccgcctcggcctcccaaagtgctgggattacaggcgtgagccaccacacccagccagcttgttcttaagaaaggaaagaatacaagccaaagcagagcaactatctttcacgggggctttcatagaaatgttttcatcggtacagtttggcaacatgacctccaaggacaagggcccttattccactaatatgagctatgatggcttagtggttaaaacctggagccaaaaagcctgggtgcaattacagaaccacactttgctgctagatggtgctgggaaaattaccaaacctctctgtgtttttcatctgaaaaattgggatgttaatggtatctatgtcatagggctgttaagaggattaaattattaaacaattgtaaaatacttagaatagcaatagggttatagtatacatgtttgttaataaattaccgagcctgaataaccaagggctttgaggccgactatagaaaacaatagagaaattgtagttataggatccaccaggtagatttcagagctggacaaaggtgaccaggcggtcagatggagaccttgggggaatgatcccagtgatggatagttgagatgcagatcaacaactgaggctgggcattctacaagtctgaaactagcaaggattgtgtgaagtttgtggatgttaagaaccttaaatttcctaaatatcatttattctttttgaaacaagatttgcctgtggaaatgctgtgacattttccaagctgtgcttcccctctgcaccactcatgacctcatactccttggcggcattttccaggtcttggtaacctcccttgaaaagagaaatatagttcagattcgcagcagtagtctaagccacacagctgctatgggtcaggggagatcaattacatttcctggggttctcttcaatgggcggtggtcttgtgcacacggcattatagatactcatccttggaacctggcttgttgaaggttctccagaggcaagaggaagttaaaagataaacttggctgtgtatatcctatttcataactgcctaaatagtaagcatgctgactggcaagaattagaactataataaatgcaattaaattgcctattacttgcataattgagaactataaatattttaaataataaaattgtgaaaaatttctctactaatgctctgggaatgtcttaaatctgtaaaggccaggggattcatagggatggctgaatatgaaatctttccattcatctctttgagatcaaatatttttcatgattatttcaaaaggctccaaaatggaaaagagtgaatatgtgagccgccatgagaaaggaagcccagaagagtgagtacagggtagtttttctgggaagatgtatttaggaaatggggcaagagcaaagaataaagaagtgcaaaaatagaactaatttgacactgcatatgtgtccttctccgttgctgtacatccttttttgcttccaaagggcataatttgatgtgattaaataaggccttctgctttaattaggtatctcagtccttgaaaattctgattaactttctgtgtatggaaggcaggagatatttaaatatgttgagagaaatacaagagcaatagcaaactaataatctgaagagaggtcctcttaacaggtgttttttttgttttgttttgttttttgtttttttttgttttgagatggagttttactcttgttgcttaggctagagtgcagtggtgcaatcttggctcattgcaacctccacctcctgggttcaagcgattctcctgccttagcctcccaagtagctgggattataggcacctgctaccacacccagctaattttttgtattttgagtagagacggggtttcactatgttggccaggctggtctcaaactcctgacctcaggtgatccacccgcctcagcctcccaaagtgctgggattatagctgtgagccaccgcgtctcaccttaagaagtttttaatactcgtacataaattcaaaaggagaagtggtatttgttctaatattttctataattcagttttaatatattggcatatccaagtgtgtttgtgtaggtctgtgtgtgtttgttagagagagagagagagaaagagaagaagaaggaggaggaggaggacgaggaggaggaggagagagattgtattattcaattacagcagacactgttagttttctgtgtaatacccacttttacttctttgttaacaatgaaatctcaattttatttgggatggaaatgtacccaggtgtgaaaaaacacatattttccagactcctttgcagctaggtgtcattgtgtgtcatggttctgggccatgcggtctaagtggaagttttctggagattttataaaaatttttgtctcttaatatgagcagttgccctgatttcttgtcctttcattcatcttcttgcttggaacttagcccatgagattgcagatggagactattacaatgaaaggcccatcctaaggatggcagacagaaataagagcaagtccagggcattaatgaatttgtagaactatgtcttcaaccgttatgggagaaaataaattcatatttgtttaagccactcatgttaactataatggtgcctacaagggaatgtataaagcaatagagcaagaggagtatcagcaattttcattcattaaagatctacttccaggactcaaataggcatgtcttatatttgatgcctattttggtggacatagccattttgaaatttacagagatccaacccatgctacaatacaatatttccatctttatagtgcttgagagtacatagatgggctgtagacaactaatatgtctgcatacactgtattcacttttggaataattctagtttttttgtttttactgagtagggacatcttgatagaaatttattaacaggattttgattttatgtaaaatgcatttaacttattttttatttgctgttttctcaatatcttatatatttagtattctatgttatattttaagggaatcttattggcacaattgtttttaatgctactgtgtataaaaaagaacacattttagaagcaaattgtaattagtaaaccaaccaatgttaaatgtttaagaaactgtaccagggaagaggacatagtacaattacagtagtactgacaattacggtaggaccacacatgtggatgccaatttatatttttacccactgcaacctctgggccaagaggtgaagttaaaaaccagtctctggctgtttcagagagttactactccacctgcttgtaaaattctgtctctttgaggtttttgccattgaactacctcccctgttatctacccacttctgcacactaactttcactgaccaaagactttcacttaaacccacagtcttcctttctctctattccaggccttgctgtcctcctgggttatttctgttttcatgtgtgcaacccattcagtagcattgactctcatttgtgggatatcatatcgttccatccataaagagttcagaatccacctccaaaagatagaaactccatgaagaaatagccaaaaagtagcaagagtctaaatatctatcagcaaaatgtagtatatttatacaatggaatattattcagtcataaaaatgaagtactgatacgtgctacaatatgagtgaaccttaaaaacgttatgctaggagaaagaagccagatacaaaataccacatagtgtatgattacatttatataaaatgtccaaaataggcaaatccatacacacagaatgtgtattagtggttgtcagaggataagggcagggggtaatgaggagcgactgctaatgggtatggggtttctttttgtagtcaaaagtgttatggaattaggcagaggtggtggtggttgcacaattttgtgaatatacaaaaaaaaaaaaccacactgaattttacactttaaaatgattaatattatcttatcttatgtgaatttcatctcaatgaaaaaggagattgagccagttatgttgctaagtttggaggaggtcaaagcaaataaggtcttctctttaccctcaaataactcatactgcgcagaggggacttccaatgggcccagcaccgtggtgtggcccagcctccaggagcaataggatttcctctcagatgaggatctgtgtaggatcaaggcagaaatctctactgaagtctgtttgtgtcacacacttgtgcatgcctgccttggagtctgagctctagctttgtcccagtcttgtcgccttctccaccatggggactttgcacttgtactcctttctgtgggaatcctgtttctttactcctcctgtctcgttaattcctcccaccttgcagattttagctcacgtgccattgccccagagaaatcttcctaccccgaccttcatagtcaggttcaatcaccaactgtccattctcttgctctcttgaaattctcctttgcaacagcttttaccagtttcccacagctgtaattctttcactcagttgtcttttcctgccagattttgaagttgttgagggtaggtactcttcaaaacagcaggcaaaggtagtactcagcccacttttgctcaccaacataacttcagcgcttcttagtgtctgacacgcagtaaggactcagtgaggacatgatgatcagctgagtgagtgtctgctactgtctacccagctacccaaagacatacgccgttagggacttccgagaggagaggtttttcccctctggccttgacaggtcctttcactgccacatcctttctcctctaagttgccatcatttgatcatcttatcctcacaggaacccagtgaggtagtttgatgccgttgtcatttacatttgaatcacctgcaatgcaaagtgaggataggatgactaaatgattaccgtgctcagggaaagtgtccagcattattttattgggctgttaggtcatgtccagtttgctcactcgaatacttcatcatattctgctgccaggcctataaatgtcaaatagtaacaacccttgacctcctggcccaaagctaagcatgttaccagatgagcctcactgaccttctttaatatgagaatctttaatatggattaatcatattataattatgtatttgttctttttattagagtccttggggaatgtcttttaccgaagaaatgttatcttacagggtaataagaccaaatgggcttttattttttaattaaaagaagatgaaaagttctgcttaaaatacttttaaaatgccttcatcttgaaggtaaatggcagacatgtatcattttgcacttatataaactttactaggctgggcaattgaactccaaaatgaggctgatagctaatagaacatttgtggaggagacaaacaaattgtccagaataaacaaagcttatgtttatttttaattgatagcagctgagcacagggaggtgtcattagctcaaggcacagatcaaactcattaagtaccctggccctcttataaatcatgcgacgtgtcgagtcttgaattaaaccaaacaagagaatggttcagaattcttcccttgtaccagcagaagcatggttggcacaaagacccttggagaaagattgagcaaggctgttccccttagtaacttctgagcctacgcagtgatcaacataggtgatttgcctgttcggagaccaagaattggagccaagtgactggttccgagtcctagctcctgcactcccctgccatgcgcagcacctgctatcggtaccttcccgttgcccttcagcctactcagggtgttactacccggctttttcacttgctggagacttcctgcaactcaggcctagaggtgttctcttgctgggaggttgtgctttgttcagttacaggcgagccagaaatgcagagttagccagctagggatgggagttggtgggtaaacacccttgctaaatcacccctcaatggaaaagttgtgttctacagagttcctcagagcacccccaacaggatggagcaccagcagccacagtggtaacctgttcactagtgtacactctcacttttcttcttcacagtgctttctgtaattgcctcccaaataagatactttttccaaaatcctagtctcaatgtctggttttggggatcccaacttgagaagctctataactgttccttttattcctaggacagtgttaaggaggctagaggtgggtagagaggcagcctagcacggtgcttaagaggacatgctctagaggtggactcgctggccacatcctgactgccactcactaggcacccagcctctctgtgcctcagtttcctcatccacaaaatggggtcagtgataataagagtacctatttgatgggcttgttttgagaattaaatgaatactaaatttatacttttgaaacactgcctatcacataataagtgctcaataaggtcaggtgtagttactagaatcacagaacatcagactggggaagaagtttacagattagctagtgcaacctcttcattttccatgtgaggcaactgaggatcaaagagacatggagtgatttcctcagggtcacacagctcatcagtgacagcaacaccccaaagtctctcagcgcagtgtcctccatgctgcgaaatcagcttcaggacagtcctacttccaaatactctgttaacaaacagaactcggtgtggtcatttcaatttgctgggctttttttcttaatttaggcaatgcaaggcaggaatgtgcaggcattatgtaagattttgaggagtccatgaatttaaaaccagaagttttttaaggggaataaaataaaaatcaacttcacaatgccataggcagaatgtcctcttgaagaatctaagatttagacacaaatactgtcttctgcagagtcctttacaaacttctgcttaacctcctggcatcaacggacgacaggttctggctgtgcagagtggaagtcccttagagtatttgacagcatttatctgataacagctcccagccttggtagtattcacttgtttatggaggtttgtacaagacagaataaaataaaaatgcatgtttctataccagccctttgctttttaaagtcttttttatctacggttccatgcaaagtcacatgttctcttcttccttttgatcttaaatgaggaaggggcaaagtgtgtgaagattccagaagaagtgaatcggagcaaagtcctcactaaatgaaagcttcgtcttccattcagccgctgagatcagtggaataaaaccacattagagatgatccccctggcccttagcctccagagagggcatctttcagtgacagtgaatgtgctgctatataaatacacaaagcattgtggaaaggaaagagctctgtggtatggagacttgtcaatatttgtccgaaagtcatgtttctattatcttcaagtatgtctggcaaaggaaatctggagggaatcttttaagaggtaaaacacgttgatttgtgaaaatgggatcattttatctcttctgcttcaaggtaagctctttggtttcacagtaactagttgccaccagatcaagttggggaatatttattcttttgcttcaattcctaaaagattgatattaatgcattaagcctctttttttctttatactttcttcttttctgcaactgataattaaagctataagaaaattaaattactattattattattagaaagctcccatgctagccagttctggttggatataggtcagctgtgtacaaatggacacactgtgaggctttgtgcaataatataaccactacttgagaccaaatgatgggtgatacatatcctaaacctctccctcatcatttttatggttaaattacaatgattgagcatcaagcttgcctaagatttgactactctacttctttgccttattttctgtatattaagttgcagggaaggtttttactttgcaatttatttttcctcttgaatagtgattatgtgaagttctaagcatcacaatgctgcagtgtataattcttcaaagcaggagaatcagagtgtagcaatggaatgcagaaaaaagcaatacgagaaaggattatttgtttgcatctgtaagaggataaagatggtttgaacatttgcttcatatggcactgatatgagcatacttacctcatttgaggtgaggtttccccagaagcagacagtgagaccagtgaatgcatgtagttgattttggaggtgatgctaggatgcactgataggaaaatgaggaagtgatcatgagaatggcaggatccgatacagttgcattattaaacaagttcctagaggagggctccatccccttgggattcttctgatggactgcatgagcacatctagaattgtccctcttgatatccatcacctttcttccatcacccatacacagccagagagtcacaggggcttgcaatgagaaggcactgatgtacatgggaacagtgagctttgaggggccacgggtgaaacatcaacagcgtgtgttaagctagaatgataactggctggttgaactaagtaaacaaatccaagtgcaaccttggaacctgggatattaaactggctgccaacattgggcctacctgttttctgtcttggtctggatttattcctcgtttccttttatttctttttctttaaaaaaaatcttttttccttctagtttctctataagattttttgagaatgcgtagatatacatgatggaggaataataaaaacactttaaagcaatagatgattcttaccaaacttacatggataaatgtaataggagacacaatttcagctgaataaaagccttactccaccactctccaaaccccagaactgttgtacagttagctttttagtacttacgactatctaatggatcttgacaaagagaaatataccatagcattgcattaatttttgagcagatagtatattttgtaattagatttaaaaaaacaatcatgtcttttgttgttaatgggttaccttccttcggtatatttgatgaatatcatctctcatggctgctcctgagtcagtctcttcagcaacctgttcctcctttgttactttgtttctgctcacaactttcagctccatcaacagtcatcaagtccatttggcaaatattgttagcctctggtagtggcgacaatacatagaggtgaaaatattctactgatataccactgtcatattaaactctatgttgcaatacaagcaattctcagactgaattctgtcacacacacacacacacacaaagcatcaatgaggaagtagccacaaaatagtcatccagtcttatcctgtaaacttagtgatgttcctccatctgcaagcacgcttgcaggaaaaccaacacgccttgcaggaaaagttcattttgagttgccaaacctctaggcaaaccaggctgtgaagtcacccattcaacatatgatcatgagaccagacagagctctggacctcggcttggctcccaagatcttattgccagaggctctagattctcatatatctcgtgcaagagcaatggtgccgtacaatctttttaggcaacaacatatcttgaacaccaatcgtttcaccaattgaggcatatttctaatatatcgtttgcttgttagctaaacttatgctattcaataataatagtggatgatgtagtcatctttggagggtgagtacctgattagaatattacatgttaattaattgccaccaggatatgtatttacacacacacacacacacacacacacacacaaagctgagagagagagaaagagatttttaagctaccaacacagaaattctttagaaatcatgatttacctttcctgtcaaaataatttgaaatttcctattgttaatctgaagtttcagtaaagagaattttattattcttcacatatagtatttctgcttttactgaaatggcttgctttaggaatttgccagaacagattttatctgccaatgggaaaaaaaaaattagatgttgaaagtcctgtttgttatcccgtcatcaaattcctcttttcaggtaaattttgaaaggttgcatcctgccagagagattttactgaattttctcatctgtctttgaaagctatactttatcctacagataaaactatgattgcatggatttgaacaagtcttatagaatcccttacatataatgtttagcctaataagattggtattggaattgtccccaaattatttagctagtacataatgctatatctataaattgtgataattttatgttttggctacagttgagttttagactctgtatgcagctggggaaaaagtatgacctactgggaagcatcagtgttttcttgcaagctcattcttcattttccaacccataatccccctctgctactcaaggaagctgaagcccaggattaatccatcggtgtccaaaggcctgcaggaggtcaggcgcagatggtttaatccttggtgctgcttggaatcatgggagtgggtgttggatggaagtgcctctgatctagctcttgctgtgggtgtcttgcacctcttgacacacctgtggctgcctggaggttgtcagcaccacccaccactctcctccctgccttctccgttgtttagaattcttgctatctagtgggtgacaaagaatgtctgaaaagttcagttgctaaatggatcaaaattagtttctcactagttctccaaaaggtgcaagtgctgttggaaaaagagctgtaaacaatattagttgttgctgccagttggagcctcataacaccttataattttatttctgttaatgagacacatgaggatctgtggagttcagtgggatataattttgcatatgcattattaaaaaaaagaaaaagaaaagctgacataagggagataaaagatcaagaagcgaagaatttccagctcatttaatagagacattgaatacccttatgcattgccttttgactatgccatctcttgtcaagcaattataaatacttgtaactaaaacattaaagcatagaggttaactaaacaaagcatcagcacattgcaggctaaagaaaacccttgtttaaagtgatttccattttgattaatttatccagataaaccatcaatttcccaaagttggagactccgtagatccagactttgttttctacgtgaaaactgacagttctctggaactgtagcagagaatatggtaccatttaaattatcgagactgtagggcaaaatttcaggcctcttaaagccagaaaaatggccccagtgagctctctcatgatcagttcattcttctgggaatctcaggaattactatgtctaatgactttgccagtgggtctggcctgtgtaattaagatctaaatatatctctatgttcattctataactaaatttcttatctggacaaatgacccatttatgaaagctcataaaatatcatagggagtcattacatacttaaaaatctctctaataaaatgtgcccaaagatggtcatatctgcattgctaataattttccaaaaatatgccttaccataagtaactagaaaatactgcatattatcattcaagagaagaaaagtagaataaagatccattagtattaaaaaagtatctttccttgctttaatttagcgaaaatacttgcatttttcttctgctctttcaattcctggatgtgctagcacagccaccatcacatcaacataatcttgcaagcttgtgcattcactgcagaaggcaaaatgtcatggcatttctttatgaaaatataaaacttttttttttgacggggcaagtttcgcttcacatcaaaggtaaatgagaatcaaggttgaaattgcaggcacttcagaattctgaatggaatactggagtgaccagactaaaggaaatacaccatatgtaaaggaaacattaactctggtattttattcccccttagtaatttccgaagttattgattagtagctctaatcttatgaaaatggttcattgtgtctcattaaggatgacttcatcttaccaaatcataacaaggaaggagtggaggtagagatagtagaggaggatgaaggaaggaagacttcccctcagttagaaactacacaagggagaaaagttatatgtgattggggagtgttatttaatgtttactgagagttccaagaatctttagtgggattttaaaaaaattgtaagttatctggtgatttatggttcaacctgaaggcaggagacaaaattcatatgtttgtgggattttttaaagttcataatggtctatgccttctaataatgacaaaattcttggaagcctctcagatcactgaatcatagtctttagaggtagttctcagaaatcactctatacagctctcaacctaagaagagccatttgcaattctgacaagaaacgataccttagcttttgtcttagctcacacagaaaagcacctgaccaattgacttcctcaccaggtagcatgcccatgctattatatatgtatatatgttaacgtacatgtggtttatatcatccaagtaaccgaagtcaaatggtcatttaatatagaattggaggcaccatagagcagctgagtcaagcctaaactgaggttatatatatcattagatttttttaagtacaaaagactaaaagtgcatttctttcacttttactgccacttggagttaagtttcctgtaatttgcagcataggacactttactgatataagggtcaccatcagtacagggatcagaattgtgaaagttcttagtttgaagaatcagtagtctaaaactcttgctactcagactgtaatcccaagactgtcagtattggtatcatctgggagcatgttaatcatacagaatctcagaccccaacccagactcactgaattagaattttcattttaaccagatcctctggtggcttgtctgcacatttatgtttgataattattctggctccaatttttggaatatattgactgtggtctaagctgtagacgtgtcatggacaggtagaaaccgataaaattgccccactaggaaacaattgagtctgtgataatgacactttatgtgaacagaaggacgcatgtgcttatcaggatgagaggagttaggtatttaaaaagggcagtattgttacaaggtacaagtatagagcacacgcttcatcatccagcctcttcctggttatccttaacctctgtgtagcttttgaagatctgccacttcaggtatccgtatacgtgaaaataataatgccctactccttgccttcccaaggttggaattaatgcaatgatatcatgaaagtagagcctgaagtagaattattttctatttacttgcttctaaatatgtccacagatcagtaacattagcatcacctgggaccctgttagaaacataatttcagcctgccccagagaaacggaatcagaatttgcattttagcaatatgcctaaatgattggatacacattggcttttgacaagtgctggtccatggcactttgtgaaccagggaactccctgtacctggagaagtttagatgatgcttgggtgagtcccatcaaaaatggtggagaggggagccatgtatggtgcatgcggaagttagaacaaataactacagggccagttgcaattctgagttagatatgtgttcttctagaaaaacactgaaacaaagtttaaagtgatctggagtggtcaaaggaataatttacagattttgcagctggatgtgagctagagatcccatgaagatatgttagttccaaaaggaacacattttgtagggtggggaaattttggtcagttctttggagcttgtgggaaatacatctctagtgaagaagtcttgtctaatcattggcttcttacttgtcctcaaaaatgttcctcaattacattaagtgatgtttgttactaacaaaactgtcattttccatgttgaaggatgtgtcccactttcagagaatcccaaaaattaaaaacagtggagggagaggaaaagtgatgggcagaaatccttccacacactttaaaggaatataacacttggctgtagtaagttttatctgagatagagttacaatctgctatggataatttttattttgttcatccttaatcaagatgcaatcataagattgtgatgaaaaattaaattcatcactttgtgaaattaaacttttgatgaagtcaaagtctagcagaactagtggcggctaaaagtattcatcaagtcaatacttgctccatccattcagctatccattcctccttccatcttttcttccatccatcatccatatatccatgcaataagtgaccttattacctttctaataagaatgacaatctagtgtatggactaagttaactccctaggagtagaaagaaattcactctctactcttagtgaatcctaggtttgtcacattttgcaaaaccaaatcttctcatctttatggtttgctcatctcccagtgtgggagccaaccctggcccgctagagcatttatttagtgaatggccagctgcttgctcccctccttgtggttgctggttggattaatgcagtgaacactgagaaatgtggagaaataacttacctcctggggcctgagctgtcatatctccttgcagactggctgctccccatcttgttctttttgctcatttccataatagactctggttgataaaactcttcactgtgattgatggtccacaaagcacagccattttcaggccacgagtagcaatttttaacttgggaaatatgactacaatcaatttctttctccttttcttttcttgctttcttttattttagtcatttctacagggtgtgtcctttagacatctctttcttggtcattattccctaattaattcccttgttaaatataaagtgtgcattagccttgactgatgtcttcctttgtgactaaggaaagaagaatttattacctttacgtattgaatcaagctgcataatcacaattcatttgtttaaagccctcattcttcataaaccatactagagtttaggccccctgcagctgccaagaggatctcacctgactttcataaatatgatatggagtcaggtgtttgcacatgtaattggtttaaaaagtggctgtattggctgggcaaggtggctcacgcctgtaatcccagcactttgggaggccgaggcagtcggatcacgaggtcaggagatcgagaccatcctggctaacatggtgataccccatctctactaaaaatacaaaaaattagcggggcggtgggggggcgccggtagtcccagctactcgggaggctgaggcaggagaatggcgtgaacccgggaggcagagcttgcagtgagccgagatcgcgccactgcactccagcccgggcgacagagcgagactccgtctcaaaaaaaaaaagaagtggctgtactcacatggaaacccatctcttcatttatgtaatgatttcaagttcacaccatgaaatcatggaggggatgaaatggaattgcccagtttgttgagagaacatgccgacacttcaagggataaaacagacgtgtcaagactctgcaggcgtgaaatctgcatatgcgttggtaaactagcaacctgctccttctccaattatgtggttctgtgacattagtaaacacagaaaaggaccttagctcatcccagggaagagagactgtgctggatatgagaaggatgcagtctgggctacaattatctggtgtagccatacaaaaaaagggaaaaaagctttgattagaaatggatagagtaatggttcgtaaagtgtggtcctgggccagatatgggggttcacgcttgtaatcccagcactttggaaggccgaggcaggaggattgcttgagctcaggagtttgagaccagcctggacaacacagcaagacctcatccctatgaataataataataataaatattagatgggtatgctggtgcgtgcctgtagttcccaactactggggaggctgagatgggagaatcacttgagtcccagcagtcaaagctgcagtgatgcatgatcgcaccactgtcctccagcccaggtgacagagcgaaaccctgtctcaaaaaaaaaaaaaaaaaagaaagaaagaaagaaaagaaaagaaaaaaaaaagtgtggtcctgggagccagcaacagcaatatcaactaggaggttgttcgaaatgcaaattcttgggctccaccgcagaccttctggatgagaaactggtagttaggccctccaggtgattctgatgcagctaaagtttgagaaatactataacggaggatatttttcttctgtttttttgggagaaagtcacactaatcttcagtttgaagacatgtttaaggctgttaagatctggtaggtggcacatagaacggttttcacactgtggatgctgaaaaagaattctcatctctaaccagttctttctcaaggaccgaggatgctcaagatgaattcttctctttcccttcttcccttgacctcactgactctgttctgcagtggaaagtgcttagaattctgagtcaaaggatcggggcttctgtctgagcttttcttcttaaccactgtgtgactctggggaggttactcacccagtctggggataagaataataataatgctttctgtcagtcttacttggttattatgaaagacaatgaagcccacggaagctgtagaatttacaaggtggtatctttcttcctacttgttaagctttaacaggggaagagactgatagctgaagctcctgagtattctgtccatttctatgatcttccagtaaatattgttgaatgtgtattctctctccctcctaacaactgttcagtttattagcagcctgtcagtgagtcccggaagaggatttgaggccaagttaggtgagaaatggttgattgctctatccatagcacctggcccataggttctttggaacctcaccactggagcctgttaagggttgggaactatttctctctgagaccgtctgtgttgctttgtgattggttggttggtgtgaatagattttcttaaaagcttctcctggaagttagaccttcaacttcctaattaagagacactggaaggtacaacttattaagaaaaccagggattgactcaaagccaaggatccataataacctccacttgggtttgtttaaaaaaccttcggaggcactggacacgtgaaagacagaatcccaaggaacactgccttcttcttaaggggcctctcactgaatcctttcccagttgtttgtccttggcagtccctcctgggttttaatccaggtctcaggggggcctttcttccttcttgtggctttataaagatttacctgcttttcctccttcttaccaagactagctggttataagcaagtgctctgtttcctctgaggttctgccaaaataaccctgcaggtttattttgctttaaaagctctactgccagccacaccaagggaaataacaatatcaaatgtcttaggttggtttcctcagaagcagactctgggataaggatttgggggaaagagatttatgacgaagtggtcccagaaaacacaacaggtgaaatgtgaagaagtgagagtgaaaggaagagtgggtattggggcaaatcccaggtgattacccaaggccacggggttgctctccagatggtgaaggtcacccttcaacattgtccccaccagggcaagggcaaggaatttgcaccctcccattcctcacccatcagtcattggtaaagggctgcccctggggagcatttgattcccgagctctatgtgcactataaaagttagttccagcatccaggggcagtcctctggcagttgctgtgaggggggcgtatcatggacaggggtgaatgggcttggagaaggatgaggcaccaactgtgtcccttagagctatgctgaggaatgctcccaggtgtatctgtcctccagagctcctgcaatcagccctgtgttcttgttcccgattcctgtgtgcaagaggcttcttcttgtcatttaaacctcttcttcagcccaggaggcccccctctcagggtcagttaggcctggcaatggccatgagctgtgggccttttagtctcgagtgggtaatttacttctcaggggatttgaaaagattgcctcttatgtcaattttcctcgggctctgcaccagcaaagtcacctaagggcgtccccctgcacttcccgcctcttagtgccaggtatgcagaatgtgcctgatacatgttccttaattatgaggaagatggagaggggatacttacaaaattagaggtgattaaggtcattgaagggtcaccatttggggaacattttcttccagtagaagctttcatattgcccaactgatttgccgttaatatgagcagggattttgttttgctttgtttttaatctttgtttcttccctttgcttctatataaagggagtttatagatgtaaacattctagaacaggatgcacattctcttgggtccagcaggtttatggagacctgttctccttttcacatatgtatgatttacagtaaaacattcctacaagtcacacaagcaagctcaggcaaaaatcaagttcttccatttgctggttccaacattttgtatcctaataaattcatggtgaaactaatccagctgtcttctcggaaaataaaaagtttgaaagagggctgctactattcatggccatgtaatagtttgttttatactgcatggagtcgaatagttataaacatgaaagcagctggcaataaatgactttacgacagctatttcaaaggtataatgaagaaaacaaaaagaaaccaagttattacttataattatagtgcctcagtgagttcgcacaccacactccaaacacttcactggccgtttctatgtgatctcatgcacagtctcctacaaagaaccttggcctttgggtcagttagccttgtgggtgggatgggcactgtaatagtgtttgcacttttgaatgcagtttttgaaggagacggcatccttttactatattcacccatgcgatggggaaaaaaattgaattattgactattctccactgttaaagagattttatattgaaaaaaactttaagaggagcaatttggtagtatttttaaaattttaaatgtgcttcttctttaacctaatggttaagtgggttaattttatttctaggaatagatcctaccagaatatattaggtagaaacatctagagtgttggttgtaacgctggatatgggagttcttgcctggaatcccagcactttggcaggccgaggcaggaggattacttgatgctaggagttggagactagcctagatagcatagtgagaccctcgtctttccgaaaacttaaaaaaattaaccaggcatagtggtgcgtgcctatggtcccagctacttgaaaggctgaggtgggaaaagtttaatagtttcagtttgaggccaaagtgagctgtgatagtaccactgcatttcagcctgggcaatagagtgccgtccttcctctaaaaaaaacacaagggtgcggtggctcatgcctataatcccagcattttgggaggctgagacaggcggattgcttgaatccagaagttagagaccaacctggccagcatagtgagaccttgtttctacaaaacatgcaaaaattaaccaggtgtggtggcatgcacctgtagtcccagctattcaggaggctgaggtgagaggatcacctcagctcagggaggctgaggctgcagtgagccataatcctgccactgcactccaacctaggtgacagagtgagactctgtctcaaaaccaaaacaaaacaaaaagaatatgggttgccaggttgcatgttacagcaaaatttacacacagcctacatattcatcaatgtggcagtagttaaataaacatagtataatcataccatagactagaatatgctattagaaacatatgaggtagatcaatatacactgacattgaatgatctcctaagacctactacatgaaaaaaggcaagttccagaacataaaaaccaatgtaagctccaatttgtatagaagaaaaatatggcgatgcttgtatagatcttataacttaatcatttattcatttatccacacaacagatatttattgagttccagacaccattctaggtgctggtgatacagcaataaacaaagcaaaggtcttcctgggagtttgcaactcaggaaagagggaattgatgttggggagactgtgaacaagcaaacaactgtgtgtcaggtggtgatgggagttgtaaagagatacaaagcaggctaagcaatagagagtaatttagctggaggctaggaagacctcttcgaggaggtgacatttgatcaaagatctaaaaggaacaagggagaaaaccagggagtatttgggaaatggagtatgccagacagaggtgacaacaaggtcagtggccctggagtagaatcatgctttgtgcacttgaagaacaaaaggagaccaatgtggctggaactcaggagcaaggaaaaagtggaagggaggggctaaggaagcgaggattggaggttatggttgtgattttgaattttattaaagcatgatgggaggtgattacagggttgagttgaggaagaggacatgacactatttagtctttaaaatgtaaatgaatgcagcggaaggattctcactctactcttggcagtgatggcctcaaggagggtgttctcagcgaattagaggagagaaagcgtgtggctgtaagagaactgttctcactgagatctgcctatacctgtcttgttttagccttgtattcatgtgttatttgtgtaattaaaaaatagaatcaattactctttatacgagataaagaaatcctttagtattcctttctgtgaccttggacaagttttctttcttagcttttctcttctccatgtttatagaaagtgggcaatctgtttttgatcacaggcttgttcatgggaatgaatcagataatgcacatagagctctgagcccagtgctcagcacatttcggtaattcaagaaatgacaacaattattgctgcagtgctgctgcctcccatgtccaaacactgtgaggcattcaggatactataaaattgcctgtctctctatcacctttatcttgagctatagagaaggataagaggctgtttcatagcatcacagaatttaatagccaaataagccatctagcccagctctgctccttttatagatggggatagagaggtgctgaggggatatactgttggctcccagacctgtagctagtgagtgacctgtgcttgtgctttccatgtcaaatctttatttcctgcattggtattttcctaactttggtcatttacattccatcttctggtttacctaatattctaattgactctttaagcaattttattttcaaaggaaactttgtatcattgtcataaatggaaaacaagcattacttgttatgatagattataataacttatagttttagcatagttatatcattgccattactacagtaatgctatataaccagcactcaaaaactcagtaatgtgcaatagtaagcatttcttgcttacatggctatgggttggttggggcacagctgatctgagactgagtttactacatctactccacttgtctgtcagcctccctggaccagtagctacatgaggcgtgttcttatggtatagtcttctcattgttctcctccaaagacaggaatttaaaagttgaaacctaaatgtcacgtccattattatcccattggccaaatcaagtcacatgctcaagtctatcatcagcgggatgaagaaaaatatatcccctctgtcttagtcagctcaggctgctataacaaataccatagtctgagtggcttaaacaacttatatttctcacagttctggaggctgggaagtccaaggtcaaggtgccagcaggtttggtgtctgtcaagagctcttttcttggtgtgtagactgctgtcttctttctgtggcctcatatagtggagaaagagataatcttcctggtgtctcttcttataagagcactgatcccattcatgagggaagggctccacccttatcccctaattacctcccaaaggctccacctcctaatgccatcatattgggaattaggtttcagcgtatggatttagggcatggacacaacattgcatttatactactcccctcgtggagtgtcttactcggttcgggatgcataacaaattactatagactgtgatttaaacaacaagcatttatttcttacagttctggaggctgggaatctaagatcagggtgccagcatagtcagattatggtgagagccctctttcagggctcaagttgcagacagccaacttatccttgtattctcacatggtggaaagaagagctaggtagctctctgacctctaatgtcctctagtggcactaatcccactcatgaggcctccaccctcatgacctaatcacctcccaaaggccccacctccaagcaccatcacagtgggaccagagcttcaccacgtgaatcttgtgggggacacaaacattcagtctattgcagaggaactgcaaaattatatggtaaagggtatgtgtagaaggagggatgaagacttgggaaaaatgtaaatatcacatttaaatgggtaatgtccatctgtttaccacctcaaaatatctttcatactcctagagttaggcataccatggtttgaaaatgctgaagtatatactgcaccctagttaacggcatgatggcacaacccactatgctgataaccaacatgtagagaaaagagtggggccaagcacagtggctcatgcctggaatcctggcactttgggaggccaaggcaggaggatcagttgaagccaggagtttgacactagcctgggaaacatagtgagacctcgtctctacaaaaaataaaaacaaattagccagatgtggtgatgaatgcctgtagtcccagctacttaggaggctgaggagggagaatggcttgagcacaggactttgaggctgcagtatgataggactgcaccactgtactccagcctgggcaacagagtgagaccctgtctctgagaaaagaaaaagaagggaaagaatggtattctgaatttcattgtttctaagatgcacatgttctcatattctaacttacttgaactaggataactcttatatttgaggtgttttacaatcacacatagttgtgatgaagcttctctgcctatacacatacacacttggttgtcatttctggcggattggctgggcaactgccatcccttgactttcagctaaccaaccaattaggggccgcctgaggaggaggtatgtgtcttgactgttgtctgaaaccctttgttggaagctctggcatgaaaaaagaaagagctacgcgcaaaactttcagagagggtggcagtggtttggaagaaaagtgcagagccaacagtgggtcagtcattaaggactggagcaacaccatcattcttgagggtatgaggataaaactgtggaaaactcctatctatgactctgagttgaaaagtgattcataagtactggatcctgaatgtgaggaagttttaggaaacaaacaatttatctcctttttatccatgctgtagaggaagatgtgcttaaaaattatctacataaatcaacaatagcaatttcaatgagtatgcaatgaaaatcctaaatgataagaaagcatgtgttatattttaactggtggagctttctcttcttagtggtccacaaagtaacacaaaataatggtgtttcttacaattgacagcttgcttgagtcagtgaaatgtgatatataatgaaaaacacttaaatggaaggtatatcaggtagcatggttttgcttgcaaataatgggaaatctaactaaaactgactaaacagtaaggaatgtgttggctaagcaattgaaaaattctagaggttaagagcactttacagttaatttacaccaacaggtcaatggtggtcaataaactcttcatctttctattcttgtggctatggaggggaaggtatgctgcttatttaggtcagtcagccccttccgatggagctgaaggtggagtcatttctacccagactgcaagactgctgtgtaaaagtggatgggatgacgatggatgagcaagagagaaagaaattcccactttgcaagaatgcctaaactgagaatcaagggtcagagagaagcaagtggtagggatgatggcttagggtttattgtgtatgttttgagacactgttagggtcaagacagagaaggctgaggagcatttccttccttacccttaaattacttagacagaaagggaagaaatgaagacggactttcaagggaatgggagacagagtctacagccttaaggatttcagtgcttttcactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaaaaggatttcagtgtttttgcaaatctgcttgatatcaacatgttgggctataaaagtatttcccacttggtggcccaacctataatttcacataagaaaaaattctccactcttaagtcaaatttatttttatttttattttttaagacacggtctcactcctgtggcccaggctggagtgtagtggtggaatcatggctcactgcagcctcaacatcctgggctcaggtgattctgccacttcagcctcctgagtagctgggactacaggcatgtgccaccatgcccggctaattttttgtatttttagtagaggcagggtttcaccatgttgcccaggctggtctctaactcctgctctaaagtgatttgtctgcctcggcctcaaatgatttttttttgttttttgtttttgtctccctagaatttctgatggctgggtgctcaggcctgattagcatggagacatattgctcctgaagtttgctgaaaggagaatctggaggctcacaaatttggttgctaatgtcattctccaaattctagaggtgattgctgagttatgtgcaacacctggcatgggttttggtacaatttatcattcctccatgggatagtatttgcatggaaggtggttatattaaatgcagctttgaaataaagaaatctcatgctactcacttctgatggccccatcagaagtttattatggcagagaacacaaactatgtgctgcaaaagttgttagtttgcttgttcacttgctctttctcaatctctctctccctgtctctctctgtctgtctgtctctctctctctgagtaataaaaaatgattaatggagtaggcttagtttagatgaattctgtgcaaagttattttacataaaatgaatttttttccacaatactctatttccatctctgctttatcattgcctttttgtttgaattaatgcaataatattaccaaagtcatcctccattacactaccatttgctcccacattcaaggcaacgatgtcatttccagatgaaactatttgtccttgttaaaacagacaaggcagttggtacattcagactcaattactaagttgcatgattgattccaagacagaactgagagctaaggcaaatgaaacttgtcattaactgtgcagtatgtttttcttctgctagatctgataggagaaagattcacatagctggatctaagagggaagcgaaagggagttagcccagatcagttcccagaaaacagactctaagacagagtttagaatgctagatgtttattaaggagtgcccttaatcaatacctggggaagagagagagaggaagcaggagtaggctgaaggagaaggtgagctggatgtagacccaatgatggaccctacagacacagtgaggaactctgaagctggaaggacccttcagtgttgtactgatgagccaaggtggccaggccttataccacttcattgatcagttactggtgtgaactgtcctgagcaggagcatgattctgggtgaggtggctttttatagctgaggcagtccttgaaaatgttgatagttgaaggctgtctgctgggttctaggtcctagactcaaggtcagtgattctcaacaaggggtgattttttccccctgggaacatttgacaatgtctagaaatatttctgattagcacaactggagagatgctactgatatctagctggtagcatccaggggtgctgctaaacttaccacaatgcacatagcctccaagaacaaagaattatctggtccaaaatatcaatagtgctgaggttgggaagccttgctctggagcaacagaacctggtggacatcacagcatccatgccaggagtcatcactaatcaagatattactacttctcagacacaatgctcatgttctttatttctcttactccttctacaaaccctttgaggcaggcctcagagtttccatttactaaagaaaaaagcagtgctcagagtagttcagtaaactgacccacgttatgaattggaaggacaccaagatgtgaattaaagtgggccatcttgttgaaaacattttgctatcttctggctttccctttgaaagagttcagaacatacaacccaaaaatgtgcccctctggcacattgactattttgagtcaaaggcacgtaaaaaaagggcaggtgcaagaagaacactcttgcagtcctttttaaaagcaggagataaaatttccagttgaaatatatcctccctgtactagaagaaaagtgtcattcttatcatcaaggatgggaagttgaggtcactggaaatctgtccaaacacaccttgttaaactaactcttgtctttcttatcacttcacccaattaactaccctagcccaagcccctttaccttgtcacatcttcataatctactactctttgtccaatttagtatatgtgtttaactttaactgcatctttcagtcatcattttcttatgaagcctccaatgccacatacaacttgaattaaatacatttgtattgtattttttttcttgttgatctgtcttgtgtcaatttaattatcagccacaactgaaaaactctaggaaggtagaggtaaaatcttgccttccctacaccttgagggctcaatgcagaggttgtcaaacattttttttttctctccagacatgagatacatgatgctcacatgttcagtttgctcccatggaattcctggggctcaagctgtaaactcacttttatcctacttaaaaggtacagtggaacatgactggcatggcacaaatatggggatgaatctgaatcctctctgatttgtatttttaagtagactgttcctgaactctgagtcctttctaatcgtaacaaatatatagtaagcttgcagttgattttcatacggagagtaacgcctattgatagtgttggtgaatgcctgtaaagagactacatcactttcagagtctgtgttacactgttgcttcatgatctgtatcactgaatgattaagtcatttaagaacattcttcagatgttattggcacctcaagaaccgtcagaatcaaagcattgactcataaatttaatttaaaaagagcagctactatgttccagaaactgttctactttctcattataaacagtagaattcactattaatagtaaaggcttccacaggagcagaaaaaagcatatatcattttacagacatacagttgagcttaacaaagtcaatttgtactctctctgaaacaaaatcacataaattttgacgtttttaatagagcatcatgcaaagggaataaacaaacataggctatgcaatagtgttaatagaaataaaaggcagtacacatttagccaaaagatataaacaaaaaggacttagatcttttattattattgacctcaatagtaatgttagttattatggtccatagcagctgcagtttttagattctagcatagtgccagtaacttaaaaaaaaattctgtcattaattccaacagcacatttcttttttcactttttattttatagatttagggggtacaagtgcactgttgttacatgaatatactgtgtaatggtgaagactaggcttttagtgtaaccgtcactctaacagtgtacatatactgtacccttcaggtagtttctcaccccttgcctccttccacctttctgagtcttcaatgaattattctactctctatgtccatgtgtactcattttttagctaccactaaaatgagaacatgcagtatttgtctttctgtgactgagttatttcacttaaaataatggtctctagttccatctatattgctgcaaaacacatgatttcattcttttttgtggctgagtagtattccacctaccatcttttctttatccagttctccactgatggacacttaggttgactccatattgttactattgtgaatttgtattgtattttttttcttgttatagatagcactgtgataaatgcaggaatagaggtttttaaaaaaataataatttcttttcctttgaggagatactgagcagtgagattgttggatggaatggtagttctatctttagttctttgagaaatctccgtactgttttctgtagaggttgtactaatttacattcccaccaatagtccacaacacatttctgtatggtgggcattatcttccttttacaattgaaaaatacagaccagaaagagtaaaacagcttggttgaatttacacagaaatcccttggcagagaaagttgccatacccagaccactttctatagctagaaagcctaatttagagtaaaatgtacatttatatttgtcaattcatttttttcaatcaaattctctgaacactgctaagcaaaatatggcataagcagtactgtgctggtaaatgtttaaagactggctgtcaaaaaaggggtacatattatataagcttcttttaaattgtactgacataaagaacatgtagcacacaatttacatataataataaataatatatgtaatactctttattatacattctaaatagttttttgattttcacagaatgcttttgttgaattttacctaaaatgtgtatcaatagccagtctgtggttttaactgtcccacaatatgggtcatgaatgttaattgatgttttcagattttaagcaactgatgtgacatcaggtaccatggagctggaaagagagacttgtgtagtattttaccatacacatacgacagacacacataatctcaagagcataggtaatagtcaaatgtgcaaagtaattagaaagggatgagttctgactattggttatctgtgttttgatataatttatttcattgtaggtttatataatttaatttcttaataataactttaacaattgcctcacaagattcctgaaaacttagcagttggttctcgtgagctgatgtaactgctgatagggaacagttaccagttaatcaaatatccccatttccagtgtcccctactccaactcatagctctgaatatgtaagtagagggcatcccattatcaaacaaaatagatgttgagaaagatgatgttgcgtagagttgtttctttaatattcattgttatttttgtggtttattcacaggcatttccctgcatctcaacaggcatttatggtaagtgatacagcttttgatgatgtttgtatttctttattttgctgttaaatgcagagattcagtgaaaaaataagaggttctctgatgaatatattttgctgtgatttagagactaaaaatgctcgtcaaatcccattaaagaatgtcatgaggctattcagattcttttgggttcttgaatttggttatatcgggtatcacatgaaattatttgatacattgtggcttgatgtcttttgttaaacaaaaaatttggttccagtaggattgacttctaatattgctttgtttaatgaaatcaaatttcttctcagtagaaagcataatgtacatagagtttagcagtatcattattttgttgctatttacaaaataatagaaaaattaaaatgcatacatatgcatatatctgtgttttcaaattttaaaaaagtccaaagaagtgacttttactaaatatgaagaattttaataaactgcaaatttttttttctgcatagtgatggattgtgttaagtagtgaatgcctcacttacagatggaagcaaaatgtttcttaatcacttgctttcactagcctaaagctctctaaatattcttccacctacctacaagaacttttttatactttttttcagaccattaataagtctgttttataatgttaaagattttctgatctaagtgaaatagattacattctttctgaacttaaacttctcacatggaagctgtcagctgaagcacaaaatatgtaaaaatctaacatatatgtatatattttaaattcattattacaatgaaggactacctagattgatgtcaaaggtaggagctttactttttttcttcatctggtatttcttttgaaggtcttgagcaaaataaaatgagaaatgtaggcctgaaccaaattaagtgggaaaggattttgtcacactatttaaaaatttaaggtttcctccttcaatttaagccttcttcctctccagattcccctacagcctgtctttgtggaaacaggatgagcactgggctggagggggctaaactagaccatctgcacaattatccccatcatggccattctttctgcctcacaaatgcccaataacaaaccttaaatatttgcttaaaggaagtattatgtacaaagttatgcctggcaaataccctaactctttatttcgccttatgtagagtcaaaccaaacttcattgcagaaatggtttttattatgaaaatgttctttcattgcaatcttgattttccttgccaaaaaaacaaacaaaaacctaatgcctacaccaatactgtatacatcattttctatgtttattaccttgtcagagagttgaagtatgttttacttctgagaatcttatggtaatgtgttaagagcttcaaaaagggaattgatgtaatatatatggtatactataagtaggggggtggtgggaaaggaaaacagaaaagcaaaggaaaatagggaaggaccataaaattagaggctccaatatgatcatgtcaatagatgcagaaaaagcaattgataaaatccagcatcctttatgataaaaaccctcaacaaaatgggcatagaagggacttacattaaagtaataaaagccatatatgacaaaccaacaaccaacatcatactgaatggggaaaagttaaaagcattccccatgagaactggaacaagacaaggatgcccattttcaccacttgttttcaacatagcactggaaattttagccagagcaatcagacgagagaaagaaataaaaggcatccaagtcaaaaaagcagaagttagactgttgctgttctctataatatgatcatttacctagaaaaccctaaaactcacacaaaaagctcctcaatctgataaacgaattcaggaatgtctcaggataccaaatccatgtacagaaatcagtagcactgctataaaccaacaacaaccaagttgagaatcaaatcaggaactcaatccctttcacaagagctgcaaaaaaaaaaaaaaaaaaaagataaaatatttaggattatacttaaccaaggaggtgaaacatctctacaagacaaactatgaaacactgctgaaagtactcagagatgacacaaacaaatggaaatatatcccatgctcatggatgggtagaatcagtattgtgaaaatgaccatacttcctacagattcccatcaaaataccatcatcattcttcacagaactaggaaaaaaaagctgaaaattcatatggaaccaaaaaaacagcctgcatagccaaagtaatattaagcaaaaaaaaaaatctggaggcatgacattactcaacttcaaattatactacaggtctataactaacaaaacagcatggtactcctataaagcaggcacatagaccaacagaacagaataaagaatccagatataaagccaaatacttacagcaaactgatcttcaacaaagcatacaaaaacataaattggggaaaggatatcctattcaataaatggtgctgggaaacctggcaagccacaagtagaatgaaactagatcctcatttctcacctcacacaaaaatcaactcaagatggagcaaagacttaaatctaagacctgaaaccataaaaattctggaagaaaactcttctagacactggcttaggcaaagaattcatgactaagacctcaaaagcagatgcaacaaaaacaaaaataaataattgggacctaaattaactaaaaagcttctgcacagcaaaataaataatcagcaagcagacaatccacagagtgggagaaaatatttgcaaactatgcatctgaccaagaactaatacccagaatctataaggaactcaaacatatcagcaagaaaaaaaaaatcccataaaaaatgggcaaaggacatagacaattctcaaaagaagatatgcaagcagccaacaaacatgtgaaaaaatgctcaacctcactaattatcagggaaatgcaagttaaaaccacgatgagataccaccttactcctgcaagaatggccataattaaaaagtcaaaaaacaatagatgttgtggtggatgtggtggaaagggaacacatttacactgctggcgggaatgtaaattagtacaaccattatggaaaatggtatggagattccttaaagagctcaaaatagaactaccattccatccagcaatccactactgagtatttatccagaggaaaagaagtcgttatatgagaaagacacttgcacatgcaagtttatagcagcacaattcacaattgcaaagatatggaaccaacctaaatgcccatcaaccaatgagtagataaagaaaatgtggtatgtatataccccatggaatactactcagccatgaaaaggaatgaaataatgtcttttgcagcaatgtggatggagctggaggccattattctaagtgaagtaactttagaaatgggaagtcaagtattgtatgttctcactttgatgttagaactaagctatgaggatgcaaaggcataagaatgatatcatggactttggggacttgagggtgacgggtgggaggggtttgagggatgtaaaactgtctgttggatgcagtgtacactgcttgggtgacaggtacgccaatatctcagaaattaccaccaaagaatttttgcatgtaaccaaaaaccacatgtacccccaaaaatgttgaaataaaaatacaatttaaaaaagtttaaaaaggcattttacttaatcactataatacaaaaaagcagaagaaaacacattttccaatacagtagacataacttaaaaatattcaagtatctcatgagatctgtggtatatttatgtatctataattcattaacaattcatctttcacttaataataatatttatttgttccacacacaatgtaataatttaaacacacacacaaaagaattgttagatcatattatatggacatgtttaactgtattgtgaaataccaaactgttttctaaagtgattgaatcaatttatactcctacccactctacccactccatttgaagatcaccatgttccctgtcctccccagtgtttggtattgccagtctctaaaattgttgccaatttactgagtgtgaaattttatcccattgtggtttaaatttgcattttcttgattattaataaagtaaactttttaaatatcaaaaacaaaagagtctccagagtggacagtaagaactaactaaaatctagagtggatcatggtccattttaatctgtgaagaatagggatttcaccctagagagagtaatgtggttcaaaatataataactgattcagtacaccattgtggcgaatgggagggaaatagtgaagattgtcaggcatggcattaatagtgtgagtcacattagctggcttggagggctgtcaccaggcaagtttagtcattttcacaatgctaggtcaaagaaaatacttcttcagtcctggctacttgtctctttctcctctgttttttggtaaatttacaagtgagactgatatacacaaaggtcgcatgccatattgcttttggttagtccccctggggttgaaacctaactttccttttagcttcataaccttctgtttcagtaactttagattgctatgtctctgtggtttatagaccattcagcattatgcaacttgaaaattacttcatatgtcctgcattagtccgttttcatgctgccgataaagaaatacctgagactccgtaattcacaaaagaaagaggtaattggactcacagttccacatggctggggaggcctcacaatcatggtggaaggcaaggaagagcaagtcacgtcttacatggatggcagcagacagaaagagagcttgtgcagagaaactcctgttttcaaaaccatcacatctcatgagacccattaactatcacaacaacagcaaagggaagacccacccacatgattcactcatctcccacttagtccttcccacaatatgtgggaattatgggagctacaggaggagatttgggtggggacacagagccaaaccataccatttatggtttatagaccattcagcattatgcaacttgaaaattatttcatatgtccctggtgaagttacagctttctcagtccttgcttctttcccaggatctgtgtattacagactagttttcttgctcttatttgaagccctcttcctccttcattaaccagataagttttctttcatcttttttttattagggtttgacgtaatattctatttaaagaaagtggtccatagctgaaaagaaaaattttacaaagcaaacacaactcccaacatttttgtaagtcatactagaatggaggtagagaaggtttttagaatcatttcctggtggcactctttttctttcttgttccatattccaaatctcactagaattgtttttctaaaataccacttggtgcgtgcttcccatctgcccaggagcctttgctcatattctattgcttgcagattgatgttcactcttcctagcctgaacaatgggcactttctatatctccataaactagtgctttcaaaatgtgtgagagggagggaaattggtgtgctaaggatgtaaattggtgtgctaagaaatttatatatgccttttcctttgcatctttaaaagggggatttaatttatggcagttcttaaagttatttgatgatagaaactagtatatcctcaacatttctctggactatgttttcttcagaatatagtttgagaaatttcttggtacccattcatcatggttatatcttctgtgacccacatgtacatgatctgatgaatataagaacttgccattgcacagtgaggtccaatcttgggtcccttcctgaaacttactccttaacacctcttccccaatgcacacacaccaaattcgcacataccatcaccaccagtgttgtctatctcatgccccaaacagaaacatgccaagcacatttaagcagactgaaacatttttaaaaagttttattttaggtttgggggtacatgtgaaggtttgtcacataggtgaacttgtgacacaagggtttgctatacagattagttcatcacccaggtattgagcccagtgcccattacctttttctgctcccctccttcctctcaccctccaccctcgagtagaccccagaatctgtagttcccttctttgtgttcatgagttctcattatttagctttcacttataagtgagaacatacactatttggttttcttttcctctgttagtttactaaggataatagcttccagctgcatccgtattcctgcaaaagacataatctcctttttttttatggctgcatggtattccatggtgtatatgtaccacatttcctttatccactctgtcactgatgggcatttaggttgatttcatgtctttgctattgtgaatagtgctgcaatgaacagtcacatgcatgtgtctgtatagtggaacgttttatattccaacaaaaattagccatggtagtgggcatctataatcccagctactcaggaggctgaagcaggaggattgctggaacccgggaggtggaagttgcagtgagccaagatcacaccattgcactccagcctgggcaagaagaacaaaactccgtaaaaaaaaaaaagaatgatttatattcctctgggtatataactagtaatagaattggtaggtcaagtgatagttctgctttgagctctttgaggagtcgccatactactttccacaatggttgaactaattcacactccgaccaacagtgtgtaagtgttcccttttctctgcaaccttgccagcatcagttattttttgactttttaagaatagccattctgactggtgtgagatggtatctcaccgtggttttgatttgcatttgtctaatgataagtgcattgagctttttttcattggcttgttggccacatgtatgtcttcttttgagaagtgtctgttcatgtcctttgcccactttataatggggttgtttgtttatctcatgtaaatttgtttaacaggctgaaacttgatctgcaggaagtcttccttaggtatgccaacccttggtggtcattatactttctgaaatttttttagcatttgtgtcaggacaattatcaactgcttcctcatgttgctccatagattgctgtttatatattctgtgctcacagccagtttggaatttaaagagcaggaattcacttctgcatatcctttgcacacccagtgcctagcaaagcactgtgtctctaggagaagctcagcaaatatttggttcatgacagcagtgattgtaatccaaattgttgcctaactgaagatatagaaatcagaattcttgattggcaaaataacaggtaaagaaagctacccagttggtattttcttaatgggcaaacatttctattctaggaaaaacaaatgtgtttttaaaaggcattctcaaactggaagtttgtatttgtaggtatggcagtgtccaccctgtcaaggtaaaatggaaactcaagaacttattcagttagagagccaaactaaatacagcattttacttcagttaaaatagaacccctttgtggtttattacagcccatggaacaatggtcactcaggaacatacaggtcagctggccatccaggaggccctgttctgacttctccgaatgtaccccagacccagcccatctctccagtagctgccatttctcacacacctgtttgctttggagttaccttcacttttagatttatgccccaaaagtccactgtaatcctagttctgctataatgaaattttgaggatggcagagctacctttcaaatggattttgttatttaatcactgagattattttataacaggataatttcaagagtgagcatacccatttcctggaaactcggacctcagcatcacactcacagtgtgtctggaggacctggccaggcgccagtactttgggggtgctcaggaccctggcagctctcctagctttctctccctctgcagccctatagccacaaaccatcaattgcagtgaaaccaccttagcctttttgtaaggcacagcctgaggaatatcctccatgtgattaacctgatttaaggaggagacaggatgagagcagacactgccttctttgaagttcccctggaagaggccagacttttccactctgacattcagtgagcactgttgctactccaacgtgacgtttccaggatggttccacagggcaccagaccacctgcttacactcaggatgaaaagcctcgtttggtcaaataccaaagaaagccctgtgctacttttggaaaaatagatccagatgaggctttcagggcttgaaatccctagattcctgttaaaattttgcactggcctctaaagcagtctctaaacagatctgaacctccctgatggacatttcagatctcaggcgtgctttctgccctttgagccctattttgacactctaatgctaataaatttaacaaaagaggctagacataatacatggcaatggaatttttactgagaagtgaatggcaaaaatgattttagtcaattttatgagagtcaatatagttaacagaaatcgactcctggctgaaaagtgtattccgtgagtacttaaaaatttggaaaatattttccctggaaaaaaagaaaaactttgaagtttgctttccaggtatgacgtggcatatgtagagaggaaggaatttcagacattgagttattggctgtaaatgtgaggaaaaattgaagtgcagcatagcttagctgaagcagctctcgtgtttatccaatatagttttgttatcaacgtggagtgcctgtttctatcagatcacctggtctctttctgctatccaccacatgctggcaggctgcaactttctaattgaatccctcatttgcattcaagtttgctctgcttctaactggtaaaaaggagaccagcgcaatgttatgttaaccttgtatctacttggcaaatatttttatcagtacatctgtctagagtcacagacatgacttggaaaaaaattagggcattctccaacggcaatgccaagggcatgcccttcatcagctttaaatgctgacagatttgagaaggtgtgacaatcattgctgtgcatatttacagaggaaggaagagttctcttatgtaatgcattgggaaccagagcaaaactgacaaaattatgcaccccttccttttatcaccctaatggctctcctccttcctttggcttttttctcttccctttgatatttccatttgctttaaaaacttactctcaggtggtctaatgatgactcttttcactgtcgtaaaatctctgctctggcaacctaagttttttatcttgtcaaattattcccactgtaagaaatgttatcattcttggcaaagcaaagtaacattagaatcagtgtaacttacttcccttgggaaaatgcagtgctggggccaagcctatctctatcatagctcgtttgaatatcactttatgagctaacacttttgagacagtggagagacaacttgacagacagcaaaattctggctattcaattgtttctaaccctgagtgcttatcatttggacagacaagtttagctaacattctcattcacagaaacattgatacatacatcccagaaaatatggtacagactcctctcgtgctctccataccctacccacgtctttaatattaaaatgacatcaaactaagaacccaaaggactaacttcactctggaaagtagtctcaagtgaccaactacaaaatatgctagttcagtgtacataaaaatggcagtgaaacccatgggcaggattcctctaggggacctgacaaaagagatgaaaatcctggaaacttagtttttctggaatgcagaggcagtgagaaaccagtgtcagtcttcctgatgttctgttccagatgaacaattttgggacttaattaaaagattaagtgtttcactatgcaatatatgcatggaagaaacttgtatgtgggccctctaattatataaaaataaataattaaaaaagaaaacaaaaattaaaaataattaagtgattcaaaaagtaataaagatcacaactgtctgactgtttctggggtttggatgtgcactcccttgtagttgtgtcaaggtaaaagtgattgaagcctggaaggcatcactgaattcccacccaccccttcctcagatgtatcacttattgttatgctataatttttaaaaaatgattttctgaatagacgaaacattgaaacagtaagccttttaaggaaatagaaaaactatgctaggaaattacagagccaatccattgagcagtaactctgggaatatctttcaggtaccttgaaaaataggagcactattaagaagctccttctaaagaactgttttggagtgttgaagaattgtccacacttggactttgatcactgaaataatttctacgtccttgcttgtttttctcatctagtcttgaatgacattccttttccttgctccttgtacatacttgtgtctaaagggtaaacgtaaataaacatagccctcttcaaaaagaacttcaaaaataatttgacaggtcttagagaagtcaaatgtgtttagctccttaggacaatgacttttatgtcaaatcctttttggtcaatgatactcttttaaaaatgtattgtgaaatgtatgtgaacaagaccatattagttagggtaaagttaaactgttctaacaaaaagactccgaaatagactggcttattgaatatcatgtttatttaccactctgctaacaggaagcattctgcttgtggaggatttgttccactctgtcattcaaggagccaggaatctaccatggtgtcaatgccttcccgaaggtattggtctcatttacttacccgccctggtgctggcaaaagatgtgtatatggcaagcacaccctctgtctaatggtccctctactcaaagtagcattcatcacttccactcaccttccatttaagagaaattggtcttgtgaccaatgtctgcaaaggaggttggaaaatttagtctagcttggggtctacacatctgactacaattctattacatggaaagaagggaatatcacattttgatggacttccagatatttaccacccaaagagaaaagaaaaacaaattaaatcaacaggttgctcgtagataaattagtttaggggcagtgtcagccacccgtaatgggtacttgctttgcaagaatatttggtaattttgatagcatatactttattaaaatgtctttataatgctgagtgcttacaaatttgaaagtatgaaatttttaaggcataaggacagtgatctatctttagttgtcagacactatatttagatatttagacctcacctcaattgtttacattttttggtaccaaaactccttgcaaaattttcagatacatcagtggaaactaaaatcaatacattgagaatgaatacataattgcattatttattacattctaattctggcccatttccatagaaatccttggaggcatcaatcgcaatttgtttctgcaacactctaaggctgtggggccacagtcatccataaacataccaggagtcctgagcagatatggatttacatcctgtgtacctaggaactctggggaaatgtgagtttagggcagagtctgatcatagttgagtggaaatattacagagaaagagagagaaaatgatcatatgaatatgaatctaaatctcctgggtagtcaaaggaaatctccttagaatctttagagctgaagataatagttcatacctgtttcccatttcagccgtgaacaacagggagagtttcctacaagtgactgcaaattgaactgaaattaacaaaatcgacatgaaattgcctcactttgtactttattgacctgacttcatttctaaatgttttaaatgaatccagttttaccaaaatgttcctagatcttcttaagcaattgcgtttttggtaaaatgcactttccctttacttgagatttccattctggtaattgtgacttagcttatgaaactgggctctaagttctgtcactgttatattccagcacctagctcagagcaggatgcagagtaaatcttaataaatatctgtttcatggctaaaaaatacataagcagctctccaatgtaaggaggctactggcctgttctgtccactctagagatcatactctggattcaataattactgagtctatgacaccctggtttctatttttttacttactctaaggaatgatttcattcagattttaagacgataacaggagagtcagttaataaaaatagagcctaatcttttagatgtggttaatttttaaagcggttttattaaactgtaattcacagagttgcacaacaaccatcataatctatgttcatcatgcccaaaagaaatcccacattagctgtcactccgtcccctctctctcaaccttgggcaactgctaatctacacttgatctctatagatttgcctgttttgggtatttcatgtaaatggaatcataaactatgtgatcttttgtgactactttccttcatgtagcaaaatatattcaaagttcgtccatgtcatagcatctgtaattaatctctttttattagtgttcctttgtatcaatgttccacattttgtctgttcattcaggatatgtgcactgtttctactttttggctgttgtgaacgatgtttagatgcagctcatttaagcataattacatcgctaaatatacgcactataaatgtaaaacagtggtgttctgtagttaatttttagtcttccttgctgtttccattctttggtcctctagtttctctcaggcctctccaaagctacttttgcttgatggctctggtgtcctgctggcctatgcagtgatgtaggtttcttgaaacatggtctgtatctctgtgtgtagtcagtctgtacacatcgcctcagagttctcttagagtaccaaagaacatcgtggaaggagagcatgtatcaaagtggctttgggcatggatttcaggctccgatagatctaggttcaaattctgagtctcttattagctgtgtggcctcatgcaaattgcttaatcttcctaggccttaataacctcaattctaaaatgaggttaataatggtataattattgaggttttttagtatgaggttaataatgtaaaatgaggttaataatgaggttcatataggtaataatgcctatatcatggggttgttgcaaagattaattggataatgcattaaaatgcttatcatagtgtcatatataaacacaaacatttaacaattatttttaatagtaacattattcttataactactgctgtcattattgccctgccactagattctgagttcttttagggcagggactttgattattttgttcactgctatcgcttagattctagaactctgtctatactattgaacaaatacttcactatttgaagaaggctttacttttgttctggatgataccagtcagtggtcccttatcatgagagccaccttgctttctgtttgcttgaatttgctgcttttatgaaatccaggtgtctcatctcagccacctctgagtcctgtggtatagcctgtgagttcagctgtctggaaatgaagtctgtttgtaacattatcataccacactttatacataaccactgtagccaattgtttaaaaaatagtcaacttgcttaagcacttccaagctccctaaaatctaactaagtcctaagaataaaaaggaaacattttgttttgactgtaaataaatacaagctttccataagagagagagagagagtaattatagttatttgtggtctgaaatgtgaagttatgtgttgtaagacagcagattcttacggacaaaaccaaatcatgtttctgtacatagattttaaatgcttccttccaacccaggggacccaggggagtagataacagttgccacttagcttacagagggaaaaagtccaatgcttgcgtttcgttggcccaaaatacccggaaagcttgcacagtttttcatttctaagatcataggctcttagaactgaaaggcattttggaaatcatacttgtcctagatccttattttcctggctgggaaaaatgagacccagagttgctgagtgacttggctagcaacatccaactagttcatatcagaaccaagaccaatgtgttgtccagccaatagggtgaaatagcaaggggagaggtctgggaatcagacaatcatgaaccccaggatggtccacttgctgacctcttctttgaactgtagttccaagcttcctcatatgttagatgggaacagcattaatatacaccttctgctattagaagaaaagaaaggatttgaattgaggcttttccagaactgagtagagtgccaaagatttgtgtcaataaatgtcatgatggcaatactttctctaggtccccattctctcctctgtgtcttcttctacccaaactgctgcttctagccaaatcctgtttatatggactaccccaccttcagccattgggttcatcatcagtgacttctgaagactgactgaatatagaaaatacctgcacacccatccttctatgcatcatatcattgtttcttcctctttatcatgaaagatcctttatagttaaaggtgatgcatctgtatcctcagggtaccaaggcataggcagcctgtgcaagggaggatttttgttcttgttgaaataaaacattgtattctaaagcagaggcgttttgcaacctcattcttaaaacaaaatgcttaacattactcactagttaagtaattttatggccctcccccaataaatcttgtacatgaaccctcaggaaggtgcacatcccgtggtttatggtgcctctggcacactgccaacaccccagtttgaaaagccaggcattcaaccaaacttgcgaacgccagcccttgcatataattacaggaacctgtgaaagtgatcaccggcagctcaggggctccaagcttccgcaagttctgaatcccttagcaagccggaaagatctgctggcgctgccgtagggaaaggttagcatcctaaattatggcctttcaattttttttcaactttgcaaatattttatcttctcatccttagtgaaaaagatagaagtgcacagttgctgttttcccatgttgtttatagaaggaaaggaggtctcaacagctttttccatccttcataaaacaatgaaaatgtgcctcgtggccaggataaaacagtgatatgcatcgagtgatccaggaaatgtaaaaatacttgacttgaaagactttttaaagatacctctgcacatgttaaaggcagtggcagtactgggacctaagagtgtgcgtgtgtgtgtgtgtgtgtgtgtgtgtgtgtgtgtgtctgtgtgttgtataggaagtatcccagtgcagttcttctccctacaggcctcactcccaactacctgtccagcctaggaagaggtaaaaaataggaattgtggtgagcatgggaaggtggtgaaggagacaagcaacaagagacagaaatgccaagaagttaaagcaagctggctgcaagctatggcagggcaacaattcctgggaaggcagagcctggctagcagaggagctggggcctgcagattggtcggtgcctttgctttcctgctgtttccacttcgtgttctttgcctcctcttcacactaccaactccttccacttcacacgttctatctcaagtgaggcagtgcccatctcaaaggggccacagtgttagagctgctaaaagcaactaggtaagtgggaagatggggttcccttattttcctaccaggctctccagccccagggctgccatggccacttctccagctcccatctcacttcctaccctaggcctgccataatctccacccagctttctttccaggagtgaagtccagtgtccaatcgagttgccatgctggacaaactgaccttgaccttttctatcccagtgtattatcttgtctctagcagtagccatccttaggaaaccccaggaaatgctatgtttgcttaggacactggaaacatggggtaaaatcaatgaagctgttttgtgttctgccgcagggtgaagcaggaaagaaatctaatgggggagtgactcatggtaagagatagtggccctgtctctcaggctattagaaggtaccaaagaggtgaatacagactggttcaggcctgtgtaaagcccaagtatttatccttgtgagaggccatgacatttttcctccagttccccaccctagaacctacactcttctaatccccatcccatctctgcctcccctttccttggaatacaatgttacaggctatggaattcaccattagtaatgtcaagttgtggaacttccattccttctgcttggaaggtagaaggcaggagagttccctaggagtggagaggagatgctagaagcccaatccaaaattccaagaacatttttcttaggatgaagactaccagcatggctttcaagccctagagtggtcttaccttgtgcctgactctctttcagtctgtcctagcaggcattttctctgctgtttgcatcctcagcctgcagaactcttactgcccatcttcagctggttaatggtggttaacaagcaaggcccctggagggatgcttgccctggcgtccctgagcagatcaaacctccttattaccagctctcatggtgttacatggctgtccttcatagcccttaatacaatcaaagctttatatttattggggtgattattttatcaatgtcagtgtctggttttcctcaccgttatgtcccctgctcccagcacagtgtttgacaaatggtagagagtcagtaaaatcttgttaaataaatgcatacatgttcctgtaaaaaaagaagcactatggtctatcttcattataaattaagtcacttttgggcttgtcctgacaacaaaattataatgcacagtattatcttgtgagaatatgaattataagtttcaaataatcaagtgggaacaaacagttttgaatatgaacaacatgtaagttagagttcttatatttaattctagggatatgtttatcttcttttcttataggacatacaaccaaataagtgttttgtcttactataaagatccaggattttgatgtttgcattgattatccttacagtcatcctaggctaacagttctgcaaatggtcatcttttctcttagggaccatccctaagaccttgaataactcagagcagataatcaaactatctaatgatcactgagatcatttatgcatcaggatttatcaataaaaaataaaccctttgaggtactaattgattttttattcccatccccaaaatggcagctcattagtgtctagtcaccagaaaactggggaccatgtggcatccctgtcccctcaccgtctaatatggcacctgttccatggaacatactgaataaatactcatggcattgaaatgaatcacacctatccctcactgagccttggctaataattgatcagagagttcatgatcaccacccatccttgagagggctcctattaaaaacagcagcaacaacaacatgtgactagagcatctgaacgcttatgtagcactgacgttaacaaggataacaggagcttgaggggcattttttaaaaggagtgcttttaatcattaaagtgagatacgcacatgctaaaaaacagtaaagcaatataaaaagtcatcaaatggtaaaaatctcttcccaattaaaaatgccagtatccctcttaagaggcagccactgttgagtttcttatgcattttccaaaaaaataatattcacttcatatataagcctataaatataaccaaattttcagtctttttattttcatggtttccaacttagaaaggccttctatttcaagattatttttaaaaattaacccaggtttcttctagtgatctagtaacattttaaacatgcacagaggctggacatggtgtctcatgcccgtaatcccagcactttgggaggccaaggtgggcggatcacctgagatcaggagtttgagaccagcctgaccaacgtagtgaaaacccgtctctactaaaaatacaaaaattagctgggcatggtggcatatgcctatagtctcagctactcaggaggctgaggcaggagaattgcttgaacctgggaggcagaggtttcagtgagagcaaagattgcgccactgcactccaacctgggtgacagagtgagactccgtctcaaaaaataaataaacatataaaaataaaataaacacacacaacagatattaagccattgatttatgtatatatgcatatatacacacaccatacaggtatacatagatatcacacatatatacctgtatgtctatacaagcatacatatacattatatacactgtatattatatatagtatgtttacttgtctgtgtgtgtacacatacatatagtgaagtatatacctaaactactaaaggagaaattttatatatattacaaaaagttataaatgcatgctcttacctatgtatattggtttgaagaaaaatataaaatacttaaaaaagattttaggagtatacataactttaaagaaacatataagtactgcccatttctttcccaaatgatacctatttttataaatttctttagactcaataattataaggtaattttttatgattaccttttatttatagagatatatattatagttttaaatgcttatatgtacacacgtattatatacaataaaaaatgtattacctattttgtgtgtgtatttttgtgtatgaatgtgagagaatgtggtgtgtgtgtttctatatgtcagttttaatatagtctccaggcagattttaggactttatgactttctttttaaaccttctgtctatggaataattgtgttcattgcttcatctatttcttgcaaaatagtgacaatgagctttctcccactgactaaaaccagacctgttccacccattcccaccccacaaatgagcaagtcatgtaacatgagaataaattaatagtgaagccctttgacagttgtacctcaggtgcttctgatgtgcaatgacatctctcagaattaaacctaccattgtcagtttgtcaacgattttctacaagtacaaaatggaattgcgtccatctcactcagatttggaagcaagtctgattatgggacatactgggcttgacaagctaaagacagatacagacattttctcatttatgaatctattcctttgggacattgttaaaattttaaaaaggtcgtatcttctaggaggggataagtaacataagttattttgcaatagctatcaatgtgaaattttgtattgtcttttggaagtcagaggaagaaagatgggctgcctcggtgcattttccatttgcccgtgattagcatgttctgaacatctcagtgggagtcagaggtatgcttctctttgggttttttcagtgtgaaggatggaaggaactctttcacacctttcatttgcactgttaagacttacatcagaagtacaaagcattttaaactgacagaataaaaagcaaacttcagagcaactttcctgcctatggtgctttccaaggatctaagacacatgagcaaatctcctgaagggtggtaaataaaaaaaaaaaaaaaaaaaaaaaaaagagtcacctttggccctttcttcatctttgaaatacactcgagaatgggctctctccctctgaggctaaatccagtgtgccctggagctgtcagacctgcagaaaggccctttttgccaagcagtctgagagaagactagcggtaattggcaatccagttctccatttccattgtacagccatccctgacaaattaatcacaatcaaatgttggctgcagcaaggggcaccctacacagcaggaaagaaaaatgaggcctcacgctgatctgacagccgaatctttcaactcaccccattagactgaacaaggggacgctgtggtttgcctgtcactaccactacccataaacaaactgctcgctctgcatctcaggacttggtggatccagtaaggccttccttggggcccaccaggtatctgaacaatcagtgcttcagagaaaggggaagggcctcatcctggtgagaaagaggcgctagatagtggcatagtggcataggagactggtgaggacaccgtggcccaacagaatcctgaagtgatgaatctcaggtttgacagtgggttgaggtctgctgcaggctgtaacggagtgtctgtctgtgcgcttactgctcacctgttgtctatcagccatcagtcaggtagtgagaaatccagccctttccatccactgtttagagttcacttatcgggcaagcttctttgttcaacataaaaccaagaatctgaaaataccttaaaatgttatttatatacttgcccagtctctgtagtaaagtttataagccttagtcacagaagagagtctgaggccctcactcttattttaggcataattttaacaagtgtgtcacagcctatagcaaattagaagatggcaggaagatcctgagaggtagatgctgacagtaaacagtgggataatactgaaaggtgacccaaaaaaagatagataagtttgtttccctgcctgccagtagaatataagagaaaatcatattttgaaacgcttggtcttttttaaaagacaaatgcttactctttgtaaaagctgtgtaatgaaatgtccccgtgatgttagatctgaagtggaagagtctctcttctctcccatctcctctgtaatattcaagatgtggtatataactgaatcacatcaagcaagaataataacgctgcctctgttctgatcaagtttacccttactccttataactgtgggcagtggcattcacggctctgccatctggctctcacaaaactcagggccaggggcttgtgggtaggtggtggaatgttctaattcctggagaagatattattattcagactgtataactgaatagcatcagtttctctaagtttttccatttcacctctcccagacaactgagtataaagaagtataattaaaatgttggctttcataaatgttaaagccacatttaaaacatttctcatctctaatactaactcagaaaactacttttctccctatatatttaggactagagattttgtcaataaaaataatggagaggatttgaggtccaaattaaagcaatgtatttcccagaactaaactgagtgtgtcagtggcttgtccaaagtcttgtagaagccagaccatgaacacagcatcaggacctgctgtttagtctttattcagaggcacataatttggtgttcttctgatgactggtttgtttttgtgggaataaaaagaatacagctgaagggatgtacctgaattgctgttttcccctttctctctctctctccctgagaaagatacataataactttctaaacctgctccagcagtctaaagattccagtgctcattggatcatggatttctcattttaacctttctctttctccctccctccccctccaacctcctattcagatgtgatcttaccagaaaatgcaattaatttaatcattcctaacattccattattttgatttgtttttaaaattatgtttacatcatgatccagttcaggttaaaacgcttgtacactgactgaattgacgcctatctttaagttaacaacattagttactatgtcctggaaacctataattgtgcctgaaatcttatgtgttatttgtaattctcacaacaatcttgatagatcagtatcattttccttattgtacaaatgagaaatcgaagaccctgagaggtgacataagtagcttaggaaggggctgaggtgggacaaggacaccacctgacttcagaggtgtctgaaaacagtccttctctgggataaagaataccgcccagagaaacattctcctgtcctaaaaagcaccatgcatgttcaccaaagcctacccagcaagtgtctggtctgaagaattctccttttctagggtctatgccagtgcttctagttatctcatggcgagagaagcttgtagcccccagagtgggaggtctctaggcagctgtgagatttgtgctggagtgtggatattagacccaaagccatgggctttttaacattggcctgtgtctcccacgcaatccgagctttatgcaccagatcgttactctgctgtgaaaatgaatattgggtttatggagaaagctaaacggttgggaaggtgtgtccctagccaattgtcaatagaggctgtgagcttcagaggaggcaattgtaataggttttcagttgacacacagttatgaccaaagcctttgaatcatttttgtgtgctttaactattgtgtgtttgttcagctgtatctttaataagaacagagcattattagcagtttttaaatcattctttgctgtaggttataagcatcttgctgcggtattcttttcaaattattggaatctctctttccctgccttacatcctgccctaacactgccttcccctctcatgttcccctaacaaatgctatatccctctcatttgacatattcaaacacacacacacacacacacacacacacacacacacacacacacacacccttattatacaacttagtttccggactgcaacagttgtctagatgtttctgagttaggaaacttgttgaatcgatatgcaggtcttctctctgtttaggtctcatttacccatcacacatatatttatcaaatatattcttaaggtttccttctccaatttcatgagagacagcctaacattccaggccaagtttccagcagtcacgctggctctcttcataaatctgtaaaataaaaatgagctttctcctttgtgaaatctcttttttataagcttaatagagacccagacaagcctgagggatagctctgttgacctcatcaagtttcttgcagcaggatgtctctgcgaaagtgggcttttaaccatttcgcatactttgaactgtggagctgacctagctgtggagaggaattgattaattagcagtgatggtggatacttattaagcaccacgttgtgccttttgccttgtgctgtgttagatgtttggtgtatattaacccctttactgtcgaaggccatctgtgtgataaacatttactctcattgatgaggaaagctggcttatggtcacacagagaccacaagtaccagaatagtggttggaccaaggcatcccaacttcaggtttcacccacgtagccaacagcgagaattacatcctaccaatgtttagagactttcttcctgtgcatcttcagagacactgggcgtgcaggcagtagagaagtatttcacctgtcaccaatgggcccatttaacagaaaaacagcagaacactcagcattcctttttaaccagctatgtcagccatgatttagataatgagtgtgcatattggtcctacctctgtgtcatctgatttaatggagattccagttagtggcagcttatccggttactttagagactgattaatgagttgtcactgttttattggatatcggtcatcagaggcaggaatacaagtgtctctagcatctgagcaacccagaacattcaacaagtaataaatgaaaacgtcagggccctttagatgtgtgatttatgtacatacccttggggtactacacttactataaaacctacaatgcaatccttatccaaaattctgatggttttaatgtttaaatattctgcttgtgaaatatcatatggctttgagcaaataactgtcaggcctgtcgaaatctttttgtaatgggaagactgtgaaattatagttgtgaaatttgatgattttgaagaagaattaattactgaagtttttacagcagattcactttcattacccatttttctttctattgtaacgtctgtgctcggttttcctacatggattacaaccttctagatgctgactgacctctcatttcagctcatttttttaagatgggaattgattgacattttcaccagtcacgctggctctcttcataaatctgtaaaataaaaatgagctttctcctttgtgaaatctcttttttataagcttaatagagacccagacaagcctgagggatagctctgttgacctcatcaagtttcttgcagcaggatgtctccgcgaaagtgggcttttaaccatttccttttaaggaactctgtgtgttaatgataattgtggtatcttgacagtaattgctgggacaactggaaacctaaaggcaaatactggtagtcacagaactgtttgagtgcctgaaagagaaaagaatctctttgaactacctgatccaactctcccgacatcatccatgccccagcctctagaatgactgactcttcctaaaacacatcctttgcttcagttcctctgggcctttgcatacacagttccttcccctgggagaatctttctgcagatgctatctcttccacgcaagcagtttggagttctcttctgctgatcatcacacccattaatgactcttccttgtagtccctttgctgtttgctatttggatagacaagagtgactgccttcactgcattcaggcacaactatttatgattaggaatcaaaccgtgcacctgcacacaagctccctgaaggcaagtagatagtctttgcacctggtaaataaaattaagtgcttctggtgtgaactgagtcttcaggaaaggctattaattcttactgccaaattcagctagctttcatggaacctagaagcagctgccggggaagttgtgactttggcttctctttccctcattttccctagagcagtagttttcaatctcagcttccctttggaatcacctggagagcttaagaaataccaatgcctgggtcttacccctcaaaattctgaggtacagtggaatggttccttgtcgtgacctagacataggatttgtattgtctcccggcatattctaatgtacagccagggctgcgatcttctgagctggtgaacgtgaagtttggctgtcccttcatgggctttatagttttatctgcaggcctcactttttatgggcagttgacctcacctcacttcattttgtgtgatcttggccagacaggctagcacctgcaaagactgaggtatgaaaagggaatgctattcatttttctttcctttcttcttttttttttttttttttttaaaaaaaaagcatttgacttttgaatatcccttgagctggatgtatgaattaactaaaattattatggttgtcttctatttactgtatatattctgaaattctagtgctcaaattgtttcttctgttaacttttgacagtattagaagatttagaatttgataaggatttcctgccttgactattctgtatcttagatgtttctattttgaggagctaaaatggtataatgatagatctggaagttataaaaccttttgctgttcaaattgaccgtaccaaattgaccatcatctccttgttctttctgagagttagatgcataatcaggcataatctcataatgttaccaatttatttcatgtgattgggtccaagagttacagagtaactgaaatatcccaggtggaaatataaggcaactggatttgcctgcccagagaatgaggagcctcattcacttgttggaaatgcagttttatctgagctttactccagtaccgtccatgatgactgcaagccagaatataacttgactcttttcatgtcgttggcagaatttgttaccaaattcctctgcctttagttgtataaatcatcccctttagttacttccctgttttatggctaatgctctgagttatttacccatttgaggacataatgctctagttgaagcttaaataaatcttgagtccctaggagatgcctggtgtcctataatgattcaatcttttagagttgcttagactgggacttgcatcttatctcttgttctaatgatttcatctccgtgaactgtggtttcccttcttccataaaatggagataacataatataacctaacagggttgttctttctgcaccttaaatgaaaaaaaaaaaaagaaaaaagaaaaacaagtctaagtacctagggccgcatctgattcataaggaacccttccatagtacatcgtaggtattttttagttctgtttttctaaactcaatttccagttacatttttccaattatttcccccagtaaaaggaactttgggctataaatatgaattatgctatataatgcttggtttcaaactgttctgagcatttccaaagatgttttggataataaagcatgcatgtgttttcatataccattgccttgcagatcaaggatgactattccattcacacaaatcacataggaaccaactcataaaaaggaaatggactccacctttttctccataggaagttccctataatagtgagatcacagcctcatttttatggtcaaactcaggacgatatttggattccccagggaagttaactttgctttcatgaagctgctgaaatataatccaagagtcaccatcagtgataaaatcatgggcttagaattgaaaagctggagttaacactccaggtatttaacagccagttaaataccaacattcttattgacaaatttagcactgaatcagagaacagccctaagcttataaagattataagattctttgggacagataaaggcaatgaactgtttttttgtttttttgttttttttttttaaaaaaaaaaaagattgtgccatttattcagtaggtgtccactcagtactacctgagattgtcattggtgatattcatttagttctttcaaagttccatgggtatttccagagtttctgcctcatcgtatacaatggctcttctggacctggcagatttgggccaggatgcctggaggaggacagcattgggcaaatgcagagaagtaccccttcacctgcacctggcctttataattttaacccctcagtggtgcgtactgtgtgagcagtggagagtccttaggctttcagcagacgttcaaggtctgcttggcattttgaaggacaagtgaatgttgcagttgtgagcctgatgcagacatttcagggagttcctagagctgccagtgtctgtttgattgaaaggatagaagttgaaatattatcagaaggccacttggaggtctgaggaaatcagagtggaaacatttcttgagggcataatatctcaaaaatgttactaatatttaaagctgggaaatttgcctttttaaaaatttttccatgataaaaatttgtagagagagaataaaatctcttttagctgcagcctcttcttcattactatctatgcattatcgctgctattcgcccaagtctctcctatctcctgccccctccccgctctcccctttagagtactgaagtattatggatgctcatttggtgttaggatgtaattatccaaggtgaagaaatttagcagaagctgtgtgctgcctatttaacatctgaaacagcttcttaatacctgccatattaatggcagcctttttccccccactatccttgtatagaagcttccttgatctttccaggaagctaaatgctctccatcctgatcattaactaataattatccaagaaggtttcagtcttgattttttgaactgactaaagaattacggctgcctgctaagtttctaagagcgatggaagaagctgggcgaggggaatgggaagtgaagtatgaagttagtaggggtcttctgagttcaaaaggcttcttgctccttttctagacagttttcctctcccgggagcctatgggaacagtaagaactcagattatgattaggatacaaagacagtccttgtggtagatatttgtttccatttctcagcatttgtccttgttttttttttctgttttcacattattgcaccaaattttcttttgggggccacccttctccaccctcagtccaagtggttcttatgagtttctatctctagccacaaagatgtagtttgtgacccaaaactggccatagtaacagatccaggaacacgcctatgacagaaatctggtcaacaggttgattctacacttctagctacagagattgtttcagagatgggcacattgattcccctagagtgatgttttgggtaactactggaaaaagacacgactattgtttctgctgtaattgaacccaggagaacgaaggtttgtagttgttttcagccactctactcccgtttgaacccaagagtgatgtcaacatggataaaacaagaccccagaaacttttcataagaaggaggtgcaggtaacacatcccttttcagtgtttctattatttcctgtttacttcctgtttctgccaggaccaattggcaacatccttcaccctggcagtggcagttggttccagattccaccctccaacccctgtagcacctgagaaccaggcttgagtttctcctcaaaaatattagcaccagcaggcagcacggtttccacagaggtcttggtcccagctccttggggacctctttcaagttctagagcctccaatgccaactgaacagtgctccttcctcagtggtctgggtttctactgtgtggggacactcctctaggttgcaatgatcaaaacttcttccctttgatccaccagcccttagaatggtagctgcttcctgctttgactgcctgttagctcaaggctccccttatgccttttcagcccttcaaaacctatgtaaacaattccttctattacattttcttttaaaataactgtggtggtttctgtttgcctttcttgacctgactgacacagccctgaaaagaaggaactaccaattctatcaaattcccatggcctcatagacatttgtgtatgattggtgatcttttctatgaaatcaactgttttcagaatgagctctgcacaccctagagaaaacctaagtgtgatggagaagtgagggtagatgtggagaagatgaatgagtccacttttcttcattataaatagcttccctttaattatctctctctctccatatatatatatatatatatatatatatatttttttttaatagatggggtcttgctgtgttgccctggctggattgcagtgagctatgagcatgaccatagttcactgcaatcttgaactcttgggctcaagtgagtctcctgcctcagccagcagagttgctgggactataggcacatgccaccatgcctggctctgtattgtatgttttggtaagatttcatgttaaaagtattccaaggatgttctctttggatatttatttattttaaaaaagtattcatttactttacgagaatgtgttaaagtaacattgtctagctatttgattgaagttgtctctttctactcctgccagaaataaattctccctacggtatgtgtcaataaactatgtttatcttagtcttaacacgttctgtttaatattagggttatatgttacatttttcttccctacttgactgtcctctccaggaaggcaagaaactggtctgtatcattaataagcacttaacaaggacataaaagtccttagaatgagtctttacatacaagctggagtacagtggacaagttagttaactctcttttagcctattggtttattttaatacaaggataataatacctactttatacaaattgtatgatcatttgaaacttaaatgaaatattaattattcttattattagttgttctgcaaaacttctcattgtcgacattccagcacttccactcacttggtcctcagaaaatatctattgaataaaatgaactcttgcagttactttgccacatgacaagccacccagaaacttggtggcttaaaatagcaaactgaggattcttcccgaattgctatacattttgtttatgcattcaaggtgtaaatggagccttttctatgtaaaaacaaccaagctgtagacttctttgtgtaaatttactgtgtaaaaataagattttttttttctttactattaggtcaactagcctcatttacatcttttattaaacatactcacaactggtggtatttttttcctttatgaacaaagcgaaattatagattccacccaaatcatgttggaatcctgctaggtgaaaattatatgtctgtaagagctacgtggaatctagtttccagatggaattcccttcttgccaattttgggaatattctacaaagtttccccttagaaaccatttacatgaagtgaaaaatttactctaggaaaatgattggagagaatgcttgtgaaatgtgaaggcatgacttgcatatggacagtatacacattcatagatattttacccgtgccgttgagatagctagtaataatgtgtgttctcattgtgtttgctcttgtctgtagagaccaccagaaactgatttagcctgaggaatatatttcaaactgaaatttttattgtaaagtaattgcaaataacgtgtaattaaaagtgatgagaaccccttacatttgtatagcatgtttactttccaaagcacgtcatgacctcttgcttttataattctaaaaaattcttgaaagataggaaaggcaagttctattaatattatatttggacaaagaggcaaatagatattacagctgagtattcttaaatatgcaagtgatattttgttttgttgacaccttggtttgttgatttgaaagcccagtgcttttgatttagcttcaggtttggtaaaaaaggagaacagtatttactgaatgaataaacttcccctttgtaacatatttgtgtcacaactctgcaattatacaaagagactgatgtctgccttgtgggaactataattgccacttggacaagtttcatgtggttgacattaatagaccatgctgattatgactgacaaccaggggttcttaaacttatccagtaaaagggttttttcccctaatatcaaattcacaagccactattctatagtaataaaaaggcaactatgaatttggtaacgtttaaaaagttatttgcattttattaactacaactaatgtatacatttgtaaagtagtaacagatgtatgcatgaaacatgctattcatgataaaagctagtcttcatacacataggaattctcaaaactcttgaactaacccagtgttcccctgggagatcatggttaatgagttgggaagctttggcataactagagatagccattacactacattccatgtgtcaatgccaacaggaggaatgaccgcctgaagaggtgtgttgaaaaggattctgagagctagtttgggttcagagcaaagagtactgtcattaattagtgatgtttgccagaggaggaggaagtaatgggtgggaagagccaaacatttgccttacctgacttagactatgtggaccacttgactccagcaaaggataatggagatgaccactaatatctagatataacaaaggattaatctaagaagtcagttaaaatatacttttaggccaggtgtggtggctcacacctgtaatcccagcactttgggaggccaaggtgggtggatcacttgaggtcgggagttcaagaccagcctggccaacatggtgaaaccccgtctctactaaaaatgcaaaactagctgggtgtggtggtgcaggcctgtactcccagctacttgagaagctgaggcaggagaatcatgtgaacccgggaggcagaggttgcagtgagccaagattgtgccactgcactccagcctgggcaacagagcaagactccatctcaaaaaacaaacaaacaaaaaactttaaaaactactgtaaaatataaagcttattttaaaataagcacatttaaaaacaggttacatttactgaatattttattccaaacttcccctgctattaagcaccttgttcttgatcctacagcttgaggaaaacctctgtttttctctcaagacaaattgatgattgaagtatcctagtcccttctatgattttagccattcgatgaaggatctttgcacccatcagttgatactcactcatgttgcagccatctcacatagcttgtagtttttgtttgtttgtttttttccagaaacaaggtctcaccctgtcacccgagctggaatgtagtggcacaatcacgactcactgcaaccttgagctcctaagctcaagcaatccgcatgcgccaccatgcctggctaatttttaaattttttggtagagatggggttctccctgtgttgcccaggctagtcttgagctcctgggttcaaatgatcctcctgcttcagcctcccaacgtgttgggattacaggcatgagccaccatgcctgacccatctaactggctgttcttttcacgaaagacaagtcattccctgacaccatttactcagaaatgggagggagtggagatatggagaaaagtatctggtagatgactttgctctatctgtgcaatatcactgtttatagacatgcatttccctaataatttaagtcacttgccctatgaactagccaacctgcttcctcactggtttttgaaatatctttagagaaaaaatattccagtgatatgtttaatttatatgttaaccattcttggaatctcccagtcccttctaaaactcttttgccttagctttatcccactctgactgtattgaagataattaaacataatcacatcatctgacccttatgtacctgttcagatggtaattgtctttcagaactccatcttaagatagcaccttcttagccgtccctggaaattaattgctctgcctctagatcggctttgtttctatcttaattattgctctgcctgaaaagtctattttttgcttgggctttttgaggtgaggatacatgtcttagtcatccttgtatctccaatgcctcgaactgtgaatagctcctggtaaatgggcataaacactgggtaggactgacactcctctgaggcacttacctcccgtggagggagacctgatttgatttttttactctctttctaccctcagcatattccccagtaaaagctagcttgtacctttttctttacttgatatactctctccctatttttttggagattatatcactttttcaatactctatataggtagagtcataaataaagataactaaggtgaatgagatttgccacatttatatgtaggaatttctaaacaccttagaatgaagtgcctttataagaagaatgaggcctactttcatgggatatttaaagtataaatgctatttttttattttgtttttaaaaagatgtatctaccatgatacgtcataactttagaatagtttttgacttttaacatgaaaatgaaaaccagcatttagccactcaagccatgttcctgaaggggagccaggcaaggtggagagtgatgatggggtacagctctgtctgtgttaagagctttcaggtgtcctggcttcagcaaggttctggcccaggccgtgagacaaatgcttggcaatctcgggatggagtttgcagagcaggcagaattttctcctcataactttagaacagatgaatacacatttcctagattccttgaggggagcgccagctcagggctatccatagtccacaatcgggcagggtgttgggcttcaattcttctctaagcgtgtgaggcatgagaaaacggggcaaccctgcaggtcgggaggaaggggtagacatgtggctggggctccacaagagtgacggtcatttcatcaacatccaaagaccttgcatgaagatctaacctccatcactgtacccacaagtgctcccatgtgcccaccttacctttggtggcatctcttctttcgtaccctgtggaggaaggtgacttccatggccacacctcttataccatccatatttactgagcccatgcttaatgtatcagacagggtcctcagctccgtggacacagtgataagcaagtaacacatggctccagctgccatagagtttttaccctagtgaagggaaagtaaacaagtaagtgacatattttgttaaattctgtgtactgtaaaggaaatgaaacagagttatgtaatagagaaggacattatggagtgagggtggtggcagggggttactttaagtttgatcccagactttcttgatcagaaaaagtcgtggctgggcattctgcacaagtctttgcatctgtgtgcttattctttcattcatttgttcattcattcattctttcattcattccataaccataaatgctttgatctatttagctcattgcctggcattgttaacatatacagattaggcaggcttccaaattattttagccctgaggatatattaattcattcaattaaagtaattattcaagtactgtgttgacaatcccacctgcatacagccattggtatggggcaaaggctggtaaaagaacacaagatggtgtgattcatttagggtctgacaaagtgaacggtggcatttttatgaactggatcagaatctaacaaaatgcccggaattgttaagctcctcacactgtgatttggcctatgggcatgtcactggaaccagtggtctcatcattctttgctattccttccctctatttttctatatcataacaattccagtctgatttctctctaacatacttcctgtgaaaacctttaaaacaagggcttggagagatactaagaagaaaagagactgtattataattacaaagtgaattttatttatttaaactgattatgtgacagttgctactctgtaagcagccctccaaaattatttttgtcctctgaaagaaggtatttcatggctagagaagctcctaaagactctttaaggtttccctagagcctataaaaattgaaattttttgttttactcctgaggaggaacattccttagaggcccagcaagtctttatagatgcaatcataatttgcagctatttattgcaaatgcactgggtgctgaagttgggcattgcagcagatactgttgctgtcctgcccatggtcctcctgtctatgctcaccatgtccatacaacctgacatccactcaggagaaagtgtgttgctctatgaaggcattctctggctgctggaacctgctctgctgaagatcaggcaagtccagaatgccaaggaattgacatccactacatcccagctgtcctagatccacgagtgatgggattggtggataagtacccatctcctttgctcctcagacaagccaactccgaagtgtatgttctataccatttcccaaagtttcccagtgggctgtagccctagctgtccacagtggcaactgctttgtccttcaaatatatttgtttgcattatcctccaaataaattacttgtgctgaaatctctgcctgaaggtcagcttgtggaagagccaaactaagacaggtacattgcatacattatctcagttaatctttcctacctctccaaggcgaaacattgcactccccgttttacagatgagaaaactgggattcaggaggttatttttttctctctctctcattccaaatattctctgtctctcctctctctcttattccaaatctccttttctttatattttattgtgaagaaagtggccacagtatatggtctcttaggaaggtgcagccatgtggttaatgaattttgcagcagaagaataaatcaaatatttattgattcaaattggtgtaggcatggtaaaaaaatgtgaaaagtagaactttgtttattcattccacaaatgtttattttctgctaccaagtgccaggtactctgtttcttcctgagtgtatagtggcaagggagaggaggccctctgagaacagcagactgcattctaatttgtatgaagttcttactgaaatgaaagtttctgtgatgttaagattgtatgctactattcagtaaatgtctagaaagggcaatctgatttccgagcttctaccatgatgccagttaggtggctatatgtcagaaagcagagtccaggttctctctttttactttctggatagacctttactctttagatggcaaattttatgttttcctcccactagactataaatgtcttttgtagataatgaatatgtctgccgctgcattgaatttgaataaggactaatggccagtatcagaacataattaaatgcaggatccacatcaactaacaaaattagatgcaggacccctttcaaaagtacttgtgctgaggaagtactgaacatgtcaagaggatacttcctccatacttctattcaattaaaaaaaaaaagaaagagaaagaagctattgatttcagttagtgggaagaaattgggtttagccttgatggtgtcttaactacaaacgaaaccaatatcctggtgttgttcctgttccattcctcatgctctgatgatttcacagttgactagtgatttgcaccttgcttcaaattacttaggatgtattatggcattatctatgaaaacagtttgactcaagaaaaaaaacagcttgtagacaaagagagaagctcagtggctgtgcagtcacagagcagagagggcttaaaaggtttgtctggacatggaagcaccatctttgtgtcaataaggtgagtttgttccacacactttgccttttgtgtgcttcttttattttttctattatccgtcttctgctgttcttgcatcctttctcctcagatagatcttctgtatcaaaaggccatgctctaagccatcttcctttctcttcctcctccctgtcagcaatctcaatctccatgcaaagtatcactctgtcatgcaataagacattgtccccaccttgggaacatttttgctctcttagaagtattagaagatggaaaaatattcaagacccaaaggatgaacccataataatggaatttctgttcactttgcaagacctccaagaatggaaggggggatatttttgaaacacatttctatatagttcctatcattttcactgagatcactagaatatagaagatatttaggagctcatgtagtgaacactaaagccaattgctgacaaccactgattgacagctatgcattcaacactgacatacgttctgtgaggaattaagaaattaaaaagaagaaaaagtaatacatggtcctgatcctataagagattactgctggctaggaaatgtatataatatgcacaaaaacgattgatgttaaaatctgttgattggcatagtcagagatgagcaaaagaaaggaggtgggaaatggggatgatctgaaatgaaaggtagaattcatttgcaggaagaaaagaaggtagcacaggtgagggcatggaaactggaacaaacagggtacacatggaatactgggatgtggctgaactgaaagtccatgttggggagttgtgaaatacaagtgggtagtgagatcaatgtcaagctacggagggcctgggatccacaaagatgatggagcttatgggaagcagggccccagtgtgtccttaggcagggtcatgcctggcagttgggtacaaaaggggctggaagcagaggagggggagagaaatccaagtaaggagaccgactgagcaagaatccagtccacaagaaaggggccttgggcctgggcgatgccagtgggaatgtaaggagccatccaaagagcatgtccagaagacaacaggatacattcaagatggagaacgcatcagaagggattaagggggtttatgcaaatggccccagacacctcatcccaatattactcctagcagtaatgtaccaagcaccgactccataccaggccctattctaaaggttttctttttttaacttattttaccctcataatgatatgaggtctctttatttccactttctagaggcacaggtaagttaagcaatttgctctaggcctcaccaaaaaattagttgaaaacaacttagttgtcaacttgacaattctatagtttgcccatatttctcagaagtaagtctatttatctttctgtaccatttttattttattttattttatttttttgagacagagtcttgctctgtcacccagattggcgtataatggtgcaatctcagctcactgcaacctccgcctgccgggttcaagcaattctcctgcctcagtctcccaagtagctgagattacaggcatgtgccaccacacccagctaattttttgtatttttagtagagacggggtttcaccatgttagctaggatggtctcgatctcctgaccccatgatctgcctgcctatgcctcctaaagtgctgggattataggcatgagccactgcgcccagccctttctgtacaattttgaataaacttcccttcttctcagcctcttggatgtttgtttcaccttgtcactgtaaaactgaagcctggctttcccctgaggtaccatctcctcctaaccttcaacaggggttggagggggaaactactcctttgtatgtcatctccctgccacctgcggagtacggaggaagagccagggcatcccttgcacttccgggccactttcttgtcctgcagagataccaccaatcccatcttggcttgtgtccacaaccctcatgggctctccctttccaccctcactgcctccatctgtggtggtccagggctgtttctcagtggcaggacactggccaccttcttgcctattcttctctgccattgtttctggggatattacatcctgatgtagcagttcctgtattcttctgcctctatttcagccgccatcccagaccttgccttacctacagcttctgcatcactgtgattctgaacatagaactcctctctgccacctttgatctcttgtcctccctcacttccttctttgccttctctcagtccttggctttgctgatgctctgttccctggcatgcttcctggtctcccaactcatctctattcttgggcttataaaaagttttttccgcctccttcatccatcttggatcctatggttgattatatcaacaatggtcttgtatgtgcccctttctcctctttgttttttgtcctttcccttctttattagtcacttagttctcatccttggggaaatactgctactcatattttccaattctcttccaaaactatcaacatagggatgacaggccagctgtattttcccatcacacatgctctccttccacacttgaacttctgttgcttctcagctgggcccttaccacttatcagtactcctagggatcatctctaatcacttgcctactacatccttccctgcattcaatcccagtgttccctgctccactcaaggaatggcagttcaggaaagagtactcattataccacccattgtgcgaagcatttgatatgattgcatatattcaaacctcaacctggtgtaggtagtgttattctcatttttttcatatgataactctgggactgagacagtaacttacacagaactcaaaaaaaactttatgtttcatgtctgtttgattcccacacctgtgggttttcaggtcgtaataaagcctccactgctgacctgaccttctgccaagtttactctgtagattacttagtttctttcttaaatgagataaatgaacctgtaacatgggactttccagttccttcttcttttccaccacattttttttgtatcttcatccatttccttctccttcttttctgtctaaaagaaggaattatcccctaatcttccttacagtcagctcctctgcctttgttatggattccaactcttctacctctttctccagattgatgatctgtcagttatcctcctctttctgatcacttttcattcccccttccaaactaaatatttttctttcacagcaaacaaatctgtcctcttacttaaaaacaaacaagcaaaaaactacttttcttgactttaagatcctgaacaagcttatcttctacctttcctaaaactccttgaataaagagactacatttactgtttttaccatctccccgcaatgatcccaaatcattttcaatgtggcatcttcctctttcctgatcccaaaccatttccttaaagtatataccaacaaccacataggaacagagccaacttctgtattctgggtgctcatttttcttaagttttctgtagctttgagtgcttcaacactatctcttcttttttgaaaaaggctttctcttgacttttctatgttttcttggttcttttttcacctattggcccacatctttcccaggtgctctttcctagctaatcttcttcctttatttccattttgtctctctttactctttcctttaagtaatgtgtcttacttaactgcaggcttagaagactatacccttctctaactttgacttttcaagtgaattcagtttggacatctccttcatttgtttcactggcctcagatttactttgtctaatactaaatctatcatcttatttttctttcccttcctgttttttttctattaataacaccattattcaagccttaaatcccgttgctcataactatttctttcaccttgttcccacatgtaatttgttgtcaattattttccagccttttttctctccacatctgttgaatatttcccaccttttcccctcttgctatcatccaagtttattctatttcctatcatttcagtacttgttttattaactagtttcttaccttatgttccaatgttctttcccataactaaacttggtgcagtaaaatccatgccttatgcttttcgggccctgtacctatgctcacagtacctctacagaatcttgttttctatttcttatttaaatcccattattctagggagtttgccataaatacatttcttccaggaaatttttctggtcttctgttctctgctttttatccctaatctggtaagaatctttcttgcccctaaactcctaaaacatctttttctcatacttctagtttattgtcttaatcctaatagaaaacaatagcaagaatgaacttttgagcccctccacccaaattgactcatctttatcacttactagctgtgtggccttaaactagttatttcacatctctgagcttcatattactcatccaagtaactaaaataataaggcctggccttcaggtatattgggaagattagaaacaatatatggcatggtccttaacagtgtgtttggcccagaaccaccattcaatagatgttgagtgaaacactttctctaggtagagtatggggtgctgaagagtatgtacagactagggtatagagtaggcattcaaaaatatttgcacagtgaaagggctgggattataagaggcaaacatctaccatcaatcctctgtcagttttaaaatctgtccaccagatatcagagaagaataaaattagactgggtgaatgtctgacccatttatcatctatcagggagtaacttttgcctgaagacatccccccaggacaatagaaaccagcattctaacattgaatttcaactgtttgtagtgaggacagccatccctggtcccattttctgagctgagtattaaatttactgtttcctaagcttgaaggaattctacacttgcatgcattttaaaaaataatagctattggttgtgctacagtgactttgccaattcccttagtttccaactctgctaatatccatcctgctcttaacagcttcctgacttgtttcctttctctagtcccagtttgcttttctcttcacaagtgatatccacgtgggtttactaatcagatttgcatgtttttcaatagcacactcctcaaagtgtccgttttctatcagctaaaagaagcaaaattaagatcttttgttttccaacatagaagtgtgtctgcatgttccagagtgtggttttggagttcagactgcctagatttgaatcctggctcaagcccctgttagctctgtgagtctaggcaaactcatgccattgcggacctcagtttgtttctccataaaataggaacgagaattaattatgtctaatctgaaatagtatcattgggagaacctaaatgaaataaggcaattgaaaactcttaagatagtgcatatctcattgtaagagctcgatatacattagctgttaataacaacattttatcataaatcatttataactagcaacttcatggttgatttatgctttagctttccaaattgtatttctatttattcattctacgtttgtggatgtttatttttttgttggtttgtttttattatcccttaggatgaaatttcacttaatgagcgaggcttcatgttgtcccaactacccaccttgcacagcgttgacatctgagcggggatagtgtgagcaaaagataatggactagaaagcatctcacactctacagtggagatcttctctcaacctctaatttggtggttctcatctttctttgctttttcctgcttcagaatgcctaatgtactcccatcaatatcagtagctggctgattttcatgaagtacagattaaaaatgagcaatcggaaaactgactcagttccagggtgcctgccagcatacacagtaacttcatacaaatcagagaaaaaccaccctttgggaacagaggcaaccccataggtgcgtggcttgacagtttaattgcttttgtgcaagagaaagtagttcgttcttaggggtcagagtggggaggttgtcacccttgaacttgaacacagaccttggcagctgaccctggctggatgtcagccctatccactccttgacttagcacaacctgcatggaggccttgtcctgtaggcatatgtctccccacagcaggtaggaatcaccgttgtactcggaggcaggatcgcttccccctcgcccctacggtcagctctctgtacctgggggatccgcatctgcagattcaacagttgctgattgaaaatattcagaaaaaaaaaataaataacaatacagcaattaaaaaatagtgcaaataaagaatatagtatagcaactattaacatcacatttacattttattaggtattataagtaatctagggcctattttaaatgtttaagaggatgtgcataggttgtatgcaaatactattccattttttatcagagacttgagcatctgtggtttcagtgtctgtgggaggtcctggaaccaattcccttaggataccaaggtaggactgtatagtaacatctgctctgcacctcaccatcccaccactacaaggtacctctttgttgcttttcctggatgatgaatctgcaagaaagtttgaaagccatgctgatgaaagtttttctgctggcattaaagatgtggcaagctttctgttaggtaggaatgaaaggtggggacaaattcttttccttggcaactgcatgagagtatccaggaaaatcacattcagatgggagatcatttaatgcagcctatggagggtgaaaacagaactacatttgtcagcatttacagccatcattgtgttccctcagcaaacctccccatgctgcagcagccacaccccgcagtcatccatcatgctggctgaagagccctggccgcctgccacacacgtgccaaggggaagccccatgccccgttagtgtcagcatgtgctgtgacttgtaacaaagacaggaatgagtcctcgtccagatagccatgtaatcctcagagaagagtgcactgtggctgctgcaggcttgcccagaaagtctcctaccatctgaagggtaattctgatggcagaaaacattcaatcccactattcttagcctgactttctacttctagctttttcaggctcatcaaaccctctaaaatcatttgaggagaagaaaatgttcttcgttgcgttctataagggaaatatattgcaaaaaaaggaaccataggcgaacaaagaaagggaggagatggggccacccctattcttccattaaatttatgtcactcagccttgagagtcaagcaaaatgtttgaggccaaatacatcttttattaagttgtaatacaaagataagttatctagatttttgactgatttggcacttcacaatgttatactttttcgaatcccaaattctagcaactataagatgccactgtaattttgtatacctttagaatacattaaatatgatacaatgccttattaccccttaaaatttgtattttatatttatcaaaagagcacttttagattcactttagacacaggcttttgtgacatatcactctttcgcacacagaaaaggaaaatgaaagtgaaataaggagaatgaggtattccttagccttcataaagttggaatcttctgaatcactgtgctgctcaaagtcactgatagtcaagttttcttttggcataggatttgcctctgtgacatcagaaagtattgatgatgtggcctctcctgaaaacaaaacaaaacaaacatacaggcttggttttccaattttaaaactatattgttgttttgcccccccccggtaagtctgtcaactgagcacagtgtagtttttacatccttactttggtgtttccctgagctggtagagttgtatttgagacaaaataactattcattcaattggattgctgcattctacttcagtaacagagaagaaaaaccagcaagatatccctgtaaagcattgctatggttttggaatcctgcagataaaatggaatgtcttcaggtgtttgaaaatctgggtcatatgtctctacttgggaacttgaaaaatgtttgataaatgtgtttgatttcaagatgatggtgtttcttttggtttgtcagaaactggctctgatacatatttgtaagaaagaggaaaaatctcgaattactcattagactatcaacaatatgcccattctttgaagtctgactgaaatcctttcttctctatggcatcttctagatttccgcttggactgatctccactgtatctgaatttctatagtgtttttgctccccttttccattccttttctctatttttagtttttttttttttttttttgagacagggcctcactctgtcacccgtgccggactacagtggcgtaatcacagcaaactgcagccttgaatttctgggctcaagtgatcctcctgcctcagcctcccaagtagctgggactacaggcacgcaccaccatagcaggcaaacttcttttgtatacataggacatcactatattgcccaggttggccttgaactcctggcctcaagtgatccttctacacatattttacagctgtgaacctccatgcccagcctggtgtattattttttaaatcagacttttaaatcagatttttaatgaggttttttttcatcagattctgtctttggatacctgttatattatttttaaaatttgacgggtatgtgcgagttttaaaatttgagacaaaaagttggataaaagacatctgagaggcaatccctctcagttggacagggagaaaggagggagagaggaggggagtaaacccaatgaagggtacattaacaaatgggttattgctgtggcaacaagggttcatttttgttggagactgtggtagcctgaactatggcctcaaaaagaggtccgcgtcctagttcacagaacctatgaatatgtttccttgcatggcaaaagagactttacagatattgatgaagttcaggatattgggatgggaggattctggatgatccacatgggcccaatgtgatcgcaatggtccttatatgaggaaggcaggagggtcagagtcagagaagacaatgcaccgtaacagcagaagcagagggagggaaggagatgtgatagtggaatcagatgttgcagtgacgtgaggaaaaagccatgagccaaggaatgcatgtggcctctgaaagctggagaacacaagggcatggatttgctccagtgcctccagcaggaatgcaatcctgcccaagccatgatttttgctcagtaaaattcatttcagaatattggcctgcagaactgtaaggtaatgcatttgtgttgttctaagtcactgagtttataggggggttgttacagcagcagtaggaaaccaatagaagggttcatttttctgagaaaccatatggaccaggcttcatagctgtgccagtgaggttcgaggaggctgaggtatttgcccatcaattctcatcacttactggataaggattattcccagaggtggcagctttctatcggttctggcttgttcaagctgtgcaccctcctgtcccctctaggggccagagaaagtctttagaaagacaggtctatataaaataagatgccataggcttgtctacaacttgtctactgatgatgcatgtgacatgtgggatggatcaagggaagatgggtgcactggaattacctgccaccatgtgtaagtacgtgtatgcatggttgcgtgcatgactgtgtgtgtgtgtctgtgtgtgtgtgtgtgtgtgtttcttcctccccctttattaagtttttttgagcctagacgttctctcccattgaccagagccccaagcacagcacccaaatctgggaaaaacacttcttgaatgattgggtggcagaatgtgacagcctgtgaatgtcacagtaaataagggagttggctattttacagtgatgtcttctctaattcttaaattaagactgtgcagagaaggaagaattgctattccttggaaagattcaagagactctggagatgctatgtagtttggttgcaaggtggctgtcaatcacaaatgcaagttgtcaccaggcaaaatggccctgtcctgctgcgtgaccaatctgcaatctaagactggctcatcaaggttagcagataaatcaacacaaaaagagatgaacattgcaggcagtgctgatgtcaaacagagatttcatgcatctggcagaaaattgagcatattggtaaagcactaaagacttccttcatgaaagttctttgctccctggtcctgaaaggaaaattagattaatgctcacaaatccttcttgacatctgaaggatggccttctcttgacaaggctctagacaggaaaatgtgaggaacaccagcatggccttccctttgctaggtatctaatctaacctagctttctggaggcacttgttaagtactagattctcgctctctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgtttttagccaggatggtctcgatctcctgacctcgtgatccgcccgcctcggcctcccaaagtgctgggattacaggcgtgagccaccgcgcccggcctagattctctctcttaacccttggcattattattatttttagcagttagcttcagcaagtgaagcactgctgattggagatgtgttttgtattctgactgtacttgcaagctctaccaagtacattagccttcaaaacatatttacgataaaggctgagtgcctgttccttaagagaaacctgcagaatggtctttatttttcacaccagctgcttcttcagatttgaacatgccagacaaatgtttgatgctcttgaatggtgtttgagtaaattaattgacacccaccgactgtcaaaatgtatgtattatgtatgtaaatataaaaacacctatatgcatgaatatgcagagatatgttttaagggtcattttgtggctaaaatatttgaaaataataatataagtaaagtatgatatgaaaattaatcttgtagaaaagtcagcagaacctaatggagattttagtgtagagaagaatgtgattaagccacagtagatccagaattttgctaatgatataaagtccttattgttaccagcctcaaggaaatccctgtctagtgcatattcatggagagtgaacgatgagcttgtgaaacatgtgagatgcaagtacagaaatgttggcccaactctattaaaaaccaatgtgtctcataattaagactctaaacacccccccttaaaactggccaaatgttggaatgagctggtgcccgccgcttcttaactcttcgctccagttttggggtctgtgcctcataaccatagtcacttttaaccaattctggttgcctccctgacagaacctgggattctgtgccatttctatgtgtgcccctattttaggaactaggtctaaagtaattaacagtttagaagtgataatctagtgaattagcttttgtgagggttgttttataatagcacaattcccttgttcactgcctactcctcctctgccccccttctccactgccttctcttccctgtcctgccctgtggatggctgcctgagttcttgctggctagcctctggttgggtttgtgtcataggggtgggaaggagtcaggttaccaggaggatgggacattgggagaaagtgattcgtgtatttcttacttgtctccaactccccatttcccaatccttcatttccccatgccactcccttttttccccacctggctatccttcccacccctgcgttgataccatctttttggaatgacgttgtccctccatgactgtggttagctgggaagcctgtacttcccagctcctgctctctcttgttgggctatggttacattattcccccacacttccacctctgagtgtctccatgtatcttgcctgtattttaaccatgcctgtgtcttcgtaagtggtccctttatcaaatttctgcatttaaaacatctatggaaatcctatttcctacctagaccctgatggttacactttactttctctaaccatagcattcttcaaacatgaaggaccacacgtatttaatatttaatcataccatgcttaagttgatacattggaatgccatagttctcatttcgctagcatgctattcaaaactttatttgtgagagaaacaaaaatagaagatgccatgtaagataacattatggtctgggtttatctgcacatgtcagtacatacctgcagagataggatctttgtctatggaagcaaaccaggaaggtatctgaatgccttggttcagtacccatcactctggaaatgactgaatgactgatgtgctttctaaacatgaggcagaggctggccaaatttcctttcaatctgggtgatgaaagctaagatgaggtaaatgttgtcacattgtgtttacattctactatatagtatatatggtatgtatatttctatgtatatgatatatatgtttacctacacatgtacacaatagagagagataatctcaaatatgaatggtactgcttaaacgcagtgttaactaaaagaactgcattacataaataaatattatggttataaaagaaaagaaaagccagagagcctactctcatgctttcgttgtatagctaaagtcatagaaaataaacattaaaaaaaaaaaactaatatttacaagacagcatacaaatgtctgtagtttaatttgggtataaacaagctacacaggtgctgaaggaattgcctgcagttaagagagaaggtgactatgcagaaataaattctaagacagggctggcttctgcccttatggaaaggtaaattagcccactgatacataatattagtggccaccaaaccattgtgacatcttgaatttcttctttttttttctttttctacggaagtctttacgggattgttagaacagcattggggggtttgtgaatcattatttattttggaggtatggagggaggtagcaaggaatgaattgtcatacccacacatgcctatccaggctcggatttcctcctttacttcaggccatacagatgattccactgtcctcttctctgttctcttgaaactgccactgcctgttccatcccaggctttctctcttaaacctggctgaagtaaaagccaagatttcgtttatttccttcttactcttaaagaacaaactcacagttactttaagttttcaaggttttttactaataagtatggtataataaagatttgacagataccacaccaaagaagatatacagatggcaagtaagcatgtgaaaaaatgcccgacatcatatgtcataaggtaaatacaaattaaaacaacagaaagatacccttacacacctattagaatggccaaaatccaaaacacggacaataccaattgtcgatgaggatgtgcagaaacagaaactctccttcattgctggtcttggcatagggattgtaaagcttaagaaaatacattgaagtccttgatctactgtctctaacccttcaaagggggtaaactcttttgtgcgaataccaaggtgtgagattgctgggtagtgtgataaaagtatattgagttttgtaagaaactgacaaactgtcttctaaagggctgtaacattttgtatccccaccggcaatgaatgagagtccctgttgttccacattcttaccagcattcggtattgtcagtgttttggatcttggccattctaatagatgtgtaatggtatctctttgttgttttaatttgcatttctcttatgacatatgatgttgagcatctttacatatgcctatttgccatctgtgtatcttctttggtggggtgtttgttgaagtcttttgccaatttttaattgggttgttcatttatttattagtgagttttaagagtttcttgtatatttaggataaaaatcctttatcaagtatgtcttttgcaaatattttcactctatctgtggcttgccttctcattctattgatgttgtctttcacagagcagatgttttttaattttaatgaaatttagcttatttttttcataaagcatgtatttggtgtcatatctaaaatgtcaccagtatatccaaagttgcctaggttttatcctgttatcccctaggagttttatagttccttgttttaaatttaggactattattaactttgaattattttttgtgaagtgtgtaaaatctgtgtcacgatccatttcttgcatgtgattgtccagttgttccagcccagtttgttgaaaagacttgcttcattgtagtgtctttgcttctttgttaaagattagttgactatatttacgagggtctatttatggactctgtattgttttccattgatctatttctccatccttttgccaataccacactgtcttgattactgaagctttatggtaagtcttgaagtcaggtaatatcagtcctctgactgttttccaatattgtgttggctattctggggcttttatctctccacataaactttagaatcagtttgtttatatccacaaaataacttgctggaatctgggttgggattgcattgaaaatatagattcttctttccaactgaaaagttgggaagaactgacatcttgacaatattgagtatttctatccatgcacatagactatctcttcatttatttagttctcctttgattttttttttatcagttttggagttgtcctcatatagatcttttacatattttgttagatttacacctaagtatttcattttcaggtagctaatatagacggtattttgtttttaatttcaaaatctactagtttattgttggtacataggagaatgtttgacttttgtatattaaccttctatcttgcaatcttgctataattgcttattttctccaggatttttgggtcaaacctggatttcctacatagacaatcatgtcatctatggataaagacaattttacttctttctttcccatcattatgccttttattttattttattttattttattttattttattttatttttcttgtcttgctgctttatctaggacctccattgtgatgctgttaagttcctggtctgataatttcaatattccttccatatctgattctgatgcttgatctgtctcttcaaacttttgcttttttcttttagtaagtcttgtaagtttttcttgacagccaaacataatgtactacgtagaagaaaaaaaagaacgacaataaataagcctttagtcatgtggtggttagatgtcaggggaggggaagtattatatagttatgtgattagatctcagtctcttggcaaccctgtacctctgaactgtgaacatctcaagtgtttcttaggtcctccacctcttttaggtggggcaagagggctagagtaaactggaattaggcatttcctttcttctatctggaaggctagagtgggctagagttgagtatttccctttccccaggttggttaggatctgatagaaccccaatagtttaggctcaggtgaaatattttctcttgaaggcaggccttattatgacacacagaatgctgtggcatgtttcaagatgtttcttcttttttcccttcccacttctggaagcatgaggggatttttctctaatattcattgtgagaacctggtccagctcctggaggtaaaaactcacaaaagcatgatagccctggatgaatggatccccttggagtttccatcattcagactggtccacatggagcctctagtaatccgtcagttagagtttaggcttttctactccagtactcgttcctgcggaggcttctgctaagggatttctgctcagataagttgtgattctctgtacccacctgtctgtctctccagttttggggacagcagtttgctctgtgacctcacttcttcgaaggatctaaagaaagttgttgctttcttttagttggtttagctgttcacgtgttggcacatgtgttaggacagagtgacatcttccaaactccttgcatgttgaaccgcctatatattgttattctcactatctaggatgtctaggaaagtaagaaaaagatcatgtgctggctctcattttgtcatcctcctgactcttcattttctttgagcctagggacaaaaatgaaggcctgttactttgtaagaagaaaaatgtcacatgttcataagtgaaatactgagcaaacatcgactcgatttttccctgaggaattgcttcaatctacacaaaagctccaccttcccaaagaggtccatcaaagtaaatctctaacatttgtgtttaaatggatagttatttctactatgagcacatcctgaacttcttttcctgccccagcaggttttcctggcacattacaactccaggctatcttgtatctgcttactacagctcaagcaggagaacagattgatttttgatgagaaatatgccttttctggggtttccttattctaccacaaacttggtccagagctcattgtttgtgaaatactgtcattcattattaagacgaacaatgatgcctgctgtgggaaatgtgcattttaaaatgcagttttcctcctttaaaattctgtggcttatttggtctcttcattctcctgtcattcgtcaaacacttgctataccccaagtgccttgctgtggttaagaggaatgagccaggttctgtctgtttgagggaaatggtacatgcatcacttccaattacatttctctaggcattttcaggagcagtaacttatgtatgggtaaaacttagaaatccaaaaccagccaaggggatgttttaggtagaatagtaaaagatcttgtatgcaattattgcatgaatcgcagtcgattactcaggtcattctaaattcattttagatgatttaaagaaacgtatccatattactaggatgtggtgaaatccactgtatagcaatttggggagtttaagaagtttcctttgggagttgatattatagacaatgacatgtattttataatttcttcagaggtttggctataaacaagacagttttgttgaaatctgttcatctactatcagttcctcttcctcaggaagagaatctgaaaaaaaaaggtaggtaatgtcaagttccaggggcagagaggggatagtgaatccatacttgatcttaaaaattgagcccacctatacttccagtcatcactctgtggcacattgaagagcatggagcccccacctggttttccaggcctactgtgcacaacagcattcctgtacctttaggctttcttatatctttcagctttctctccttactaagcaaataagatacatttagggaaggagggctaacaagaagacctgtaggggagcaaaatgcttgtgacttgtgcagtttagtcttcacaacaagagagagtagacttatcccctcttatatgttaccggtgaagacattgaggaatagagacctgttttgctcactcagattgtacttttcaggggaaggattcaatgcctggtaggtctgactctaaagccagggtttctcttgaaccagatctcagctctctttgaattcatcaaattggtatgaaggatttattatgcagagaatatttttaccttggacagatagtcagtaattgaagccagattccaaaggtggcaaagacctagataggaatgaaaaccatcttcaagtgttgtatatcctcagagggatttctgaaacattgtgtgttcaccagcagcattagttctcactcaatgtatcagtcatatttttccgcattacaaacaacctctaaaaccaagtagctgacagcaaatagcatgtattgtcttatttacaagactgcgggttggctgtggtttaactgatcaagactgggcttggcctaaccaagctggactcttggcttctgctgggcacaggtcttttccttctttttcatttcaggtacctgtctgaaagggcagtagttatctcggacattctctttccataccagcaaacactttaaaacttcacatctgctcacataccactgactaaagcaagtcagatggccaaagtcaacattgatggggcagggaaatatgttccacccagggtggcaggctctgcaaattcagatggcaaagataagcgaagaattgggaacacttatctaatccagcactctcagaaagtgatctaaaaaaggtgtcacaagagtctaatggtgttactgctcatgtcagacttgaagctatgtcctctgactcaacactggaattttaggaatgcctcacttgatatcttttggaatgtctttgaaaatgagttttaggatgatgtcctccagcagattttaattatatcatataatgtacttttaatcacaaaattgtatccaattatgtattatttttaatcataatcttagtccttcaaattcttttcatctctgtctcaatcagcaatagtgtggctgccattgtataccctatctaaaccatagaatagaagtcttgcccactggaccacccttttttaggcagattccacgtgctaccagcggatgaagtcagacagaactcagaatagagtgtcatggccaaggtctgtcttaagattcaaacatgaaaaggaaagattctccatgccaaatgttcacctcaggggagctgaacactgagaagttttacagaggaattcctagaattttgagggcagtttacaaactcaggccttcagggggcttgactatcactgaagagcaaaagccaatagtcaggggatttgagggctatctttctttcttctacactaagataataagggtgaatgctgctgagacggtgatgacgtgttcagcatgcctgcctctggagaatcatgcacctgtctgtgcctgtgagagcataaaagctccatgagacacaagtggtttacatcctgggagtcagtaacaaagctaagagaccctgtctggtgctgtgtccctgaaaggggtccttcagtctgtcctagtctagggatcctaggacacaggcctttgtcaaaaccccaagccaaggggacctagctgtcattctcctaggtcgtgtttttaagttgatcaaggtcacgtgcatggagtgtctaggccagcagaaactccagagagcagcacagaagtttgtatcctgccctccagtgagagggcttattctcataggcctcaggtggcacagaatcactgcaggatgctaggcagcctcctaggacacaggatcaggcaggtatttctcatgttcccaaatgtggcatgacaccatgttgagcacctattttgctttgagcccgaaggtggaaaggagaacaagacagacagagctctgtctcatggagcttaaattccagcagggtggacacacaataaccaagcaaacaaaacggacatcatttcaggtagtgataagagcagcaaaagacccctgcaatccaaggtgaggagtttagattttgcccatagtgcagaggaagccccactggggggctcctagcgtggatgtgacatggtgtgctttatgtttggaaagatcactagctaccaggactatgcaccatcgaatgccacccattcaataagcagaaactgcattttcatctctcagtagatcccaatatacgccttttctattcaaatgtgatgtcctcaatgaactcctttgattacccctgtagggaaaatgttcttttaaaaaagaatttctaaaaaccctattccaggtgattctatgagatctttcatctcctgtctcagaagacttatccaggggtagcaggaacagcttgcatagaatagaatttgtttcacgaaccatttctccagtcattattataattccttaggcaaaagatgatttcaaaaataccctccgaaatagacactggagctcataagtttgaggagctgatgaagcttgcatagattgtaaccttgtgtcctataaaaatgcagttcatttatacctgttttgcagagcagaggaaacacaacttgaaaggaaaacttcatgttttgcagttttttaaataaatgaaagaaaaagtgtctcaagaccaaagctgaatatagtagaatttatggagtatcatttgctttggcacacataatgtcaagtgaaatgaaagaatggtgtgaagagatgaggatgagaagaagtacagaatttcccttttccctttttatattatgactaattctagaggccctgctagggacatcagtgctaagttgaataaaataaaggaaggggtaagacaggaccatggggaaagaagcgatgtcacaaaagttctgtagtgagccagtgggccacaaatttacacgctccagtcatgtccagagtgatggtacctaaatgttcaagtgtaattgagccatcagaactgccagcttttctaccttctcaagagattccttgggccccacacacactctgcaatgaagacattaaatggtagaatgggtgctgtcacctgagaaagagggtagcacatctaattccatgggtcctctgggcatagcttatgcagaaggccatgtgtttggtgctctgaaacagctccctgcccacaggggcttccaatctgatttcctttctttggggtttcaaaccgtgtaacatccagactggagtgtctgacatagaggctttctggtatgttccatccattctgaggaccaacaacatgccaggttccaggctccaggctagggtatggagggggtgtgggctggtatactggtcctgtcccttgcttgagtcttccacgagccacttttcctctcctgtaaaatgggagatattatatacattttgaagggagttttcaaggtttgatttattttttgtggaagccagaggtggtttggcttctaagaatagcctaggctcccacccatgcccaccacagcatatcattactttctcttcaagcagatgcaagtccaaactgccttactgggttatattgagtctattaaaactgcatgacaaagtcacaccatactttgcacacctcttggcatttccttccttccttccttccttccttccttccttcctcctttccttccttccttcctttcttcctccctcccccttccttccttccttcctcccttccttcctcccttcccttcccttcccttcccttcccttctttctctctttctttctttccttctttctttctcctttctttcaacagggtttcactctgtcacccaggctggaatgcagcctccaattcctagtctcaagcaatcctcccatctcagcctcctgagtagctgggactgcaggcatgtgcctgggtgatttttattttttaattttgtagagataagatctctctatgttgccaagactggtctagaactccttggctcaagcaatcctcctgccaaaacatccccaaatgctaagattacaggcatgaaccaccgcacctggccttgggagttttcaatataaatccaaattaattctgttgaggtgatcagacccaacaccaggtcatgggggcgacgaagtccaccggagtcaaaggaatgagaaaaagtttgagagagaaagtgggaccagggagccatcacgagtggggaggctacgaaggtcccgagctctgggagccaaagaaacaggtagtgaggatgtgggggttgaaaggaagcagtgtatcaagtgaatgagaaacatatggctacttgagctaatgggagtgatagaagcaaggagccagcaagtctagcagatatgcaagccctacctcaacttctgtcccaacactcagcttttctcccaacaaattatctttgcctctttccctcaatacagtaaagtccaattacattgctgtccatttacagagcaactcatcttcctttttcttttctcttctactttccattgtattcttatgaaaattaaacgaggtaacacagataaatgctactaagtagagtgacttatacataataattgctcagtaaatgctaacagcagcggcactagcagcagtttattattatttcaagattgctgtcttgtctagtgagccaggtgtgcatgccaatgtgtgcctggactagatgacctttatactccccgaagtgaaatattatgttaccgtcgtgctgacagccagtgagctccccaactcctccccaattaattagctattttatagaacatttctctactgtgcatgtgctagaggttacaagtagaatacagtggagaaggggtgatcgcaagatcagacatgacacctcattgtctcagattcatcaatacattttgacagctgtcatggtttgactacccccaaaaagcagatttaaaggcaggggtttgtgtgtaagttgttaatttgggaggtgacttttggaaagagagacaaagaaaggaagcaaataaagaatgcattatcatgggatttgccactgtgggcaagtggagtgtgagctcactgagcaactctgggaaactataaagcacacacctcagcattatcccctgaggggtgagggagctgaggtgttagttaacccaacaactctcagtaatcattggttgaagaatgttttgggggtgccttgttccctggtcctttagacctgccctacatgtggcaaagtgagctctggccaccagaaggagcccttgggtaaaaggggctggcaccagaaggagccctcaggtaaaaggtttaagtcaaagcagcttgcaaggacacagcatatgccaagaagatacatgcagtgcatcgtcagcatctgctcttgttacccaacttatgaatatgccatgttatgtgtataatactcatataccaaagccagatcacaaaacagctgcaactccactctcttaacgacagactgtggccacctcacccttgcctactaggtgcccctttgtgctcctgggcgaagccagtgacacctttttagcattctgctgctgtgctcactgcagtaataggggcagtgtcactcttattacttcacctgttttatcttttgtgaaactcagcccttagccagaatggtctgagtggctggtctagcaagtgcttaacggtgaggctccttcagctcatttctctcaagtaatttgatttcattgcactatcagaattgcttttatgggttggaaggaggcctagggggaagaggttgacaaaagctgttttgagattaaaaaaaaaaaatgtattgcccagtacctgccatcacatcctccatctacaccctccaatctctcctcccgtgcatggtagggtgtgcgtgtgtgtgtgttcaggagaaattaaaataacaacacacaatgcatctcacatttgtatttcttttcacctgagcttgaaaagtatactgtttgatttcctgtgatccccacaacagaacttgtgtgctaagatggaaaaatattatggctatgttctctgaaattatcaagcaaagtgtaattttgcattgacagtcaatgttgacaatccctgttcaactgatgtcaacatattgatcaacccagtgatacatccttctcactcaggacaatcataggtttctatcagtgctgaaagtctcacgtttgataacttcataatatttttattttgagggtgtgcacgtgaataaaaataacacggtgccatgctttcctcattaaagagttggcaggaatagagagctcagaagtggatgtgaatttcatgtgcagagttcaagggagtttgatttttttaaactgctgctcctaacttctggatatttataacaatacagtaccaatttagagcttttagttacttggaaggctggttagtatagcaactactttctaaataatatgcagtctacacagggatttatgatttcataaaattgctggtgttttatcacagctttgggccccatgctcggctgggtggggtgaggatatggatgaaaaccctttgaggttaaaaccaccacaaaatacatttttcagctgaaaataaaatgattgagtgcataaagaatagtttttagatttgtgagtttcgcctggacattggtctctagagcgctgccttcttacaaactgcaagaaaggcagttaaagctgaggtgagacctggcaacagatctagaaggggatgttgacggaagccctgggcagactctgaatggtgcatggggttaaggttttaaagcctggcttaaatataccaaattattattataccaacattatgttcaattttattttaatttttttctagtgagaacctccttgaaatgattgatttaaagtatcaccatatgcctttctatgatatggtaatctatagccccaaatagactttcattttaaagtttaaaacaaaagctaatctgttgcttctgactccaaaaaggacagttttactggcagagtaagtcatgtctatctttattttagtggaatatgctagagttctagtaaacatatttgaattttatatcaggtgaacaaaattagtttctacatgacagcctttggacaaagttaaagataatagggaaatatcaataacagtaaaaaataaaaagtaaatagagaggaaaattgtccccagcaaagtgaaaaccagatttactgtagctgcattggaaccattctgggttttcaataattccaacaaacatacagtttagacatggggtagaatcttcaatgagtctttattgctatgtctttctgtagtgaaatttgatgaaaagaaacattggcttaataaccaagtgaaaggaaaatgtccacctaatgagttatttgatgtgctatggatgaaaacaactgtaaattcaacttgctgtttcacttctgtctcttttatttaaattgtcttgatggtctgctgacagaattggtcctttcttggcttaggaacatcactgctttgcagcgagaagacaggcaaatcataaaacttgtcttggcttctagttataaaaagtattgactagcctaaagctatctttaatagcttgaaatgtggtcaagagaatttaattagaaagtacatctcaacatgctaaataaatagatcagcagagattattaaaacacatcattttacactttcatatacttctggtgggagtgttattggcacagctgctttggaaaactggcagaatctcccagagtcaagcataacatggagtccagcagcccttcctcctggatatatactcaacagaaacacatgcttatgtccaccaagacatgtatgagaatgttcatggcagctttattcatattagtgtcaaactgggaatagtctagttgttcatcaacactcgactggataaacagattgtggaatatccatacaatggaatgcaacactacaatgaaataagctactgttatatgtaacaccatgggtaaatcaggcaggcataattttgaacaaaatatagacaaaaaagaacacacattatataattcatatatgtggagtataaaaacagacaaaactaacctttgatcatagaagtcagaatagtggttattttgagggctgggcattgactcaggacaaggcagctttctggggtattagaagtatcttataccttgagctgcataatggggtgtgtgtgtgtgtgtgtgtgtgtgtgcgcgtgtgtgtgtgcgcgcgtgtgtgcagtatataaaatatttgcaagcactttcaatacaaaagtaaataagaaaaaaatcatttatttatcgtataagtcaactttcacatttacaacaaaagttaattttatgaatctatgctaatgagtagaaaactaagctttggaatgccagtagaagcacagaatctgtgtgcacctggatacacacacatgcaactccctgcatgcctgaccctaaattattcatggcttgttcagcctcattgaccctcatacttggaagaaatttcccatgtcatctaattcagtgattcatctgaagcttgtctgtagcctcccctccgggtggccattctacttttgtgaacaaaagtcccctggtgaccagaatatgttgtgatgttctgaggaaggcctttttctcttggaagtccatccctaggctaaaatctgtctttgtctattcattggtcttatttataaccccggaggtcttgtagttaagtggagaaagaattgtcctgttgctgtttatcctgaacatcatgctttaccttgtatatccatgtccactgaaagcaggcatattatcagggatattcatcttgatatttttctccccttttaattaatcacaaaacatcttcctatgaggaactagattttcacataaatctctatatttttccccagggatgaaaagggatattctgaatataacaatctgttgagtaccttctcagcatcccttcctcctccccatactctaaggctaaacacccctgtgctcccaggagtgagccttttcctgttgtcaatatgtacaaagatccacaagtctgtaatccagtcagtcattcaacacctagttattgatcattctctatgtgccagcaatgttttaggtatccagtgataagcaaagacagatgtgttatctgcctcccagggttttcactctattaaggttattaatcacatatttacataaataaatgcagaactgcaactgtgatgggtctgtgaggtaaaggtacatggtattatgaaaacacaacatagggagtcatcagtgtcagagaagcctttcctgaagaagtgatcacctggcagaggacaaataaaatggatatacactaggaaaaaaggaggagaaatgtcatttcagaaagaggaaagagcatgagcaaggccttatgacaggaaggcaaaataaaaataccacattcaaagaccagaaagaaggccagtgtcgttgcagtggaggaaacaaagagcaatgcaacatgagatgagactagagagacaagaaagggccagcttattcaggggagaaatgttgccactaacttggggagtggcttgaagctagagtcggcttcaaatgattgtgatgcttgtgatgcttgtgaaagagtattccttggaaagtagctgagcaaacaaactaacgagaaaacaagttttgagagagctgtttaaatcagtaactttgaatcgggaatgttgcatcaaggtccagggcacgatccatggaggaagttgttgtggaagatgagcgggtcaatggactggctaagcgcggggtgggtcactcttgtggatgttgaaatcacgtggggttacagcaaaccttgaggttaagatgaaaaccataactcaatgccagatgctctgatgaatatgagagagtgaccaggaggtcacaaataattgagaactgaccatagttgccatggttctatgacaacttgtataatttctctgtggggaattatgtcttctaaaggtgaatgttaatactgatggtcattgcaactgagtgtgattgcagtatttattcgttttttatagccctataattttatgatgtaagtacttattcaacatacctaacatttggagaagaattttatgagatgagaataaataagagaagactgagaaataaatctagaaaggccccctggggtcattggaatgtgtaacacaaagctaaggtgcctgtgtttattctgtgttggagagtcaacaaaggctgcctctgttttgtgtaaggttgaggtgtaatgctaactatgcctatgcctaggaagaatcacttgaaagtggcttgcaggatagattggagaagggaaggaagaccaaaggagcacagctgtcaactacagttgtctgggtgagggccgatcagaccttgaatgaaatcaatgggaaagggaggaaaggaaggggcggtggaaaatagttcagagggacaatgcctttaggacttggttaccaacaggggagtccgtcaaacatggcggtaactaggagagaggtaaagccatagacagaaaccagaaagccagggatgacatttgttttaggtaggagcatgtattgcattgctggtgctgaagtgtattaaagggaagtatccaggcgattataaatctagatgttaaattcagggcagagatggactgaaaaggcctcctatggttaatcccctaacaggaaatgcccatcctggcctccttctccttctttttttttgagacagagtcttgctctgttgcccaggctggagtgcagtggcataatcttggctcactgcaacctctgcctcgcaggttcaagcaattccctgcctcagcctcccaagtagctggcattacaggtgcccgccaccacgtttggctaagttttgtatttttagtagagatggggtttcagcatcttggccaggctggtcttgagctcctgacctcgtgatcctcccacctcggcccttcaaagtgctggagttacaggcgtgagccaccgcacctggccgcctccttctccttctttgcagctcacccgtactctcattctgcttttctctcccgttcatttttcctaacctttcccattgattcctcgggactcacagcttatttctgagaataatgtctccttggttccccattttacagccctcttcctcaaatattctattatttcctgcaagcctcacacttctttctaacttagtcctctttatctgtgtccacatacccctaatacacttgtcatgctgcattttgtttgcctctttacttgtctatttcctcccctagactttgggcttttagaggacagggactcattaaaagtatgacatagctactcgtgtggggttcagtaatactttttaaataaattaactgacaattaactttaaagaaaatttaagagttttacattttggtgcattcatttaaagaaaacgaataggattaaacaattcataacaaatgcacaatcccaaatgtggtagacattgcaaaggttcaagaacttacgcacattttctgtataacagtcattgtctctaagaaaaattaagcttggctctgatttgttttgtcccctttcttaatgaactctctagcaaagcctgtagaaacctaatcaggaaagcaacacatattcttggaaatggggacaatatctgtctttttcttgtcctctcactcattttttttctgaagacgtactgagatctgaaccatcagtttgaactactagaatacatatttgccctccaataaaactgggtcttttaagtcttggttctctccatttccgcaacgtctctctctttctgcgtctgtatggaaaatgttccaggagactctggaccagaagatatcctcatagacaagccgtataaggaaaaaaagagggctgagtttaggatgctgggaatggcacacatttaatgaatgccgctagaaagaagccaggaaagaattggtcaaacaggaagaataagacgtggaagaaggcagggttgaaaaattcaggagaagaagtcacacattcatcaagacagaagtagattaatggttaccaggggctttgggtgacagattggggagtgaccgttaatgggtacagatttttgttttgggatgataaaaatattctggaattagtgatgatggcaagactttaaaaacatggtacaaaccactgaattgtaaactttaaaacaataagtaataaagtttaaaaaataaaaattctgtgagaggagaataaaacataaaaaaactagtcaaacacatctaacactagagagcttgaagataaattgaaaggtgatgggatttggtgattaggaaggcagtggtgagctcaaagagcgtagtttcagtagcatagttactcctatctcttctgcttcctgctctgtaaatatatacattgataaggttattccttcacataccatcactattggcagaatgtttgatgactctgcaggtccaggaatgtgtttggtttagatcagctatggtgacattctgaatgtgttttggagactctgagcatgtacgcttctgctctttgggacaaagcataagtctgtcattcttgctgcccttctaaaaccaaacctatgcaacaagacctgattatctcatgctgtctcaattccaagcatcacctctgatggccccaagtgaaacaggaaataccctctttgaattctgacaataagtttctgtggtatgtttcattggtggagttctgctggccttgtgactggcagaactgaccctggactaactgcatgttttctctgagacacatgtactttttttttaagctgaggataataaactttaatctgagcacttcttacaagaaaataatatgaaagtatattgtaatctattatgcatatgtaaatatgtttttaattgatattgttataagattagagacacaattaaattatttattgtctttttgttttttaaactctgtactggtgtaggaccagccttcttaatgcctgtgtgtaggatcacaggcttcatatccatgtacatcttactgaggcctgtacttattggttgaactgaatgttgtttaaatgagaaaactccagtatcatagcgtgattagcctcccttttgccttcatctttcgttgttcatttgttttttcctgctcttcatctaggctttcccaacgagcctgctgcagtcattgccctcaacaccattaaggaatggcttgccaagaatcaccatgaggtaggaggaacgacataatcagtgaacatccaagatgatgtaatttgatgctcagttccccccaaaaaagcacataaattttataaatatcaactacacctagtcattgagccaaacctagctgaccattcttcacttgggttacatgagtaattaaatgttttttggtaattgatagaatgcagcaactctattgatctatctggtgaagtgaccagattcatttagccataatctaatttttttacattggtggatagtatgggttatatgtgtgaaaaagagaaggggatggatttcattaagaataaggagttttcctatgctattttccttaaagctaagttatctttgttgacttgaggttcctggtgtacagtaattgtctggtatctgtgttctttggatttataactaatcacttccctaaagtcacttctgagtgtgagattgaagtgggcttgtataattgatcacaaaatcgttatgagcgggatttcttatgaaactaaataccttcatcagagtattcatcatcctcctattctgcttacttaataagatctttgtgatacgtttagtgatgaataggggaattactcaagtaaacaaagcagcaaaataactagagaccgtggagcgttaaatttcagagatttgtcagtttacatattgtaacagctaggaggtttcaggcaatgcacagtcttatgcatttttcttctgattttgtttttctcctcagttattcacataagggctataaaaattgtgtttcattttctgatggaccatgaatttagctattttccttgggtaggagatgaattatttggaaataattagatatggaaacaggtgacggggttttcaaatgagaaagcacttggtacttttgtgtgtttgaagaaacagcagtgtcattttctaattattgtaatttcggcatttgttgaccacgtggccaaacctatccatttgggtgcttaccctttattttcttcttactttgaaatgtataaatatggcaacttcaatttaaaggatatcttaaatcacctaaaagaagcaggagaaaaacaaatagctaaaatagccagcttacaaaacatgtctttgacacattttattttcttttcacaacaaccttatgaaatctctagggtaggtatatgttatcttcatctgcatttgccttcaaaaggttaaatgacatactcaagattggaaagtcacagagccaagagactaatccagctctcataactcactggacgttcctcattggaatgccaccaaggccagaaagagaaactcagttcctttaaaagccagttatcttcaatatattgcttggtcatagtaaatgttccacacctggattaactgctttgcaaaagtgtagcatgttgcatgagtgaaagttgataactgagcaagcgtatcagtgcatatccatcatttccactagaatagtaatccaaggatatgccccactggaggaagttttcatgcatcatcttgggatgtgatggacatatgcataaagtcatatcatcgaggatgtagtgatgaagaataaacatgttggtcacaggtacatctcatcaacaaattctactcattgattctctctagctaaattattcagaaagttattttccatagaaattttctaatctagtgttttctacttaattcacttgcctaccctatctttgagtccattcttttgctttcatatccttttatttttctgctaatttcttgggtccattgtagaaaatatagataatttggattgagaaactcagttattgctattgcaactgtaaacatatcctgtactgattcccttttaaaaaagacccctagtttcaatattctaatttaagcaagtcaatttgaacatatcaggtttttctaaataaatgaattataattggtaggtcttagataaaagctaaataaattgattagcagtattttgatttattttttcctctgttaaaacaaacaacagactaggttaaggacttataaaagagtattgcttctaattgttttctcttcattgcagtattattttgatgttctgattggttaagctacttattcattaattcactcatttgataaatatttattgactccccctaagcaacagatacttttttatattccagggacagagcactgaaaaacaaaatccttgctttgtcatattggtagtctagaaaaaaaaattatgtttgcttaacataaattaagcaaataaaaaataaagaaatagggaagttcaaagagtgctttacaaaataaaacagggcaattggagaatgtgtttttaggtagacgtgctgaggacgtaatcttggaatacagatttgtacaatgggaaggaggaagccaagccatacagaggtcttgagttaaaacattccacacagagagaaccataggagaaaagcctggaagagagaatgagctcactgcttgctagcaatgatgagacccaatgtggttgaagcagagagacgaaagaatggcaggagacaagtttggagaaatagacagagtcagattatagggtcttgtggttcatagagagactgtgaattttattctagtgggtagttgttgaagtgttttgggtaggagaataacacatataattcaccttttaaaaacaagcctggctgctcttccgaaaaggatatcttatatttataagatatcagagtaggaaatggcagaccaattaagaggatgctgcagtaaatccaggcaggagatgagggtgctctggaatacagtgatggtagaaaaggaggtaacaagcgtcaagtttggggtacactttgatgatgcagccaataggactagaggattgttttctgttaggatagggttatgctgcagttacaaactacccccaaatcttggtatcacaaacagcaaaggtatgtttcttgctcacactgtttgtacgtcttgagtcagcagagggaactgacttacaaatccgggctgacagatactttaccatgtgaaatatcatctatcacatgacaagaaaagatagataatcaattcccttgtagaaatgtttctacaaaggaatgatgtatataactttcactcacatttcattgtccagaaaaaggcacccagggactaagttccaggagacaagaaaatgcagcctttttgtatgttcagaatagagcaaactgaatattgacaaaaattagtaatgtctgttataaatgtaaatcagatgtgatatatgacaaaaagagaagaatcaaggatgacaactaaatttttggcctgagctgctgggtaaattttggtgcatttactgagatgaagaatattggtataagagcatgtttatatgaaaaatataaagaagacaagaattgtgttgccatgctacagatagttaagtctgaaatgattttagatatctaatgaagatttcaaatagacaattggctcttggagcctaaagctcaagatagaagtaggaaagaaagaccgggtgatattgatcagattaccataactttaacttgggttcggcctcagtttgagattgcttgcaagaaaaaggaatatagtcaaactagcttacataaaggagaatgtgttgtataagtgaactacattcttaaaaaaagtcttgaaatccaagggccggaactagagaggggtctcatgaattatagaatcccaaactataaatccaataagaaccaaggtagctcattttcattctctcccactccatctctatctctcccatgtctctgtttcattattattatcatgttgcatgttatcttttattctcattcacctgcttacgcgtggccccatcatgactgtgtctgtccattcatgggtcaatcagccctgcttgaggcaaggcctgggttcagtggataaggttgcattttctgaagctcttagctggtgaggttcccccaaaattttcctttaaaaaacaaaaaagaggaatctatgtaatgtgagtctcccatcagtgctcatgcttttcttattcagctgagtttattattcaacattcacaaatttcatagtttgtggctatcattccccataaataattgaggctgtcatataattgatgagcttttacatttcaccattaacttactctctgatttctaaaccatcaggaatgtgcactttttctttcccaacacagtagttgatttgcttatgtttaatttcataaatcaccgccagctggtgtagctggatacttccacacccagagaggtctgactagagtcccagtggtcaggagggggaaaatcatattctgttgcccaccatccacttgtttaatttacccaaagtctgaactccaagggcacagcatatatttaagaggactcagaaacccgaggggaggaacgctgctgcacacacagcacagtggctcaaacagtggcagctctagcagaagagctaaagcagcactttaacaaaaagaaaagaaaaaaaggagcattctcaaaaggctgtaattgaggcacaaaaatgacttagaactgaaaaacatgatgactcttgagttgaaaatcttaaaaaaacaaaaaagaatattcactactgagaaccgaattattgctatgagaagatcagatagatgaattatctcacaacacagaagagaaatacaaagaaatgacaatcatgactgaagaggtaaggtggcagagaaacccagggatcaaacatgaggcaggcagggtctgaagattacccactggcattttcagctaaattaagtattaagaacttctgagttcagaaaaccaaaagaaaagaatatcagagttggcagtaaaaattgacagcaggtagcatgataacctttctctaagtgcaccatttttctcaagtagtaactttattacagaaataggtgagcaaaataagggactgttatggaaatgaacagtagaaatgtggcctagatttctaagttggggtggctgctctgtgttatcaaatgcaatttcatgcattccttatttttcatgcaatctagaaatataattctttgcggaataggtatttccccactctgcagctctgagaccccctgctcatatctgaaagttagcctaagaaatgtttttacagtgcctgttctattgttctaccccagggactcatatggcatttggctattggtctctgagacaatgcacatatttgccattttttccacagaaaagtagaacaggatgcatttcacccttcagagccacaaatgtcctgatattgtgagacatttccaagtcatggtggtcatattcaatatttcagataccccaagggagcaagcatcctacagcacatagcaccatgtgttcgttttcccaggaagtcctgctagtcagggaatacggcttctaagatgacgattctgagctggaggatcagtggatttcccaggaacttttaaatgtggaaccctaaagtactgatcaaggattagttgtaacatgaaggaaacctgaacccctctcctcctaccatcaattataaagaagcagatagatggacagaaacccagcgttctaggaggctctaggtaaagctgtggccacctgcagctatccaaaggggagcccctggttcccctgaggcccggccccagcatcatctctgtgggctgttgaggatggactccttcccgctgcactactccaagggaattccctaatatcctccctcctatctatactgctctcctccctagacagatcccattgctctgggctggggacaattcaatggagaagtgtttggttcatctttgaaggcctttggctaggtcacctgcctagacttggaaatcactggcaaggaaaaaccccagctctgcattttcaaaacccaaatgggttttcttttatataggaggaaggtggtacttttctctcctcgcgtacaaggtttgggtctttgcccgacataattttttttaactatgcctttagcacaaacagattgttgttcaaaatgttaaatatcatctacttgtcatttaaatagtttactctgtgccttcggagggaaacacaacacctgtggtattgctgtttgtcacttaaagtagcaagcctacagatgtggcaggggatcctgagatgctgtatatgtgtggcagcatcgctctgagacagatgtccagctcggcaagttgatgccagccaaggctcccagacctcacccagtgtggtctagacctcaccgtaagatgccgatagccagagacaaaattagctttgagttcatccttgatgtcctttggaagtagagacgttggtttctactgcgtggaagcagttagccttgtcaccctcccttgccttccagtattcaggcacatgattcacaaactgctgaagaagctgaacatatttctccaccccagaaaacagaattaggaatccactgtagaaatgcacgtccagcctcctgagtggttcagatgctgctctcatgctgatttgacaagatcgagaacacagccacttgtttcctcattactgatcacaaagaaactgttgcactttaacttctggtgccaagactatttttcccccttcttggcagaggtctttgagcatatgcagtgttaaaaattgtttgccacttttatttcagcatcacgttatggatcaccgaaaaaaaaccccagtgtggggcctgccttatgtctctgacatgaaacgccttaggatctttgtgattcttaaaaagggggtttaaatgaaacatgaaatgatgcttacatttatgatgggaaaattatatatttcgaaacaagctccaaattcctgtggactattatttacacttatgcaaaaggcataatgtgccatcctccaattctatgcaatgcaggggtgtggttaacattcagagacctggaaggagcaaaggaaatgctccgtgctctctctcaggaatgcctttttatgtccacaaacatcatctgagtacctattatggtcttagtttttggtggaatttagtgttaaaatttgtgcacttgaaaaaataaattgcagctttgaaatggtcacatcctatgcagtaatgtggttatggtaataatcatcatcatcctaatatgctgccgtaaaaacgtatcctttgagtagcccaaatgtgtcgttcaggtggagccatgacactcataggctgtgacaccactgaggacagttagtcccagattttgcagatacgctgtgtcgcttttgctcttcaagaacactgatgacttgctaacattttatattttctctctacctctttatttttctctccctctctccctaccgttctctttctctctcactctcctttcttccctcctttccttctgtctccctccctctttcttccttcctccctcccttcctgcttctcccaattccctcctccctttttccttcctttttctttctttctccttccttccctccctccttccttccttctttctttctctctctccttccttcctttcttccttcctttctttttcttttttattttcttcttttctttccttttcttttttctttcttttcttttctcttctcttttctttttctttctttcttttcttccccccaccagcccgccccagcccagacaatcccttatcactctgagtctgtcattgtcgggatttgtgacaagcagttattgttcccacggttagaataaaagctaatccccaaggcagcttctccccttctgatgggggtgttccagtgcttggtgtcaccatacactgccacacaagagtttgccaagtggacagatccaccgacacttccagcttcaccctgctttagcatctctcacaattggcataatgaggttttggagccagaaactaaagccccaagacaacatcaagggttgctttcaggctccatagccctgttgtggtcaataggaagcacagtgcatgggaaaatatgcattttgctgtttcagttagtgagcttattaccagttagccagtgatggggagggctctaattacacacttttaggcgttgagctgagcttgcccaaatgccctgtcacccattcttactctggtggggagctcatcaaagttcaacaaatgttttgttttatttcctcccagtaggggatatcaggcaatcaaggccttggggtgctctagggacaccaacctacagtcctatgtagattagggtggcttgctgtcttctgcacttgcatataatcaatatacatcctcctcagccagccctcctgaacctagtactatgtccattatgccccactgtatctagataaacagaatggagtgcatgggaatgcagagagaacctagaaaaatactctgctgggggtgagtggtttggggggttgggattttgtttaaataggcatggagggtaattcatatatactgctaataggtctagaccttctagaaagagttctaggaggtatagaataggtacatgaaggagttaaagagggaagaaagaggtaagggaaatcaatatttatctgactcctgatgtgtcccatggcagaggcatggcccaaagatgcattctgtcttcacaaaactctcttcaaggtagttattttaaaatctttaatttcctagatgtgacagttaaaggaaattttaaaagtcaactaataagatactttcatgttctactataaccttgcttctgtggcctgtctagcgttgggcaccttacccagatttagccatacatgagaataaaaccaaaatagattgattagggtctttccatgggatttctttgccacctggagtcaggaataaaaaatggtggtgaacctgagggatgtggagcacagctaccgtgttccctaccattttggaaggttcttctttaagaagataatttgaagatgtcccagatttgagggcagttggcaagagtcacagaacccattctgttggctcaagtgaagaaccaaaactgaagcaaaaagcagtatattttagcaaaatgcaatggccacccattttaagtttttacaactcaaaaaataatttttaactagagaaaagaaaaggttgagaatcatttggagggttatttttttcaaaagtgtatgctttaaatagtttattctactcctttcagagaacctgtgctatgttgaaccactgtttatgatgagaatattttacatccttcagatgtgttggctggaaaaattttgagagtcactgtcctaaatagtaaaattagagtgctttttataaaatcagtctttcaatattcccttcatactggaggaccatcaaaagatagtaattaactaatgaattaattttctgatggctgtatttttctccttctttcctgcaacctggaggtaggaaacacacattaacagaagccagtgctgaggagagactaagaaatagcatgagacaggtgaaatgcaaactctttaaaatcaaacttcagggtgcaggtattaaaaaaaggagagagaatgcagtttgctcagatgacttggccaggatgttcctagggttgggattggtatatctgaaaaagaacggatccctttgcaaagtttggcttagaagttccaagcctgcaggaatgtactcaggagctcactatgtaacagaagctcagctcctcttccgtgcagcaggaatgggaattgtggctcctagaagtagagtggtaagaggtagggtgcagttataaccaccactgtgtaccctcactccaaagaggaagtttggtgttctaatcagaattttccacactcttacatagccttaaacaattaactccatctctctggactcagtttcttcatctgtaaaatagggagggtgggcatgtctcttctagcttcaggattctgtgccattgatgtgtgtcttctggagcaggcccactgatgcatcctggccatgcctttgaccatgtcttcatagcacaatcagacctgtaagaaggcttacactctgtgattctccaggctcctccagtggcataccaaagatcaagcaacatttgcatgtgctgtctgtatgcctttaagatgattaccaacccccatatgggtgtatctttagagttgatattaacaaccttgacccatttagtgtagaaggagaggccgccatgttgattttctgtaaatgatccggattatatggtggtttcaaaatagccaacttttaaagctccttatgaaattaaatgtgctgattatccaaatgatgtgacatttttataaatagaaagtaaacctctgagcatgtggttggaactacatcagacacagggataaaaacaacactgggaggtcctactgaaggacattctaacaaccattttctggagatagaagcatgcaccttcatcccttctaggtaggaaggaaaaagaaaccttttccttgtcctctaccttgatggactaggactcgtatgctgccctgattgaagggaaaattaacagttttgatacggtcatctagctcaactcagggaaaaacaaaaaaggcatttcccctttctagtggaagtaaatgatttgcttgttgatgggtgatgttttcagccaggctgctgtttccgatagaagctgtgaccagagctgaaccatctcattgtttctctaatcacgtctaggcaaagaggtggctcctctggaaagactagactcctttgatgatgccactgctactcactagggtaagaaaaccaaataggtctggcaaaacacttgcttctccaatttcatggctcaatggaaaacatactggaaaaaacatccgaagactgtgggtctctggccatgcaccgctggaggctgtaacggtgagcccagtgacagaagggctggctaacgtgctgtcctgcaatcagttatgtcgtctacatttctatttatgaaccccttcgaagtccatgacagaaagccccaaccttttagtgaggagactattcatttgcaagaagcagagaatagaagaatattgggggatctactattaactaaacttgtgttgaatagaagttactaaaacctggtcagattcacatctgtgattccaggttaagggcctcaggcaaggaagcgaagccccacgtggatcctgaaatactggccttagactcgattccacagcaaaggttgcagccacccagcatctgagctgctgggcaccagggcaagtgatggccagtgacaggaaggagctatgcacgcatatatcctctgttgtgtgcactctttaaaagaagagataaggagaaaaaaatatttaaatgatatcatttaagtttcacaataaaccattgactgaaataagacatatgaattctcttttcttccaatcggtccaaattttcacatgttccttagcttctttctgcattgatgtgatgctaagatgtaaagacttttagttgttgttgcttctctgacactgctcctcgatataagcgcaaaacttcaccttttgatcatggggtctttaaaaaaaggcccagcaatctcccctaaagctggagacaaaactgggtttcctggacttactgagatgtgatgtgtcagtttacaacataaggcctttctaatgaattttaaagaaaaattttgctcatgtgaaattttcactttatgtgctgaccttagagcttgaacattgcataagaataactcagctgtatatattttgcaacataaatgttgcctgtttgtaaccagcagatttcccttaggctgggcggcttcttctgccctgttacctactgaagtactcccctaatgaccaagaggttgctcagcttgtcagtgagacaagaaaattcttggagatgtgacaatcattctggacctattcctcacctgtaagataaggtgaaagtcatctaggaaaaatccttaaatcagatactggggcataccctaaatctactgtatcagaatatctgagaagatagtggcctatattttgaaaatttcttcaggtagtggttgagaaagattaggccagttgctctcaacaatcttttatggctaagacatactgcaataaaaactcccatttgttctcttcaataaggaaaaggctatgttaagtgagaactgtgagagtaaatctctcctctcaaccagtttacgactggccttctaacaaggggttaggagtctagggttggggctgtattgtctagctagtcctggggtggccacagcttactttctactcacaagcacttgacatgggttgaccaataagtgagtttgatgaagtttacacataatgtaactcaactcacattaaatatctttgggagttgctagacagcttttgtggcaccctgtaaacagtagaggccttttgccatcttttagaaaggattttagtatattcccaatatcctgttgatagtaatcattgtctctggatattgcctttgatgcctctatgcaagagatgcatttaataaattactaaaaatcattagcatacacaacttaattcttctttgagtacttattgtaggcagatttgaaaataaagccaacagggctatctcatggatcttatgtaattatattggttcctgaaacaacttttgagagtcaagtactcagtcatctgaagcaaattaattctccctggacatgaaggtgccattaagcatagcggcaagagatgattttccggttggtaccctgttgtcctttactgaagccggtttacaccaccctcatgtgaatcagaccctggatgtggagatacgtgccacccacggtgcttctaggtccccccaccgctggcacaattagatttctttaaggaattaggaaatgaaactctatattaaaattcattgctgagaacactacctaccttaatattttctgctgttcaaaattttcctctgaaaacaattagaggctgatggggtgtgcatttgacagtgcaaatggagctacaaatgacctgggtgggcttcagctaagcacagggcagcttaggaatgtattaagtggagtaattatctcatatggttttcccttgggttcagtgacatctacaaagttcgtttttctaagttcctccttctacaaatttaaactcaagggaaataggatccatatgtccctgattaatttgcactaactcatcaaacgttcttttctttgtaacttattagatgtctacagaggatttcaactgttttttataagttctttcaagcctttttgtctagaggcaggaaatggccatttgccagcagcaagcgaacccctaaatagtcacgttctgttcgggagtcaaaggaaaaagaaaatcccctgttttctaagtacagctgggtaatggttttctttagaggtgatgataaatgtattctctgaaatgtattattagacttgttaaatgtgtaattaaagggattccatgaagttgttgcagcaggaatgggatttaaattgcccccaaacccccttccacacacacattattactttacctgtgaaaatcttaaaagctgttggtttacccagcagcttagagccttgaactaagtgaaacatgaaatatcttcaatatatgtaccagaggctctgcgtgtgtgtgtgtgcgtgcacgtgtgtgagacattgacaagagaaagattgatatactcaaaccctacatcatactgtttttcataaatttccatattgaatccaagagacctcattttgaggatttaaaataatgtggcatcttgcttcattaccaataaaagtaagctttttggcctacccataataccccagggtaactggatttcaaaagcaaatcaacttgagcttggtctttcactaactaaaaatacagtcatgtgccacataatgacattttttgtcaacaacagaacacatgtaaaatggtgatctcataagattctaatgaagtagaaacattcttttcacctagtgatgttctgatgattctgaactgatgtgggcctaggctaatgagtgtttttgtcttcatttttgtaacaaaaaagttttaaaagtcaatgaacagatttaaaatgttaaaaacagaaaaaacttacagaataaggagataaagaaagaaaatatttttgtgcagctataaaatgtgtttctattttaaactgtgttattacaagagtcaaaagtttaaaaaataaaaaatacaataagttaaagttaatttatattaaagaaacaacattttcaaataaatttagggttgcctacatgtacagtgtgtataaagtccacaacagtgtacagtaatgaaccaggccttcacatgtactcaccactctcacccactggctttcccagagtaactcctagtcctgcaagctccattcatggtggatgccgtatgtaggtgtgccattttttaatcttttctactatacttttactgtaccttttccatgttcagatatgtttagatacacaagtacttatcattgtgttacaattacctacaatatggagaaaagcaacatgctgtacaggcttgtagcttaggagcaatagtctgtaccatataacctaggtgtgtggtagtctgtagcaccaggtttgtataagtatactctatgatgttcaaacaatagtgaaattgcctaatgacacatttctcggaatgtattccatcattaggtgatacataaccatatataaatgaaaaataatcacaggcattgaagtattgagtgcttcctttgtctaagtaccttacttgaattaaataatttaattatcacaaagatgctatgttatagtcataattattccccttttttgatgagatgagaaaacttagactttaaagatcatacagcaaataaatggcagttgagtttttaattcagaattccaagttcataactacaatcatcaaaagcattgtattttcccttaatgataaaagtaaactaccgtatcagagatctcctttcaatgcttatgaatctcactacagtctaattcagatctcttctagcattatcccatgtcaccctccatgctgcagctcatacaacttagaaagagttgcttggtaatttatttgtgaaaccaagatggcaggtccatggtttggtcaacttttattgtcttgcctttagcacaatgccaggaccatactcattgcaagttgaatgaaataatttacaaatgggaccttttattatccagcctgctgctcttataagctcctaaggcttcatgtgattagaactagagctgaatagtcatttgtggtatcaacatttctaagccatggatatttccattagttcattagtcaaacatgatcaaatgattaacaagcccaggaaatttcaaaatctccctgagagcaggaccctaatagtgactaatttctcagcgatcagtgctgcctttgttgcaaacacatggctcttgagattacagagtaaaatctgtacttactcctgttatctctgctcaaatactgcatctttggtgaatttttccttggccttaggaaaacttttcccttccaaatatcactgtcttttactgtggttgtggatgtacctgtcagctttcccactgactcaaggactgcaattgtgtaaattcatccatgcattgtttttgttttgtgttttaatccaaggagcctggcacataaaaagctttgacaaaaatgcattgaatgaacgaatgttttgaattgtttcttaaatgatggagctgagcatgtataaagccagtgtatctgtctcatacagattaagattcaagccttgaactctgttcctatcctcaaatgaggaaagggactgaaaaccagccctagtgtgcagagattcagccagactctggatgtagcccaggcttggagaaaattctaccctgctctttcctttatcttggacagatggcagtgtgctggagttaggcagctttagactgttgtctaaaatgggaagcttatcctcaggacaaattggagacagtcaagacttcagaaagctcacccccaagcctgagcttatgatctgttgatctatagctgatgggcacacggcttaccccgtttgcctgctttgctttctcttttcctgcaaaggcttgtgtgattttaaacaccagacaaccttggtctttaggtaactgcattatccttttttcagttaatctacttttaatttttctctctttttttagtccactcaacattgtcaacactgtcaaagatgtcaatgttttcatttccagttctgatgatactattttttaattgtcatgtatttccatatgtaacctgtttctgaaaggaaaatatgcccttcaaaaaaaatgttggcagcttagatttcatgtgtaattctttcaaaagcctctcagtctttatttatttatttagcaaatattcactgagtagctggcacaccctaggcattgcacactatttatacaaaagcagttgatatacaattcctgtcctaagaaagcttacggtctgttggagaaaacacaaagaggcaatgatcacaggataatgtggaaagtgctaggataaagggtgcccagggcagtgcgggtgctgggcagaggacagagtcaaggaagactctgggtgcgttctggtttgaacagaaggtagagggcagcctgaatgtttttcctggggctttttcttttccttgggagtgaaatccaaatgcctgtcttaccacaagaccaagaacacctgatcctcggtccacagactcaagaggtctcagagagtttgtaaatttggggcaaagtttacagttattttcactaacctctagttaaaatttagtactttctcccatcatgactgtagccgcaaatcacagtggtatcagcagtctttgtgactttgttatcagtagaaatcacagatatttcctatcacataacagttgttgcagagatctcaaaacactacttatgctcatcttgactttgaattatggtagacccaccataagatcttgtttcaatgtgttcataagtagtatgcaacgtaaccacataacacattgtttccttgtaaatggtatctcaaaaaaaactgtttcttttgtaatcttttgtatttttatttatttaaaaaccatattctgggaaggatccataggttctgctcaactactgaagaggtccatgttactaaaaagtcccggtggccaccacataccatttctcccttgctcctaccctccagcctccttggcctctgactccacccgtcaccctcatgctccaggccaccaccacatttgcaggtccccccacttataaggctcttcctaaagctctctgctcacactgacttcttttattcaggtcttatctcacacagcacctcttcacaaagaccttttcctgaacccccacacaaagtagacctgccctcctttcactctccctcacttcaccatttgatttttgtgtacaattcatcgctactggaaaagcgtatatgtattggtttatcggctgtcatcttactagagtggcacctatatcagagcaaggacttcaaatggcttgttctcttttatattcccagaacattgaacaatgcctggaaggtagtaggggcttaataaatgttcactgaacaaaaagtaataaatgagcgaatgggagggggagtagagaaaggggtatgccagacagcaatcagcgacaaagatgcagaggtgacaagaagcctgaatccaggagcgtttactgcaaagactgacagcaatgggccccttgtgcgcagggtcccttggccctctcactctttcctggcccctcagcagaaataaaacaggctcataggactctttttgataagagtagagaatacagtttgaagaactcatagtcttaacagataaatctggaaaatgctaatggagcaggttgccgagccatttcttattgcccaaccctgctgcctctttcacctagtaaagatgaacagacatgatttgcataacgtgcaggcacagaccatcaaaagtctggaaatgaatagagctggcaacagacattcttttcaaaggcatctgccataaagctagactcctgagagaacttgcagcatacaattttgggtgcccaaagagcatgctttatgagggagaaaaaaggtgatgggttcattgttgccagaatgtagtgtcttgacacacagtttgagatgtctgaatctgacatttaatagctgagatgatagtggtcaaatacttctcgaggtcagattcatgcagagttcctgaaaaggtgagaaatcactgagatctgtaatgacaaagctgatgagaagattgatgaaatggtggtggcaacaggacaagtcttcaaaatagcttgtgaatgatttattttgtagcagcagagccaattgacaatagcggattgctaattaaataccaaccactgggaaaataccataaatttcttttggctcagtattggcaattgtgtactttgaagcagaggccaaattattttccagtgagtgcttcattttagacctaaattttgtgggcctccatctctttttgctttcccttcaacctccagcatatttgatttaaaagcaaaaaggagaagagggaagaagaaagaaggggaagaagagattgaagaagagaaagaacaggtgggaagaagggaagaaagagggaggaagaaagacactcccaagtgtcctaataacatcctatcagaaaggcttatggccacgtgcggtggctcacacctgtaatcccaacactttgtgaggctgaggcaggaggattgcttgaggccaacagttcaagaatagcctgggtaacattgtgagaccctgtttctacaaacaataaaaaaaagtcttgctttcattcttttccagtctgtggctaattaggaaactataataactacagtttattgagaacctatcataagattggtgttttgctaagtgtttatgttcagtaagagttaacatttactattttctatgtgccggacattgtgctaagtgtgaattctcaccaggacactatgaagtaggaactgttaactcgctctttccttccttccttccttccttccttccttccttccttccttccttccttccttccttccttcctttctttctttctttttctcttgctctgtcgcccaggctggagtgcagtggcacgacctcggctcactgcaagctccgcctcctgggttcacaccattctcctgtctcagcctcccaagtagctgggaccacaggtgcccgccaccacacccggctaattttttttgtttgttttttgaattttttagtagagacagggtttcaccgtgttagccaggatggcctcgatctccttaccttgtgatcctcccaccttggcctcccaaagtactgagattacaggcgtgagtcaccgtgcccagccgtttctctgtttttcttataaatgaggaaactgaggcagatagtcttgtttgaaatacactgccattttttaatgagtgtgagaatttctgtaaaacaatttttaaagaaactttttatatgaaactagttgataagaattatagtttgctaagaaatacaattgaggcaatttaaggagaatctgtaagataaataagccgtatatttaaattaactgctggctacagttaggaaataaaagagatggagtcttactcctcaaatgagtaaagtgcgaagtgacctcagtttagaaagcagttaagatgggctggaagaatgaggtaagaatctggtacctagagaagccttatctccctctgtccactctctggtttgcactaggttggagaaagccattcttggagtcagggattaatgaatgtgggaatgcagagcaaaatgaggttgctctccccaacagttccataatctgaacctctatagctgattgtcaagggccgacctgcaaaggcttttgtggcaaagtcgaggagaagcctagaactccatgcgatgcagaggagtctcttctgttggagttaggggaagcggcgagaataaaagaagcactgcaatcaattccaacaaataaaatgagaactgggaaaacttatcatagaaaaatgaaaacttataatagaaaaatgattaatgatgaaaataggtaaatgtttctttaaatggctttttggatagaactgatctatttttttcagttaatgtagattaccatttggtggtatcacgaagcttttatgtttaaaatccacactgggaaaggactaaataaagttccacatggatgtcaggagaagaacctgtcttataattttgtgaagtgtctagattggggcaaatacccacagggagtggttatggcatggagaccttccccaacatggtggaaccacactttctggagcgagtcaaagtgccaatgaaccaaagtgaatgcagtgataactgcaagagcaggccatccatccctttcaccctggggtgatgactatagcgatgccagcgtgacattgaaaaccaggacacattaacacatttgtcacccctatgtttttaaagcttaagaggagcctagagcttcaagattccctctagtaacaaagacccccaactgccatgacaattaatcctgtggaaagctgagggtagagtgaacagaggaacggcaagatcccattggctgtatggtatgccgggtccctctgtggcactactgagagtcagacgggcccctgatatgctgcatactgaagagactacacacatgtatgaaacagcaggtggggtttagatattctctgatcaagttccttcacttgtttctctgacagaatccctggcctgtgccttaacaacatccacacattcatcttcccactacttcttgataatgagtttgaaaacttgccatggactgcacatagatctcactagagttcatggcggagctgcagccctcaacttcagccagcctttcattctgtttctcatcagatacatttaatggcaagtgggtgtttaaaccacagggaagggacagcaagaacaaatatataattagacatgtttcctggctgtgtgctttgtggataggcctgtaggttttctcctgggtgacttgccctaattgtatcatcagcttcccccagcagacaactgggctgagtttgatccatgaacttgaagcacgaggtgaagaatcgtgcatctacaagagcaattataattataattaagagtgggttggttttcttttcggtttgccttctcgtttttcagtgagcatggcagggatttccattaataataaagacattctagagatgtagaattaggaactggtcgactctggttaattggcatactattgtattcccataaattctgtctgggactgctgtgaatagatttaaagctactaggaagaaataaaatatacagccctttacaatgaagttgttttaagcttgaagcttttgtgtttttagtgactttgaagccggataagtattaacttgagtattttattgtggagaatgctaaagtaacggacatgataagagtttctggtggatattcataaactgcctttggatctgggagacagagagttttatgaaactgtgtaaaaatgtaaataacagtatggcacacatttactttctgccacctcttgggtagtccattctcctcatttcctctcagaaaaagcaagattatggacggtaaaaacccaactatatttataattgggatatgctaattgcagtattttaaagaagctaacacagctcaaaataaacagcattttcaatttacaaatagtgataacaaagattaaatggggattttctttggagcacaatttacagtggattttagtgaaagttgaaggagccaagtcagttcgtatgcagcttaaaagcatgttttaactggcgttgtcttcaggccacaggcccttcagtggtagaaagaacaccagaatggggtcagcaggtttattaactggaagtctttggacttaagttgctgaagatctctattagtttgcccatctttgaaatggagaagataatgtataattcacaaggctggtgataatattcatatgcagggtcaggactagggtgaggtaatcaaggtgcttgggatgcacagtttaaggaggcaggtctcagccgccaactctgtgcttgcatagccctcatattctgcaccccaggagcctccttcacctctctctagtcctagtgctgtaaaagaggtagccctattaccatgcctggatcatatggaggctcaaaataaaatgtttttctactgtttgtcctgtctgcctcatagatatcttttgaaaagtacatagggaaaaatagagaaatgtactcaatgcagtgctctacaaatgttagctgatactaaatcacaccaaatcactagtaaacccctgctacagttattagttgcaatggtgttctcatttgcaaagatacatgtgtgtgtatatacaaacaatagatattatggtcgtttgaagaatttcaatgaaaaatgtgtattactgtgttgagagtagccctttaaagtaggattgtattttttcctgaggacaaattataagctttgtgaaattagggatggtcttctcttgccttatttaatttgactgccagcccagcaccgtaagtatataggcaaattgtatcagaaaattagtagggttggaaaaataaatcagaactgaacattgttctagacttggatggcctttagctggcaactggtgctaactgctgggtgactggagacagcaatgggtatggcaagggtttctggtagatatacgtaagcctgccttttggatctaggagacggagagttttatgaaactttttaaaagtgaaaatgacagtatgacacaaattcactttctgccacctcttgggtagtccatctatctcattacaactccagcaaaagcaaaattattgatgataaaaatccaaccatttggacaattacaagttaaactggggaagatgcataagtaggcagctagagggactggtgttcttaccacccagaaactggatcatttgggagagaagcgcaacaaaaccagccatctatggcagtctctgacgaagccttaagcaccctttaaagagattctacaagaattgcctgactccatatgatttaaaagctaaatttattcagagaaaagaaagattttttgctgagggaaggacgttgctgtatgtttcatcacttgagtcgtggcagataatttgggttgagttcaaacacaatgtacttttcaaaatgtaaatctgtgaagaaaagctgaatttttagagccatcacagttttagaaattttatgctgtaatctgattttgtagtcaaggtcagtggctaaagaatgctgttggaagggcctagtctgggtcagacaaaggaccgatttggggaagatttggctgatgtcttcttttgtgcagggagagttattctctcactgggttttctgtgcaccagtagggaaagaagctgcacacacatggtatgtgtgtctgtgttactccaaaacccatcccaggctgtgctgcagtccttagtgaaacggagagattttgatgagtcaccaataactggtttcctgggactgatcatttaacatatacaagcgcactcagatttctgctgtggtttagaatagactggggggtgaaaacctgcccaggtctctgtttcatattgtgggaaatgtttgtcttcattctttctccatagagaggtggtttccatgatcgatggacagtctgaagtctagaataatggtaactatcatgttctgagcttgtgtagctatcatgttctctatcttgtgatgtgccaggccttattccaggtccttcatgtcgcaccagcctcgtgatctaggtgttctcttgtctttattttccagatctaggaactgcagcacagctaagttccatgatcaaggtagtaaatgtccctgctgtatgtacctcgcccgggctcacactcatcctgatgcagtaacttggaagtcctttgtctgtgtgcacattcatgtttgcttttgaagaacactgaagagattctactttgaacagaaaatatttacaccgaggtccttgttctctctgttgagtgctaaaagtgagggccaccaaggcaaagtgacaagtggtgccaggctctcagatttgatgcttctgcttggggtagatttgtgaggggatctccaactccagccctttcaggggccaaggcaggccacgtgaatgagtgaagcaggctgggcagagactccactaacttgctagtgtcccttggacacagctgcagacacttgttgccaggaaggattagccagggttgcctcatagtttaatttttctggagaagtcaagcattgagattaaaaaatttttgtaacaaatgttgagaattaattttaaaacttttttaaacagtacaaactaacccaaacatatctatgggccagatatagctaatgggctgtcatttctatataatttctgttctaggtgaatgatgcgtcacctacaaaaggctttggtttcttgatcttcctgttaggaggaaaaggagctatcacctataggaaatcccaggactggggaattgtataatagagggacttattttctgtgtagtgcctaggtatagccctgtacactttatctctctgcactataccgttccttgagcactagctacatgtagctattttaattaaaattaaagttaaataaaattaaaagttcaattacctacttttaccaaccacatttcaaggactcaatagtcacatgtggctggtggctaccatattggacagagcaaagtagaacatttctattgtcactgaggttctactgaatagtccaagtccaactctagattcttaggctctggcagcccaggctatcttacaactaaatgttctttctggtattggctcttcctggtattggccaacagttactgcgattgccccactggcttaagcttgtttgctttgcttaggtctttccattagtccaaaaatatctcagcattcggccatttccaggtgccttactgttggctcataaagatgtgtttggtgatgatgtttggtcaccaaagaagaaaggaactcttgttacctcttgcacttctccctcagactatttactgccattataatgttatatttgttgggaagtgaatgcttactctccactagaatcccactaagagccccaaggaaagggatcatgtgcttgccattttttcttcggttccctacagagttcctggcagagtggtcagccacaactgttggataaagttaagccctgggtaggataattttcctttacaacagtatgtccagtgtaggcaaaacatcattcccaacaagaaaaatggcacatctcaaaaaaagtaatttccatcatgtgttggcttataacgtgccatggtgagattcagaaccacaaggtccctgttcctttcacagtaatgaacccaaagcaattgaatgcagagctatcaacatgaataagggcaagtcaactaggactttcttatgcatccagcattaaagagtttttgttaacatccacagtaactagtgaaactttgtgtgaaaacattcacagtaactagtgaaactttgtgtgtttctgaggtcacattaaaaggcggtttgggtaggctaattatccttttatcatcctttttggtgttatgactattcaacctctttttatataaacttaaatatcctttgctcacacaatgatccagacagctggatactccttatagggtagtcaagagtattcagaggtccctcttcaacatctactggctgccatggctgagcatcacatccaatgtaaaaagctgaatattcttgggacaaattaatattgatggttagaaataataaaataaaaagatgttttatttttaacatctaataaaataaaaagatgtttttctttaagttttcaaaaagagaaaatagatttttctttatttcagaaaaggaaggatgtacggcattactgtaagctccacaaaggcaaggactatggttttggggattgtccttagaatgtctttccttcaggtccatctagtgagagtcttttaaaaaatatatcagatgctgtggcggacaccaaaccaattgtatccctcattcccttgctgtaagttagacaaaataagctagctggaccccaaatatctgatcttttgaaacaattagatgacaatgatggaatgatatataattaggaatcaccaaaaatagttcaggtataacataaatcctctagagagttgaagaaagatgagaatatttggggctaaactgatgaggcaaggctttatggaaaaagtgagaaaaattgacccaaagatgtgaataggtgagagagtggaagggaagtcattaacattggaggagagagaaaaaggagactgaatcctggtatgagccaagtagcaagaatgagtagacaggatatgtttatagaacagtaatgattctgatttgactttttactgagaaaaggtgggttgactgttttcagccaattatatatgagatgcagaagttggatctactaacttgatttagccagcaacacatagttagaaatgagtaaaaccatattgggcgtgtgggggctctgcctgtggtagttgacacttctttttttggccaggatggcttggttgatctgggcattaaaagaggatgcccttctttcctaaaagtgaccttcctagatagcaaatagaagataatgactactgtttagtcaatgaaagatgtgcagtccccaaataatcaatatttcctaggcacaattcatttatgttttgtttgtttcaaaattttgctagcaagtatctcaccacgtattggaaatgagaaagatatgaccatcttattttggtaacagttgtcgtgggtgaatgccaaaatattatgtaaaataaaacctttaagtatggggaagtaagctcactatctcagctttccctccccttgtctgagctcagagcatcaagctgttaaggactgtaccagtgactgcatgtgttccccagagaaaatgaaatgagcccaccagatatcagtaaatatttcttactgttttggtttccatgtgtcttaagtgtgaattttgagtaaaggttttattcaagcaaaaggctccttactcattttttctacaataatattactaaagtttagttaatggtattcaactatctgttctactcagcaacataatgtaatcttatgaaataagaaattatctgaaagggcatttcttttcacatggctttataaagcatccgtgttgaatgtttgatggagaaaatgagttaataacatgagaggtttatgcattaactatttaataaccagtggattcaggtaattctgtttctcctgctaccacccgaagtcacaccgctccccagattcctgatgtgttgcagccatttttctccctatatcataactacccagcactaccctgcaaatcctcagagactgcccataggccatctgatcatcagtgtaaggcttcagaatgatctgaggtccactactggcctctgcatttcttccttggagtccattcacacaatttagtaaatatctctccagtgtttctccaaaaggcaaaatccaaacactgatgtttggtgcacatgaggccaggaaagggatttgcgagctgctctagattctcatattttccaaatccctttttcttctccccttcagtgccttctgtctttttctccattttctccatagcacttatcaacacttgacaaactatatcctttgttcatttagcttgtttgttgcctaacaagttcccagtagaaagcaagtattataaagacaaggatttttgattattttatctgctgttatatctccagtacctagaataatgcctggcacacagttagtgttcaataaatatttgtagaaagactaatatagagcaatgtttctcaacctggggcaacttagccctccaggggtatttggcaacgtctggacacatttttttttatttgagacagagtcttgctctttgcccaggctggagtgcagtggcatgatcttggctcactgtaacctccacctcccgggctcaaacaattctcctgcctcagcctcctgagtagctgggactacaggcatgtgccaccacacccagctaatttttgtatttttagtagacatggggtttcaccatattggtcaggctcctcttgaactcctgacctgccttggcctcccaaagtgctggggttacaggcatgagccactgcgcctggcctggatgcttttttatcatgaggattgaagggataagcagtgctattggcttcctacaatgcacagaacagtctcttaccacaaaggattatctggctccaaatgctgaagttaggaagccctgatgtggagcacagaatccttgggagccctgccaagaaggctggctaccatctctcctgtggctctctggcttatctcctggactgtggctctttctgtctcatctcctgaccacacacttctgtttgcgttttttcatccagaaattaaaatatctcatttgttcctttgcagttatgtggtttttttttttttcagttcctttaccaccactactttaatgtagctttttgaagaagaagaagcaaatgcctgagcttagctgccatcttgaactcgaaactcttatcacttttatcttgtttgagtcaccatttctctgaagtctgtaatatgactgctaccaatacagcattctctcttctctgaattcttagaatacttaccatcagttttgaccatttgggtaatgtattagatagaattactgctctaacaaagacactcctaatgtaactattaatatatcttaaagaagatggaagtttatttctccccaatgtaacattctcaaattgggaggcctgagtcagtagtagacaccactgctccacgtgattgatcagattcaggctcctccaccttgctactctcccattcttgatcattgttctcagccaaaaggagaagagctggaagtagacagttcttgttctcagtttgagagaaaacgagaaagaaacagtcctgtttagcatttttcttctaaatatgtgctctgtgggatgcgtgtgtgtgtgtgtgcatgcctgtgtgtgtgtgtgtgtgtaagtgttaatatatttatttctggaagataggatcacaagatttgtaactttaattattttgctcctttatatttttccaattgtttttacattgaacctatactatatatatatttgtggctgacattagatattctttaactatttgttaaagaattactattaaattaaacgtctatgtaaagatcttcctttagaagggtaggaaataaccaagtggaggatagaggcttcttttagacaacaaagaactcaagcaactgtaaatacaagcaaaaaaatgtaaagccatgtttgtgattttaagtgaattgaaaaaaaaatctcttaaagtatatctttaaactgtaatagttacgtatatgttgtataacctttcaaaaaacaaatcaaatgaatcagatgtttgacacagtagaattaaaactcctaacttgactgatatccgccccccccacctttgaccgattatgttgacatttaacaaattaaagttaaatttaggagttgggagaaagaaagggaatatacaatgggaggtggacaaaacagtgtgggagagtggacacagaataagggccacggtgtgtattcagagaggtgacagacatcaacatatgttcatcagcaagtgacggaggtcaacaggtagaagaaatttgagtgaggacatgggacatttatcagcaaagacatgaaaataagacagtaaataaagcttgtatttgaaacagaaaaaattaagtggaagtaactgataataaacctgatttaattaggcctaaaaagttttatttgttacctgttagtcaccatattttaacccttctttggccatatgtagaattagctgctgtccctctaccaaccttaagagatatgaaagtggggaaatggaaactcatcccaagaggacagttgaggttcatttgatgaaggagacagaaagctttgggttaaagattaagtgatccctttgcaaattaattcttatactaaggtactgtgaacatgggtcagttttcaagggtttctttaggtttaataccataatactaagatttcagtagcatgattattgagcaacataaatagtgtatacatttttccaagctgtttttttaattaagatattatgggccaggcatggtggctcacgcctgtaatcccagcactttggtaggctgaggcgggcggatcacgaggttaggaaatcgagaccatcctggctaacacggtgaaaacccgtctctactaaaaatacaaaaaattagccgggcgtagtggcaggcgcctgtagtcccagctactcaggaggctgaggcaggagaatggcatgaacccgggagccgagattgcgccactgcactctatcctgggtgacagagtgagactccatctcacaaaaaaaaaaaaaaaaaaagatactatgaacatttttactttccatgtacgcgtataatgttttttctgattatgtaacagtctatggagtggaagttccaattaatatactcctgacaagattagcaaggttggctatcagatgtatatttattgaagaaaatatttatttgacaccacttattggtttattctttatccttagatactttttaatgaaacaaaatctttctacattttgattgtcataggtgacttatttaagttgaaaaaaataacttcgctttttttttttttttacaaattgctggagttgtacatcgatgagttaaagcttataattttaaatattaataattaagaatagagcaagtgctgctgccatttattcaaaaagaggcaagagatgttaaaatgaaatcgataaatgtatttgttgaaaattaccagaataaataggaaaaaaattttaatattttgaatgaaaaggctagaatatgacatattctaaatcccattgtattttacttctctgaaaattattttaagattatacatttctatataattatttttacaaaatatgatttaataacataaacaaaaataaaatataaacatgtattatttatgttaattttctctttattaatattttttcttctcctccagcttattattataaaaatcttcaaatatagaaaaattcaaaacatagaacagtaaacacctgtgtcacctctaagatttaacggctgttatattgtaggaaaataaaaacttatttgctgtatgaatatatgaagtactgaaatagaataaaaacatacaaagtagtataaacacacttttatttctgtaccacattattgatattgtattgatacattgttatatttttgaagaatcacaataaactctagattggagaaatactcactcatagactcaggccctggaaactaggagagtccagtgcaatcgtttttgttatgactcgttctcttttatttttctcctttctttttaaatcttctttgtctttctatctgacagaagaataaaatttagcaaaataattattcactaaagaaatatctaaatgaatattggttacataccaaagatcgaataattgcattctataatagggaagtctgttgtctttgtggttggttggtcttgtgttatacagttcatgaatacataaataaaattcgtgtgtcttttgcaaattactcttttattgtgttccttggaaataaatcactataactaacatgtattgagtactgaatgccttttttctttttgtaatagactggagtgaatttagttctgcatggtaagaacttagtatatgtagtaagtcaattttaacttactggtaagtgacattttaatgaaacatttttaaatgggcagatctagtgttgccagataagctgaagcatgctcagttagatttgaattcagatgtacaatgaataattaccttaatataaatgtgtcctaaatattgcataggacatacttatactaaaataattactcattgttcatctgaaattcagatataagtggatgttctgtattttgctttgctaaatctctcaaccctagcagaatgtgatatgttagatgtttggtcatctagggttttgtttcatatactttttttgtctttttattttatgccagaatcatgatttagacaaaatattttgcaagttttagctacctatctgaaatgttggaagcaaaccaatcaacaaacttggcaccgtcactgaggaagagagaaaagtgaggtatattaagttactcaaccatattttttattttatttttactcattgattataattttttctctaagtataccaattatataaactcaattataagaacaaacaagtgaaacaaaacaaaataaaccaaaaaataagcacacctaaaaaacacagaatgctacaaacacactacctcatattaaatgtattgccctccagaatcagcctctgttctctgaaaaacactgacctgggtcttaggaaatcttaccccccatcctggtgttgtccttatgagctctctggcatgagcaagtatcttagtctcctaggattctggttctcatctgtcaattaaagggtttgaaagattgatatctgaggtcatttccagacctgaggttagagtagcccatgatttcagcttcaagttcctggacaataattatgtatccatagcactcatgagccctgtacttgtttaattaatctgtgtttgcttgttttttaaactgcaccatttctatgtcttcattcttctttattgaaatggatttagttttcatcttaataggtgtaatgatgttattcatgcaaagcaataattcaaaattaaatccaaaggaaatcttttagcagtattcacattaagatgctggatgtgccctttaaataaagtcagcatttctccctaatgattttgaggctcattctaaaagtttaatgccagaataaaatggtattttccttgggaagaacaattttggtggtcccattgtagagcaatctttttaagagaattgcagaaggtaaaaagaaatgtacatagatcgtgataattttaggcattaggacagtgctacataagacagatgctttctaccgtaatttataaacatacgctttaggacatgtaatttttcccatttgtattacggggtactttaagtgtagttgtaatactttagagttatttcagacaacaaaaaaacccttagagatcatctatccaactttctgtctctgtctctgtcgctctctctctctctctctctctctctctctctctctctttttaagaagaaactcagtcccagtgcactaggtgactggtacaggggaaagtaacttagggaagaaaaggaagcatcctgtaggtactttgcaggcatagctgatgttgtatcataggcactctatgggctggcccagccccagaattcctgctataaaaggattgaaagtgatagtgtggtcctgggatggaggagggagggaacttgtctgagatgtgcctgggaggtagggtggagtgggagacttgtctggaagctaaatttgcatttcaagttcattatttttgctcaggttgtctaaatgtggtaccttgatgggagagccagggaagtggggaggagctgatggaaatcacagaggggctaaatgcttcccatgccacttcttggctatgacaccttagccaagatatttttttcccaactgtacagatgataaccctgaggctaaaaagcatttctttgatttgctgaaagttacagaataatgggtaggattcaaactcaggtctgtcaagccagaaaatctatatgtgtgatgcattataccatgctgatggaataaacatgacctcaacaactttgaaaccttccttgaaaagagacacaaaccttcaggaccatacgtgattgtgtttgctacatgtagacacacatccttctgaacatagtaattcaaattaaatttcttaaaagtcattgaaaaatgtatagctagagttatgtctctatgtgcaaattaattgctagaagaaagtaaaacataattaaaattgaatataaagcctattacattaaagtaatgaattatttattttaaaatatccacattgacccagttccattggttggttttaaaatagcaacatgtttttctcctgagaaaagcgtttctgtataaatacattcattctccctcccttacaggctctttcttgactgaacaaaagtaatttatgctttttttttcttacttagaagttttcataatcaaagggagtctctaaagcatgtaataggacggtagatatgaaggttgatagatatgtttcatcagtttcaagcacataaacagttcaacccccaatatacaaatgttataaccaacagtataatttttagcaattcatgtagatttgatgccagacctggctgcaaggtagtgtggagtaaacaaagcaaaggccctggagttctgagtttgtcagatcctcagtgtcattgctaactgcttaggctttaagcatcttgccaactctaaattctactctacattcttgccaactctaactgaattcagcttctgaattcaactcaaaattaaatttctaattaggattagaaaattctaaattctttgaccggatttataaaatcaaatataaaaaacatatatatatgtttttttgagacgggctctcactctgtcacgcaggctgaaatacagtggtgtggtcatggttcactgcagcctccaactcctggattcaagtgatccttctgtctcagcctaccaagtaactgggacaacaggcaggtgccactgtgctcagctaattttttaaaatttttgtagagatggggtcatgctatgttgcccagattagtcttgaacttgctttttaagcagtcctcccacctctgtctcccaaattgctgggattacaggcatgagccaccacatctggccaaatattgtatataatacatgtttctggtagttcccagggacaatgaaagccttttattcccacagcagtggttctcacaatgtggtccctagaccaatagcatcaatatcacctgggaacttgttagaaatgcagattctcagcctccatcctaaacttgctatatcagaaatcctgaggacaaggtcagcaacttcggttttaggaaattctccaggtgattgggaactaccgttttacactatgatattaaagggcgatttcaaagaatagggtaattcccagattattatactgagagcttcacaactcaatctctgccttgactgtatcacgaagaatccttaaacagaagagagtgagccacaatggatggttgtggaagtgaacaaccaaggcaggtggtactgccatttcctgatagaacactttccaatcccgcgtctcccacctctgggtttccatcttcctgtatctattttcataatgagtgttcatctaagcattccaaataagttcatactggataattatggatgagaaataaattggcaaccagaaaaataggaaatcatccctaaacaatgcctattgataaatatctggaaatttttctgggaagcataggtatgctgtttcacaatataagacatgaaagaatgttcccagaagggtaggagtggctggactgaaattgaagtagtaatttgaggtgtcacagtggacacctcaaggtcatggcattttatttattgttgcaattataagaacaataaaactgcaacaggcagcagggtccatgcagtttcaccagccttccacacgataccgttccccctcatcagcacttctgatttccagaggctcgaatccactaagcagcctcagcaagcacacacattaatatatttgcccaagacagaacagtttttgagctggcagttgttgataaagacatgtcacccctggttttgttctttactgaaaggcctccgaataggaatggtgaaattctttttatcacctccacatgggttgtcttcttggcacaaatgaagagaccggagcctgcaatcattcctcaactcctaaaacaaaggaaggtggattccattattctaagggccctggggattggacatcttcagaagcattcaagaaataaggaagctgcatgttaaaaggcctcagtgctgattaaaagtaggaacaaagctaggtgctcttgcatttatcacatgtattaattgtactgctatctttggcttgcagaataggatgttataaagaatgcagtgaccattttggcatgttgaaaatcccattattcatatgattaagaaacaaaagtgaagtcgccaagcactgggttatgcccatctaaagatttgttgatggaatgaaatttatcttttattcatactccaacaacttctgaataataatttctagtgctgctcttcggtgcgtttctggtggttctgagctttattatgatcgtttccatcctaagatatacttctctttttagtatttttataaaatttgataaaaagaaaccagtggaagtgatcatgtcacctcttgtttataatgcttaagtggagttttctttgtatagtcagcaaaggatggataatctcactactgcttgttcctgcaacctcagtgcatgctgttcaccccttgccctctgagttctgaactgactaccctcctctgagatgctcaaaggccactgatatggtttggccatgtccccacccaaatctcatcttgaattttagctcccataattctcacatattgtaggagggacccagtcggacataattgaatcctgggggtggtttccatcatactattcttgtggtagtgaataagtctcacgagatctgatggttttataagattaaacccctttttgcgtagctctcattttctcttatctgccaccaagtaatatgtgccttttgccttctgtcatggttgtgaagcctccccagccatgtggaattgtgagtccattaaatctctttttctttataaattacccagtcttgggtatgtctctatcagcagcatgaaaatgggctaatacagccccaagctcctttccactcatcattttgcacatgttgattagtcaccagggatagtctttcactttgcctgggaaatcccactcatcttttttttttttttttttttttttgagagggagtgtcactctgttgcccaggctggggtgcaatgacaccatctcagctcactgcaacctccacctcccaggttcaagcaattcttgtgcctcagtctcccaaatagcagggactacaggtgcacactaccatgcctggctaatttttgtatttttaatagagacagggtttcaccatgttggccaggctagtctcaaactcctgacctcaagtgatatgcccaccttggcctcccaaagtgctgggattacaggcatgagccaccatgccaggccccacttacccttcttctcacaactcttacaaatctcattctggagagcctgcctctggctcccatgctagatcacgaccccagtcatatgctttcaaggcatcttagagttttgccttagagtaattatttgattaatgcctgtctcccaacatagaggccataattttttcatcattttatccctagcacttagtagagtgccagcctggcatattgtgggcaataatagccatcaaatgttttgagcagggaataatatggttggatatgtcttagaaaaataacccttgtaagtttggaggtcaaattggggagtggaacgattaataatagagacttcttatagggaactattgcagttttccacgaaggaaaaagaaaaacaacttaaaaaaactacctaaactatcaattttatcatccattcacccatttgctgaacatttactgagtgcctacaatgtacatgtcagatactgggctgggtgctgagacaataaaggactctatttggaaaatgaaaggaaggggatagattttaaaggggtctaggggtagaatcaataggacccactaaacaatttgagatgtaaaagacgggcttcaaaaggaatctaagatttcttgctcaatgaccaaatagagggtgattctattaacccctttttagaacttcaggaagagtagcaagtcagaacaaaaggtggagagctcaagttgaacatgtggagtttgagatgctcatcagatttccagatgaatcaactggttcaatcacagtttttgaaatgaagcatcattgttcagtgcaaatcttccaggggaattcaaatgttagatacagagaagtagagactgagaagagagcaaggcccatttaaaaatataaaagtttagttttaaaaatgctgtctttttgacctttacaatgtgcatattttgaatgagagtaagcaaaaacaattgatttttttgtaaagaaatgctgaagaaatacattcatcaatactgtagtttgaatataaagaaaatcagaatatttataaataggaatataaataatatagcactcttattggatagcaatggattaaatgggtatttgctactctactgcttttttttgagctgattataattatatgaaatatattttagggcatgcaattataactgtatgggcatacctaataaataatatgtctatatcgcataaagtataaattataaatatatatgaactatataaaaatatactttagtcacttaaaacacataatagaacattttattctgttttttcatctttttttctgagtacgtaactcttgcacttgtccctttcaggcaatgcttaagaatgtatgtaaccaacaaatacaatgataaatgtcttttgcagcaagcttcaaaatctcaagagatgtaggggcagcataaaactctaaccagataaatccatggtatattgtctgagccaaatgctttctctaaaatgagagagattcaaatcagtgacaagaaggagcatgtggggcttaagctgactgtaggaggacacaggtgtgcttcagcaccacaaatgaacgcagaattatctaagaacaccttgccttgccagctatttaatatcacatgaaacgggccaagaatgcagtgatattgaaacaccaatgccagtattgtttttcctgtgtctattccagcaattgcttctttgttattgttgttcaatgaggtgttatttcaatactgaagtagaattcattaaagtaaggtttgagtggagatattttcactggttgattggttaaactgaggtttctttttgcctctctagttatccagtgtattgacagccatattttaacaagaaaaaaattttgacttcacacattcactcagtaaataactacttagaaggttcttgagccgggcacggtggctcatgcctgttatcccagcactttgggaggccaaggcaggtggatcatgaggtcaggagatcgagaccatcctggctaacacggtgaaactctgtctctactaaaaaatacaaaaaattagccaggcatggtggcaggcgcctgtagtcccagctacttgggagactgaggcaggagaatggcgtgaacccgggaggcggagcttgaagtgagccaagatcgtgccactgcactccagcctgggcgacagagcgagactccatctcaaaaaacaaagaaggtacttgatggacaacactctctagacttaggtagagcgataaagtgatgaccaacttacagctgaaggggaattccacatgttgggcatagagaagagtaggtaaaggtatagggatgacagagaccatggttgctcagataatgacaaacagctgagcatggctgggtgcatgaactaaaatattgcttgaatgtggggaagtaggatggtgggttgcataactggtaaggagcaaaccgtgactagccttaaatgtcaatctacagagttaagatttccaaattcattaggacatgtatcctacagtgtgcaaggatttttactaaaggaatgacatggccagatttgccatttggaaagctgaccccggccatcgtgtggaggatagtttggatggtgaggcaaggaatcagaagagaaggaagtgtggccaaggaagagactcttgtagcaattcaaatgagaatactgaacactgaaccaaggacaagactttgaatgtggaagcaggggaaccacataagacaaatctcaaacttggatgctggggatgaaggataagggaaaatcccaggtcaattgggttgatggagtgtatattggtttgctaaggcttctgtaacaaagtgcacaaattgagcagcttaaacaatagaaacaatagaaatgtactgcctcacagtactggaggctggcagtctaaactcaaggtatcggcagggttccttctttttgagggctgtgagaatagagtcggttccatcactttctcctgacttctggcagtttgttgacagtctttcatatcccttcgttctagaagcatcagcccaatctcctgccttcatcttcactgtgagttctccctgtgtgcacatctgtatccaaatttctccttttctagagatgccgttcatattggactagaggcccaccttactgtatcatgacttcatcataagtaattacatcagtggtgagaccctatttgcaaatcaggtcacattctgaggtactgtggtttaggtcttcaaggcagggatttttagagatacaattcaatccacaacagggtactactcgtggaaacagagaatacacaaagataaaccagtgtttgtgggaggaaattattaatgcatcattggttatgctgagtttgaggtactaagggttcatgcaaatagcaaatatttctgggactggacttaaacaattctagaacatagaaaccagcatctctcaaaaaagagaggccttgggtacactgcctactataatctcttttatttgtcttttttgaatttaaaaagtatttaaattatattagcagaggaacagaaatttagatattgcctggaaattttaaaaatcagaaggaaagggccaagtagaaaaaataggagactcttcccagatgaatttcaacagcttggtattcgtgtgatgagttgtgattaacaggcaagcaggccaaacgtggttaatagagctgggtctttgagttttctttagaaaatgttgattctataatataagtgacacatctccatacgccccaaagcagcatctggtttgatattgaggtttcacctaacagttttcttcagaaaactggaacatttggccaatttcttaatatattaattttaatagattttctgtttctaatgaaaacattcttgtgaaaacatttgtttttcatatgcataactccttattgcccaatatacataggaccttatatatggtagatgctaaatacatccagttgctggatgactgttgtgtaaatgtttgggacacaacctttgaaaagaatctcaatagcccataactccatgtagcatacaggcgctcatataatgctctcccttccccactacaccacatgggaatgttatggttgctaagaagcacaaatgatgccaccaaataagtctaacttgggtgccaagtctgttcttccagtggtatgggcactatctttaggcagaggcatccagtaacagttggaaagaaacccgtgtgactgcgacctgtacaatgcatgcaggtgacagtcttctctgtgcctctaaatgtgacaggcatcttggggttatacaaaaaaaagtatatcagatagtgccttctatggagacagtcaaaagctaagattgttggagtcagatcgacatcttcatatcccagctcagccagctctcgggctgtgtgaccctgagtgagtcaggagctttctcaggttcaacttctttataatgtggaaattgtaataacattaccttttagggttattgtgagcacaatgattgtatagagattaaggcacataaagaagttcacaatagtagatatggttgtcaaaattatcatcataattataccagagacctgaggttcctgtgtacttcatgaatctattaagaaaccattccagaaagtaggaccagtgggagatgaccataatagccatcgatattgcaaatggagaggggcaaatatgggtgcttctgtgatctgggaggggccttggaaggaggtaaggcttcagtggccttcaaagatagagtcttaaaagaagattgaaaggacagaataaaaatgtactgtctgaactccactatttcaaacacttgactgatctttgacttctctgaaacctgttccttaacacaatttctgaagaaggattggttctcacaatatttactattgtaagcttcatcaaacagccaagtgatttctttaaaaataggggttttgacctttgcctttccctggctgggaacttaatcatcattctttggccataataggccaactctatttgtgggcctaggacttgatattggagatcacgtgacatccttgtccacgtcctacgcagcacaacttgtcaaaccagagcagatggctcttccgagtctaccccactggcagagggtgaggacgtgggaaatgaagaggtcctttacagcctgggcttctgggttgctatgcctgtcaagcagcaaattatgataaaaagggccatgcaaaatttaacatttttttaatctcttgagaactgactacaatgtttactcttttctggagcttcccggaatgttttatataaaacttttgctactaaaatcctttggagttttagaatgatgatgggaagtatagcagagtttaagttttggtttgagtccactaaaccaggttcaaatgtatcagttgtgtgtccctgagcatgttacttaacttttctaagtgtcagtttcctcatctgttcaagaggaatggataataaggccctactcgtaagattatagtgaatattaaggatacagttgtatactgcaaaaggcttttgatacatgatagaataggccctcaataaactctagttattgttattttaatggtgccacacacaggtgatcaaggtttcagtgccacaaccattgaaagcttggagtcccaatgccagtaatgtcatttttaaattttcaagtcatgacagcagaatggtgagatgttctgctacagagaatagaaacttttagaaatggtttccttccaagcaatgaggtaaacctcctcttaaaaaaaaaaaaaatcttagttttccattgttacaatttcaagcagtggcttaaaacagtaagcacttgcaaattatgtggctaaacacagtaggcactttttggcatgtgaatctatgggactatagttcaggccaaatggctctgctagcctcagctgtgtctggaagtcagctggtcattgactgactaaggctaggtctggccaggccaactatatttgtttcacctgtcttttatccgtttccctgggacaagccagcctgcctggacatgttcttctcatggtagaggtataagatagagcaagtccccaaagcaatcacccaaatgctttgctagactgcttacatcacatctgctagcatctcattggccaaagcaagtcacatggctgagcacagcatcaaggggcaggggaggtgactctcacactgtggggaagtacagtaaagtccctgagggaaaggatgtggatacagagtcggggaagaagagggagcatcatgtgatctacctcagctttagagtaaccgatagccaaggggccatcacctcacagcgtctagactctgggaaacagacttttgccctagtattgattctttgcctggagtcgtatcatttgctttagtacctggctatggcgttaataataatagcacagcagaaaggttcagtgattcttgtatagctacagactgagctttataaaataacctggatgcttattttaagaatatagactctgacagtagcaagaatttttctcaattgttttgaaaaggttctcacctattgaacagctaggatgaggagggttgattagaattttcagtgcatgctctgaattatgccatggagacatgtgcaagactaatttgtttgtagcaacagagaagccaatcatgattagatttcctggcatgttattcacctgcgaggagagtcagacttgtgtccaagaatctcaatgtgaatttggtcataactacatccatacagtgctggagggtttgataagctctaggtgtccaagcatgctcttctagaacttaactgacttctgcatgcacgccagccttcctagtgtaacttagggcagagctatgttttacttagttgctattgtctttgtattttatttaattattattaggtaaataacagctatctggaagtgaaaaagtcaaccatgatggctgatttttagagaaaatatatcttgcttttaccctctgacttctagcccttcagttccttggggaaatacttgaactcactgagcagcggtggggtcacagtctgggcttgtatgccctcatttccaggccgcattcctcagaggggccctgagtactttgggagctgatagagtttggctgtcatttgaaaatgttttcctgctaaatgttttcatttagaagctaatttatactctgctttcaagtaagcttaactccatttcacatccctgacatgtagcacacactgcagtgactgggatggaagtagacaattcaatcaaaggatgatttctccgtggaggaaatgaatattatttgttcatcttgcaattcagaattctgagaaaattatgatgtttggcaaaggcactggcaagacagaaagacaaataaattgcatggtgtgagaacagccttcttaatatgaaggtttccttaaaacagtgggtattggctgcaggcaaaatattaagctgcaaatcactggtttgcaacttcttgatcatcggttgtaatcccaagaacatatttaatttcatatttagtcctaatttctttttgttccgtaatgatatttctgtcactcaaaataagccatctgttggcagcagcccacaggaaacagatactgcacactcagtaatcttggagtgagtctgttgcattgtgagaatgaaaaacgggcctcttcagaatcatagggtcacctttaaaattcctaatttttctttttgtcttctctttggccatatgtagtagtggaaataaatcttgtttcattgtcttttctgagatgtttgtgaccagaggtcagtgctttggactcgaggattagagagtttccagctctgcttggagatgcatttcccatttttttaaccctctatttaatcaatacctagctttgccatattttcaagaaaaaatatacctggaagtattgaccagaaatcaagcctatggcaaaagaatgccttccatttgaaggttatgagatggagggcaggatgtaagacagggagcaccatgatgtgaggagtgggcagaatttgataaattgacattatctccatctagtctttgaccacgcgtatttgaacagaattccaaatggaaagaagagacagctgggcacgatggctcatgcctgtcatcccagcactttgggaggacaaggtggatcacctgaggtcaggagttcaagaccagcccgaccaacatggtgaaaccccgtctaaaaatacaaaattagccaagcgtggtgatgcatgcctgcaatctcagctacttgggaggctgaggcaggagaattgcttgaacctgggaagcggaggttgcagtgaaccgagattgcaccattgcactccagcctgggcaacaagagcaaaactccatctcaaaaaaaagagactctgaccatgacttcacatgatagctaacacttcttgaacgtctgcagagactgtgctaaatgactgtaaatggattttctcctttattcctctcaacaaccccagcaagtttctcataatattatttgcattgtaaggatgagaaaacagtctcagagctccatagctattaagtgatagaatcttgatgtgacagccagggcagcttgatttcaagatatctcaatactgaagttaaaacttggaatgggttaaaaatgaagttgttctatccatcatgcctgcagaaaacctcctaagaataaagaaaataattcagattcacataaaagaaaatgttagagatattgaaatggacactcaaagcacatcaatgcaaaggtgagggagacagaggagcttttgatcttcccttttgttccctcatgttttgaaacatgcttccttttgatgccagctctttagaggttgctgcactcaagctttagatgactcttctatctcccagagcaattaaaaggtaatgtcactattttaccacgtgacgcttgacatctgattcatatatcactcagcctgaaggcatatttttcatactcacttgggtgcatgtcaagcagtgaattgatctcttttaggattcaaaaggaatccccttttccaaaggagattctggtgagtgaacaaaatgaatgtccctattacttcccatctcctttaattagcaagccagagagctaacaattatctcacctgtcagctctcttgacagcttgctgttgaatcggaaccaaagagagatcacctgccccaatttcaaaccccagcaattgatatcaaagtctccaccacccaaggtctacttaaagcccattagtgtggccttcactatatttcagtttcagttacctcaaaccaatatctcagattattcctccttccatcatggatattctgactcataaatgtcagtacatggtggaggttgcctcatctcacaaatttccactgtcaaaatattctcagcagtactagacagatggaaccaatccagggagcaaaacaaatgctaccccagcttttggcgcactccaaatgtagcggtactagctgttcttatctcataatatgcctatcgccatcattttttcccctaacaatctgtccatgatgacaagttctattccatgttcttgatgagggatcatgtctctaagccatatgttgtaactggaagactagcccagttgttgcctttacgtttttaaataagtggaataataccgctcatattaccttccattatcttagtacttatctcagtctggttctgtatcctcatcatttccctgactgagaaaactaaagaataatgtgtaatgtgatcgcaaatttgtaagatggaataaagcatttagtcgttctcctctgccaaattttttgattcccattttcagaggatgatttgtctcctgccataagtggacatggtgccactgagcatgtagcaggaccgagcagctggccaagacagatggattcctgtgttgatctagtgaagtttcacctttgtaaatcttccttgctttctcatgcctattaagcgatcttcatctcagaacagcctctttgccctggttttaccctctctagtaattgtgtctcagtgaactgtggttttagtacaagtaccctatgaaagatgtttgcaactctggtcatagttgggaagtcaccacatactatgctttggattcatccaaataacccttctctcattgccatctatctatatccatttacttatccatccctatccccctcccttcctccatccattcatccatccaccatccatctgtccacctatctggtcatttaatatttcttttggaaacagttttggaacttagctttaccttgtgatctgattatatgaaattaatctagccttttctgatttatctaggaaagaccttctttttcagagttctaattaagggtttgaaatgccacagttaaaacatagtgattttaaaacatatcataaattctctaacactcctccctttgagaggaggagtctgtgttccctccccttgaatcggggccaaacttagagatgtgcttttttttgttttgttttgttttttgagatggaatctcactctgtcaccccaggctggagtgcagtggcgcactctcggctcactgcaacctccaccccaagggttcaagcgattcttctgcctcagcttcccgagtacctgggatttcaggcacctgccaccacgcctggctaatttttgtatttttagtagagatggggttttatcatcttggccaggctggtcctgaactcctgaccttgtgatccacccaccttggcctcccaaagtgctgggattacaggtgtgagccactgcacccggccagtgatgtgctttttactaatagaattaagcagaagtagggctatgaaattccaagctaggtcagtaaaggccatactatccttggttctcatgagttaccttccttgggggaagtcagccaccatgtaaaacgttatactactctgagaccaccatgcaggagaagagatacatagactctctgaccaactgtccagctgagctcccagccaatagccagcatcaactctcagtccgggatgtgagccatcttggacatccagatcagtcaagcctcaaaggatttcagctccagctgacttcttacttcatcctcatgagaaaccccaggcaaaaactgcccagtcaagcccttcagactacaactgggccctgaatccatcatcctcaaaattgtaagatagtaagatagttgttgtaactgctaagttttgggttaatttgttatgcagcaataatagcagaaataaaaacaatatatgactgagttacttagcacttcaagggaaagcctaccattttgttttatagaaatgggctaattcttcttctagttttcacctttctgttttaaactatagcttgtcttgcaagctttgctgctagagattgaggtagaaatggatctagaaactatggctgtatgtcaatttcatttcctcaaaggatcatatattttatgcagatatggagagaatatctaagctgcaagagtttggaggtgaatagaagaaaaatagaagattttgtaggttatccacatcaatctatatactcctagtttaggttctcatattgtgttatataccaaatgtatacatctcttgatgactggatactttgtgaggccttctgttagtctttggataatgtataattcaacacagacagaggttttattttgacccttaagtctcacctccagggagggaagagaagccttcacattgctgtcacaattctccagatggtcctaaaaggagctcacttttcttgtctgccccagtcccagtcgtcatatcctataatcgaagcagcttcctcttgcatcttcctaaattaccacttagcatattccctgactgtgggcatattcagtcagggaacatgttaactcaaaccaaatattgtctgtgcattttctatctatgtgcatatcaaccttttttttttcagcgctatctgaacattaagcattaagtttgcgacattgctgcttcattccaaatgcgacatatataccctaagaaaaaggacattttcttatataagcacaagagcagtatcatactcaagaaacttggcattaatacagtaatatatctaacattcagtttatattcagatttccccagttgacccaatgatgttttctggttttgtttttgttaatagagtatctttattaatacagtatctaatgcatcacatttacttgtcagatctctttatcatcctgtaatctagaaaagtttctccatctattttggagtggtgtttggtaaaattaacatttttagagaattcatacccactgttttattatttaaaataagaaatatttaaataaatatttaaaataagaaatatttaaataaatatttaaaataagaaatatttaaataaatatttaaaataagaaatatttattattcagataaaaatgtgtcttattatttcttcctgattaaattcagattatgaatttggggtaggaatatttatagatgatattattcctttccagtatatcccatcaggagatacttatcatcagttagtcccattatttgtaattaaaagtttgattccgttaccaggatggtgtcctccatattttttattgtatcacttttttattccatattttttcattttaatagtttatgagcaatcaagaagtgacactctgacactgtgcaaatattcagttccccaaccagttttcatactatggttttcacatccactgatgagtctcacctgagtcaaccattatattgatggctgcaaactgatgaccttctaatcctgttccctgccggggtagcacaacaggcactgggctaaatgattgtacatggattttctcctttattcctctcaacaaccccagcaatttctcataatattatttgcattgtaaggatgagaaaacagtctcagagctccatagctattaaatatcagaatcttgatgtgacagccagggcagcttgatttcaaggtatctcaatactgaagtgaaaatttggaatgggttaaaaatgaagctgttttatccagcgtgcctgcagaaaacctcttaagaataaagaaaataattcagattcacttaaaagaaagtgttagagatactgaaatgtcctatgtccccattccatgtgggtgtagggaaggagataggcaatgtgaagccagggagggctgtggaggttcagctgctccatttataggctttcaacagatcgccctgttttcagccctaagccttacccctttgcttagggctactgggtatctccacttcagaatcctctacagagttccctggcaacagtcaacacactctgactacttctcagcaggctctcctatttcagttcttcttccttactatctgttatctctcatttaatatttaaaaaaaaaaaaaaactacatctcttgtcttttgtcacctcgtttttcattctctttgtgggcttttatttatttatttatcatattattattttaccataactttagtggactttcagaagggaccgaagagaaaaaacatgtactaaaacatgtgctcacgttttgtgtatgttggtatttttattcttcagttttacagatgcgtgccttacatttctactcacatcatgttgtttcatgtagcagaatattttcaggctgggcgcggtggctcacgcctgtaatctcaacactttgggaggccaaggcgggtgcatcaggagttagagaccagcctgggcaacatggcggaaccccgtctctacaaaaaataaaaacttagccggatgtgatggtgtgggcctgtggtcccagctgctttggaggctgaggcaggaggattagttgagcctgaggaggtcaaggctgcagtgagcggaactagcatccctgcactccagcctggcagacagagtgagaccctgcctcaaaaaaaaaaaaaaaaaagaatattttatttctgtgtaaacagattattattccttttttatttatgataattatataagcacttattactttcatataaggagaaaatcttcttcaaatttttatatgcatacatttttttcttcaaggaaatctatgattaagcctcttttataaaaaggtatgctttatgaattaattagagctagggaagttaggtaagtatatggagtaggaacacatgttttcctcccctcctcataggtttctagaagttcttctcttttttggaagacagaggaattatcactgccttgccagaagtagcatctgggcctttggtgtattcttcagcttgtttattgacagcttgtaaacgtgcatagatgttcacagtctttctttagttttcttgaccattctgaaatctttaaatgatcttttcctgtccatggcccttttagtcatcaccaaactagatctggtcctcagagaatcctgatttcttgaaaatctctcattattccgcaatactccaatctgctattaagtgaatactagaaacaaagtggtaggcactcaggatgttaggttttggggtgtttttgtttttaatgctgtatgtgaaggtgtgcatggcagttgataaggatgcctactctgtttcccttggcccagctgagtttacctgcagccttcatggacagttcccagataacacagacagcttccatgtcaaaaacctccatctcccactcctttcctggggacttctacagtgccatggtagttttactcagttctggtgaatagcagcctagaagtgacaagaatttaatgcctccaagggcatcccttaatcaatatgggagaagattcactgaataaataatctggtatctcagtccctcattggcactgttttaagaatgtcctatatgagtcctcagaaaaaatctgagcctcagttgcctacatgggttaccctctcgttaaaactcctcttattggatttctcccttctcagttgcctttcctatcacctcccctgttcttcctgggatcatcccaaataaactaactgaatccaagtctttgtctcagggtctgcttttgagggaactcaaactaagacaattacaaagactaaaaatttccagagaaagtgtaattatatgttgttggaaatttactctgctgaggggaagtgcacaggaaattattctttttagatctattaacaggcaactggtaaatttatgttataaataacatggtaatttactcaaaaatttctggaacccctactaggtgccaggctttctgctagggactgagaacacacgagtcgacaaaataaacataacccatccctctccatcatagagcttagattctaatggtgatatggacaaatcatgtcaattataattcagattggggcatgctatgctagaggaagtcccattactgcaggaatacatagggtcagaaagactgtgttcacccctgtttctcaacatctagcacaaaacctggcatatgatgggtatttgtttgtttatttgttcgagatagagtctcactctgtcacccaggctggaatgcagtggtggtgatagctcactgcaacctctgcctctggggcttgagcgatctcctacctcagcctcccaagtagctgggactacaggcacacaccaccatgcccagctaatttttgtaatttttagtagagttggggttccaccatgttgcccaggccagtcctgaactcctaagatcaagcgatccacctgcctcagcctcccaaaattccaggattacaggcatgctgggcacattgtggacgtgcccggccaccttgggtattttggaagtatttattgagtaaaagaagcatattcaagaatgagtttatattcaaagaattgcaaaaaaagatcaatgtcctacagaataaagcagatagaggcacggacaagaatcaggacttgtaggccgttgaatactgtttaggcctggagacttcatctgaagagttacagcagacaagaagcagagaaattttaggcattaggacagattcagtttagcagtttcacatggccactctgcagacactaggaagaatggatcaaagccagcaaaacagggatcagaaaaataagggagagggctatgctgtaatccacatgagaaataatggcaagaatggcaatggagatgtggaggcatggctggactggaaagagatgtaggagttagaatagatgaggcttagtacttatttggtatgagaagtggcatagagagagacagtgctaatattgcccacagttctgatcagcacagctaaatctggggctataggaggaagagtaaatctaatggtgaaggtgaagagagaggaatttgctccggtatagtgcttaaagaaggaaggcagttttggcagagttgttttgtattacatttctctctgcccacaaaggactctttatttatcaaaaagataaatctaaaatatgtcacttgaatatagctagataatttatagccttgtaaatctgaatggacttcaccttagataaaaacttggtatgttaacttttccatcaaataagtttcatatttttggctttagaacctatacatcatggtagtcctatttggccaaaaaaaaaaaaaaagaaatatcaaattatataatattcattttcttaaacaaaacatggttatataacttgtatgcttaggactattgtttgttggaatgatttaatgaactagattatggccctttaggtgcagtttattatttttaaatttcttcttttggaaatgtgaggaagggtaggaaggttaaatggaactgaagtagcaagctgggccatttaaggagggcatgagtttaaattctgaacgctgaataaaaatgtcctaaaataccttcatttggaaggaaatgactttagctgtttagccttggagggaataaacagctacatgcatactaatcttctgaaccctgtgctatgttcatagccttatcttttattcatttcaaaccatacaaatctttaagggagagaaacccctgcttcttgcagcattgcaactaaaatgcagatgctacatttctatcagtggaatttgagttattcttgattttataccttaggatatagcaaatctctaaagacagagtgtaaaggggtatgagtgtgtctattaatgggggaagaaggagtgtgtgaaggggatcccagtgggtgggtgaggagggagtgagaggcggccaggggtggaagcttacacaagagccaactgcagccctgtggtagagaagccctcctattctctgatatctatttcccaatcagaataatgaccaattccagtccctcttttggaatagggatgtggagagtcataatgggatttgaaagctgtcctgcttgtagactatcatttgaacttgacattttcacttgagtgccttcttcttgcaactagtttacggttttatcaatacagtttaatacacttttaaagccatacttctggcatgatctagcattttccaggaaaataaaagaggcacatactgtaactgttgatcatggggagtgatggatgggttctgccctctgctagtgcaaaacatatcactgaaagtctagaggaacaggtaaggggttgatagttgggacaatgaattttgaaagatactctgagcttatctcatttatctaaaaaatgacattagaaataaccagcacaacacggtgaaaccccatctctactaaaatacaaaaaattagctaggcacctgtagtcccagctactcgggaggctgaggcaggagaattgcttgaacctggaaggcggaggttgcagtgagccaagattgcgccactgcactccagcctgggtgacagactgagactccatctcaaaaaaaaaaaaaaaaaaaaaaaaaaggaaaagaaaagaaaaggaaagaaccataaattaactgggattgaaagtgtgtgtgacatttatatcatggcataatctccaaatgaagaacatgtttatttgatttggggatagcttactcaggattcgttgcctgatctttatttctctcaggtcctaaatgggactctttggaactcatgcattcctgacttattcagacctgcttctgaaccatgcttggctcagtaaagcagagaggcttagagaaggaaaattaaaatgggtcatatgcatctgtgtcctctttgaggcatgtcacaaaaacagccattctgggaacactgtaaacagttttacccatctgtctagtttaatctatttggggattaaaccttctggcttctcagagtacagggttgtgtgagaggctcgttcatttatgatatgtgtttctggaatgctggttacaccaatataaatgatggatttagggcactgtgtttacttaaagaatcatggatctcttgatttatactaagacatctggttttttttttcccaaaatctttgcttaaactgaagctgtttatccactgataaaataacctctgtgtattcatggtgcccagttgttggtaactagcaattatatactactttctaaaatagttttggttaaatggcatgcatgatttgtagtaatgaagttcttcaatgataaaaatattggaagagacccatttgaattttagctcttatatgttacaatgtacttcacactggctgtgtgcttagtattcatgttttagaaaataagaaaagcatttgggagatattaccaaaaagaatcactgcctctgtttctgtttatcctgtgattacagttttcttattaagaacaaatgtgggtataaactcaatacattgtgggattcctctctggtcaatggaccctcactgtgttctgacttctctctctttcttgattgatggtaatttgctacagtgaacttgaatccagacttcagtgtaagattgatgtgtgttaggaaaaagggaagaactcttgcccttagaatcagtttccaactttatttactgtttggggctttttccatgaatttcaattttacctatctaggacccatattagcttgaccattgcaagtagggagggctccaatcagtcatacagccatggattgatgagtcatacaatcataattaaagaggaattggcagcaacataaaattcatatgcaaataattgtgctgattcatcattgcagtaaaattcacttctctgcatttcttcattcaaaaagccacattcaacggggcactccattttaagtaggcaaatttggagattccttaaaaaaaaaaaaaaaatgttttccttaggaacaattctgtttagtaaaatttagcccaggctataaaatacaggctaggacaagatacgggttaggacctctactttctcttcattctttgattaggtagttttacagttcctgattctattacttagatataacatgtagaagaatatctacacttcagatgcagagagagaaaaaaataaaaggggtaccccacaagaagaaacagcaaacacacacaccaaagacaagaaatgtaagcataatcttttgttttttcccctgacacacagatttagcaagcttaccattggccccttgggtcatccccaaaccagagctttaaaaatctgtggttacctgagaccctagagctaagtcagacattctaggacctaagccaaagggccaatagaaactttagcccaagtaatggtcacacatgtttactatagagagcaaactgaattggtctcagagtttatctttctgaactcatgatggaacacagagagtacagaagggggaattgggcttaatttggtgcagctgttagaatatcccctggtctctgagctatttgtttgtcttactgaactccagcagattaccattgtcgggcaatctggcacattttgctcctttgttcatccccagccatgttatgtaggagtcatcaacttccccctcataaagacgaccactcagaaagcactttcaactgggacaaactcacatagtaataatctaatgtgtggctactatatgttaggcactgtaatacgctttactcaaatctcaatcaatctctacccaattctatgtggtaagcataactaagatataaaaagatgacaagagtcagaaatcaggtaagacactcagggtttctctactatcgtgtcaatggaaattcattagatcctggcccaaagcaatcaagcccatcttgggctgcccgtgtactttggctctagccagactatgagcacttcaccaccactaaagacctcagtggccattccattctgattatcctgctgacttcttgcctactgtgctctcttcaggaccactctgccccagctgccaaactttcaatctgtggcctgagccaccccagcaccttccctcctgcactgaaatcctcaggcatttctattaggttgttgcaaaagtaatagcgggttttgctattactttcaatggcaaaaaacacaattacttttgcaccaacctaatgctttgtcccacactggcctgcagagaacagcctctaaaacacttgccaaaggtgctggggttcccccaacccacatcttggtgaaggggctcattttggctacattgaaacgtggtttcatatgtttcatatgaaaccagtgtgttattatttttccccctttcccttatcttttagtggcctcaccagaatttgaaaagttatattcctttgataacataactcttcctcccattggctgagctcaagaagtgttggttaggaaagaaaacttcaggcagcccactgaattctaactctgtgtctgaaattctttcctacattaaaaatgttactgaagccctgatagtatcatttctttgatatgtgtatatgtatttcttataaagaaaagattagtttaagtgactatcaaaattaaacattttgttgaattattgcaaaactctgactgaaccatttagttatgctactaggatcacattttcctttttgtataatgcattaaagattctcactttgggaggccgagacgggcggatcacgaggtcaggagatcgagaccatcctagctaacatggtgaaaccccgtctctactaaaaatacaaaaattagctgggcatggtggcgcacgcctgtagtcccagctacacgggaggctgaggcaggagaatggcgtgaacccgggaggtggagcttgcagtgagtcgagatcgcgccactgcactccagcctgggcgacagagcgaaactccgtctcaaaaaaaaaaaaaaaaaaaaaaaaaagattctcaggctgactatcacatgtgtggatgaaggtaagagcctagaacaattagataacaagagtgaataaaatattaaataaagaatagtcatgattaaatcaatctctggagtaggatcactaaatgcatcaaacaaatgttagttgagtaaaatagaatcattgttatttttgagtttaaatattgaaatcgcaatcttatttaagaccaaagtaggtttacatttgctccatctcctcacccatttcccatattcttgccaccccataaaatgagaacttctgtcaacccttggaagaattgaggacaaagagctgaattctctccattgttctctgacttctctcatgggaagagagatgacgggttgagtggcaagagcctgacaaccattggtccatgttcttctgctgagtaaaatcagtgcattaagcatcactgcgcatgtacagtcactcttcttgggctcacagtggtcaataaggggtgaggagatggaattttctatgaagttctctgcctgtctgtcctgaaaacccaattctcaacaatctataggtccaagttataaacatggagtcaatggatagaaagacttctgaccttgtgttcaagctacattttgcaatccagtcttccaaattagaaggctgatgttttcatctctgactcttgcacatatttttaattcatccatggtttggaagttagagagttatgatggtttattattctcaaactgcaatactttttatttagttcatcaaaattaaagacaccacagccataatccatgtcactttctgcctcaaatctcaagattttgaccaaaacatatggctatggtggtctcttctagtttaaaagggcaaccatgttttcctatcattttatgcctgttcgcctatttgtggctggctaaagaattgtgaaagtaagagacattgtgttggagtaaaattaggagacccaaatttgactcccatctctaccagttaactacctgaggaaatttaggtgagtttcttaatctctgtactactcaggtcactcatttgtaaaataagaagaataaaaattactttgtaaaattatagtatattatctgaatatgataagatgataaaacaattattaaaaagaaaagatgtaatgctagtgctagatgctggggggattttgccattgaaaaataacctggaaataagtcaagactgatcatgggctgagttcaatgactcatgcctataatcccagcatttgagaggctgaggtaggcaagataacttgaggtcaggagtttgagaccagcctggccaacatggttaaaacctcacctccactaaaaatacaaaattagccagtcatggtggtgtgtgcctgtaatcccagtgactcgggaggctgaggcaggagaatcacttgaatctggaaggcagaggttgcagcaggactagattgcaccactgcactccagcctgggccacagggcataacaaagtctcaaaaaaaaaaaaaaaaaaaaaaaaaaaaagactgatcatagtctttctgtataggtcaatttttttttccattcttggacacataattttgctttaggtggtctggtttatgtctaaaacagaaggggaatgggttgagtaaaggggaaagaataaactaaatgatcaaagtcaacttgtttccagatgtctagatctaaaaggccacaaaagagctcttacttaaattatttgcccaaacaaaggagaaattttaaagatcccaagaggatgtggcattaagacagacactgtgatactcttggtgtagtcagggaacatcagaagctcatacttcctgacatggaggcagtgagtattgtaagagaacgctactcaatgacatcattcatggtcttttcacagccttcacctcctttgcctcaatatccttattcttcaaagtgttggtaaattgggcttgctgtcattacgcattttattggaataagcatgaattatgcaattagctttctcgctttccagcagcatatgcaaagtgaaccagaaagataagagaaaatcttttcctcaggatctgtagattagttcagcttttggaattttgctggcaatttgtagtgatgttgtcattttgactactcaacagctaagtttcacattttgggctgaatctggctgggtagggtggttacttgctttgatgttcttggagattctctatgttgcttggtactactaggctaaaatgtaatactgttctgtctgtgctacctaaaaccagtatgtttggggcctcatctgccttcagtagggtattttcctttatccttcgtgaaaatcaatttttttttaaatgaatgaatgagagagatgaaatgagaaggagaaaaatggttagggtagattttttaagcagtgcctttggcttttgttattttatgctaagttatttatcagtaattatcattagacaagctatactggggtgaaaagctgctgctttttcttccgtagccatgtgaaccctggggcgtgccgagggaattaaaataagaacagagcacactgctgttttatctcagctactgcaacatctctgcttgacaccctgtgttgaacaagagactatttagtagatctcaacaattatgcatgtactttcctggcagagaactctttgctgctttgtttgtcaagattatgttgaatcagcataaaaatcaggcctgacttatttctggaaggaagcagcctctctcgtaccattggaaacaatatgatcataataaagttttgcatatagaacatttcttttgagtgtagacaacaacttattcttgtaaagaatttaacatttaagtctcatatttccatacttatttctattgggactgctgcctactgccccacccccatcccccaccagccagccttagtttttggtatatttctagctctgtccatcttggagcagctacgtgaggattttacagctgtctttgtttctgatggaatcctaacccttttgtgatgtggggccttcatataagtatgtgatgtggaaaatgaagcccatgtgtgaatacaaagttaattagtatgaaaagtcccattttccaccacatttcttgccagcagctatgattaggtgcacctaagctttccaggtctcctaatattttttaactaaatccaagcatagagattccaaaatatcccattctgtgataatatagatgcatgacagaaagggaatgaatattggaaggtaatgtttgtgtgtgtgtgttacaggcttgttggagttcatcactttactttctgtacataaaggtgatttgttctaaatgttttaagcagcagcagcagcaaactttctgaagtctttaatcattgggatgattacttagggcatgctttaatgaaggaccactttaaaaagtagctccagagtaaggctgaagtccaattgacattttctctatgtgttatctaatggaaatgatctccatggcagagatgaaaataagacctttgaattgtgttgagtaaaataagatgggtcagatggatttgggcaatttggggatgatccttagaaaggagatagttgcatctggatggagctagggagacccagtgacagagggagcctgggatcatcttatggtgcatgtcatgtttgtgtagaaacgtacagtttgagcagaatacaaagttatataggtctaagaaattacaaaagaaaaccaacagcttcccctttattcctgatgctatggctggcagacaaatggggtcttcgaaatatgtgtgtgcatgcagccatgcacaaatgcttattcgctgatgaggatgcagtgttgatgcccttaggaacagcatcacttgtggactgggtggtaacaaagaactagaaagatgtgcttctcatatcttgatatcaatgtctatcagagaagatggagaaagctgagagatactagtctagcttgctgtgcaacccccttcttctgtcccatcctccttcttatgaaagacttcctaaccctcctcctaaagcctctttttctctgtattttacacctggtccatgcccttaatatccagtccagtagagatgaatatgcctagttcctggtgtcctgcttttatggccttagaaagcctttctctaaacatctctactcttcatgcttgcattcaggcttcatgtgaaacttgcaaacattgagcataataagaaagaatacatagtaaaccatcttaaaagaaagactataaattattttggcactaaaactattaaaaagtatatttcactttagtagacagcagagaaaaatctcttttttaagtttaaaagaaaaatgcattttcttagcagaataaatgagttaacagagtgtggtatggattgatcaaagacataaaataatatattttattgcacacttctagctctttgctggaaatacttgactataaaaaccttttaaaaagtagtttgaaagacagggatatagcacattgtttgtcttactagcagaggaaacaaaatgatcaatgaaagcagggtaaggatgaaggaatccttaaactgttttccatgcatatgattccatttaatcagcgctggaacaaaggatagcatttttctttcctttttccgtgtgtgttatttcatattattaaatgagatttgagtgaactgaagtaaatcagccaaaacccagcttggattagatcccctaaacttccttatgcccagattttttccagatggtttctcatgtcgccagtttaatatcaacagtgtgtgacacgctagaagaatatttcttagaccagttcagtccttgaaagataattatactgtcagttgccatcactgttactgtgaaagtgaagataactggggtaagtatattaaaatccagccccaaaccagcctgactttcagacagtgcatctaggaaccttcgctcatttttgtcactatctgtctatgctacccgacgtaacactggtatctttttgacagcaaaatgtctgcaggtcactttttggttatatgctgaggaaaatatgaagaatttttgcatgatgaaaaagatggtgtgctcatgtctgcttaaaaactctgatttctctgctttccactttaatttacaagttgaaaatgtattttcatgctactacccactttggatcttttttattgtacctctgacattacttatagcacatttcgcagctgggtttaaaagcatgttagcaggcaattgtaggtaccgtgtcaacaaatgtgggaaatagaacaagactaacacataaggaatgcctgcaaaatcatgatatgaggtgaaaataaaatggtttcatgaaaatgctttttcttctttttattttaatataatcacaatcttacagaaaagttgcaagaatgctggagagaaggctggtaatatgtttaccagagttaccagttgtcaacattttgaacatttttcccatatgctttttgtcattatatatgtatttttcccttgaacaatgacaataagttatgaacatcttgccactttacttttaaataattgagtgtttcctatgtacaagaatattttcttacatgaccccagataaactaccatgctacaaaattatagtgagtaaaatactgttgtttaatccacaattcacctttaaattttgccagttttcctggcaaatgtactggatccattgcatttaattgccatctccagttagctctgggatatcatgaagctgctttcaaaaatacagtattttaaaagacaatatggagcagctaccccagcaagcctgccaccaagagctgttacgtgaccgctgtgtcactgctcaccaaactctgttgtgcttctgcttttctggtaactaacttgcatcttacagattaccaacaggaagcatttcaaatgcaaatgttcatctgaaaataaatccctagagatctctgagtatctaaagaggtaaacacgcaaggagtctaaagttgcttttaggttgaatatgcacatttatttataaacatggctgtaaccataaatgattttctgcaaacttcatgtttatatggtgattacttcacagaattttcttatctacatatttgtttggaatttctgagatgatgagtgagtaggtgcattcactgaaataattattttagcatattaaataaaataccaaatagtgtgagatcctttcaaactgtaagatacttgtgtatgtagtttcttgagatatagaaagtagacttgtcagctgagcaacaagtcatgggtacagttggtattctttttttgtttgtttgtttagagacaaggtctcactctgttacacaggctagagttcagcggcactatcgtagcttactgcagcctcaaattcctgggctcaagcaatcctcctgcctcagcctcccacgtggctaattttttaattttaatattttacagacgcggtctggctgtattgcccaggctggcctcaagtgaccctcctacaggcatgagccactgcactcagcctggtattcttttagtagtgctgtaaggggaaaacctggtctactttaccaagccacactgggtttgcagttaggactcagagtactaatccttttcctgccatttcttagccctgtgacctcatttgccttatctgtgaaataaaacgactcaggcacgtgatctctgagcttctttcagcactacagttctgtgaaaaagttggacatctgcttatggccacagtaaaagtagaggaaaaaaatcattaatttaaaaagctgttaccatacccaagcttgttcttaaaaataatatatgcagttgatatccatttactcattagtgaaaccccattagaaatacaatccccagaggctgggcacggtggctcatgcctgtaatccaagcactctgggaggctgaagccagtggattccttgaggccaagagttcaagaccagcctggccaacatggcgaaacccaccccccaccgtctctactaaaaaacaaaaataaaaattagccgggtgtggtgatgtgcgcctgtaatcccagctactcgggaggctgaggcatgagaatagcttgaacccgggaggaggaggttgcagtgaaccaagattgtgccactgcactccaacctgggcaacagagtgagactctgtctccaaaaaaaaaaaagggaacaattcccagtttgaaattgaaactgattttgcttactgtatgactgggacctctgtgttcaggactttttccagtctcatacgttcccttctaactccattctacctttgtatttcttgtcattaaaagaagaagaaaagctcttggcattcccagtagtttgccctgtcatcatttccatcttattgcttaggccaagaaaacatccttcagttaatcatttgtgtgaataagcatcactctgaaacttatctcaaaagcctcccctgtttatctgcaggtctcttctaatactccaagtagttcttttccaattatgcagtaatttaccatagttacactgtttcctttcgtagttcttactgtgtctgtctgcttacacttacctgatcagcaaaactaactataccctgtatctcaaatgattctcatactgaaataaacaaataaaaattcagaagtgagaaagtggaaaagccagatcttttttttaatgttttttgtattttactaagcagatttatgactgaaagaaaaacattttaagcattttatcctcctctgttttaaataactattgtggggttttttttttcagaaaattatttaaatacactggctctagttaaaataacttggttttgattcatatattaatagttaaagtaaatattttgaactttcccatgaataagtacaatttagttagtcaagactttattattttatgaattatataaaaatattgttctctttcattcatgaagggaaggagaatctggtcatctagttggccagtgcatataatccactcagctgatgtagatatctgagtgtttatgtcaggcaaatgtgctccaggaggctgggataaagccacggatgtggcctccatgtggctcagcacttgagatgccaggacgcgctgccaacacctgggaataatagagaatgcgaatacctcccagattatcatagtatataaaccactccctgggagtaaatcaggaaccttgttcatgtgctttcaccctttccagactcctgggtaccttttaatgatcacttctgtagtgtattgcaggatactctggcaacaacttgaaggccttaatgtgactgccacaactgcctcgtaagttttcagtattggaggattatatcttagagagtctgtttaaaagccagtcactcaaatacctacaaggtccaggtggtagcacatgagtgaaactcgcactgggtaccatagtgaaagggaaaacttggcctgcttaaagagggcagctgtttctctgctccagtgaatggtaccaggtcagaatgtgggctcagagttatcacttcttcttgcctttaagaagaagctggaaattcagattttttgttggtgaaatctcctgaatcttaaatactggcaaatttacttcaaattaagaaagactgtaccagctaaatacgtctgtgggtcatcagtttgtgaattctgaaggagaatccaaaaatatattaatgtgcttcaacaggtaaattttctgttgactttagttggttatgagccacagggcctggggttctggctctaaatttctacataggaaaagccctgtgtttcctgtggacttgctatctcctatcctaccatttctctatcatggcaaagatgtccatggacttcagaagttctattgagagtttcgaggaaatctcagacctctcatcctttgtgtttctttcctggtaaaatggagattgctggggtccaggccttcagggtagaggacacatctgtatacaacacattgttttcctttctagttgatgcattagtcagtgtaggctaggctgtgccatataacaaactcacgtggaatgttcagtgactagacacacagagactttatcccttgctcttaccctatgtctaacagtgtgtgtcaacaccgttggctgctcagtgacctacactaacaaatggcttatttctctgtgatgctgccaccctcaacatagggcctctagggacttcatggcttaggaagagagcagtagcagggcacatcagttttgttcagaagtgatgcatattactcatgcttatggccctttgatcagagctagtcatgtagttccaaatgaactgcaagagaggctgggaaacgcaaggtcacacataagataaatatctcacaggagatatgtgctcctacaatgatgttttcctgaccatcaaactcagacttggggctcctgttaataagcaactatagatggttttagccccagtctttcctagatgccaagatcagtctctatgggtatgatctgtaagttatcagaagaatcttctagcttaagtcttgtgaatacaggttggagcttgggaacaccaggattttagaatccaaaagattaaggggcctcctcatccacagctgctgttcctctttccctgccatgtcatgatcacagcctgagagaaaggagacaaaaaatcttactgaaggccttgaccagcacgtgacttcccccaataattctgaagttagagttcaaccaagaaattgtagagaaggatgagggagggtcttctggttaactcctgccctgaatggttctatccctcagtttcacattggttgatcagaagtgtaagtttccacggtgtatgggggctgtgtagaaaagtttgcattttgggggttttgtgaatctttgttttcctggaaaaatgttcacttttatttcttaattattttttaattgacagataaaattgtatatatttatcatgtgtaacaggatgttttgagttatatataaatgctgtggaaggactaaatctagctaattaacacaggtattatcgtttttgtggtaagaacacataactttaattctttagcattttttaagaatacaatctgttgttattaactatagtcaccatgttgtacgatagatgtttaacttattctttctatccaactgaaattttgtattctttgatcacccctctagtccctgttccccagccacccaagtccctggtaaccaccattctacgctctgctgcgatgagatcagattttttggatctgcatataagaagtgagatcatgcagcatttgttttttctgtgcctggcttattttgtttagcattacgtcctccagatttagctatattttgaagtggtagcttcacaaagatgtagaccatttgttagtctgggtcactgagtaagcaaccgtgccgacatacagtgttagacaggttcattctactgcaaatgacaggatttccttcttgtatggctgaatagtattccattgtatatatataccacattttatttattcgttcaactgttgatgggcacttaggttgattccatatcttgggtatagtgaatgatactgcaataaataggagactgcagatatctctttgacatattaattttatttcctttggatatctacttggtagtgggattgctggattatatggtagttttattttttgaggaacctcaaaaaatgtacatatgttttcaattcatattgaaatttgtataatatatgaaacaattcctattgttttccgtaatggctgtattaatgtacatttccacagatggtgtgcaagggtttccttttctctacagccttgccaacacttgttgtctttcatattttttataatagccattcaagcaaatgtgaggttttaatttggttttgtgtggttttaatttgcgttttcttgatgattagtgatgttgagcatttcttcatgtagctcttagaatgttggcactttgaaatagttttaaccagtctgagcaaagttctctaatatgtacactgtcacagatttataggcttggggatcagtcttgatgggggacggagaatagaatgactacaactcgtatgtacatcttttagttatgaacgactgagaacccaattcaaaccagctcaagcaagaaaagaaattgattggctctagcaactaaaagtccaggggaaggactggctccagttacacttggattcagcactcaaaacactgcattggcactcacactttttctttcactattgtgttgttctccatgctggctttatgttgagccactacatgttggccctagctttagaaattctcaggttcattcaagtttagcaaaagaagtattagaatcctttcttgcatcctcaaaaatcctcagattcactcgaattggaccaatttaggtcacatgcccggccctgaagcaatggctatggcttgtgatgtggtgattggtttcatagatcaaactaaaaagtagaggttgttgccagatccacagacaaaaaaaagaaaagaaaaggaaaaaaaggtagcaggggatcaacacatatccactaaagcactaaaggggaaaatagataattacctcagtatttcaattatttaaccttagtatgtttttctttctacccactattatcatcttttcttgtacccgctggcttgggatactatcttcagaatcccctagtagttaaaactctgctaaagaaatttaactcttaaggtatattttaatctacaattgtaggtcaatacagaaatactttttactgaagccactattttatttttaacatggtgctatttgtacatctggaagcctgcagatagctggaaacagtttggatgtccttgaaaggaaaaatggttataatctctggatttctatttagatttatgtaagtcaaagaggttgagacagaaatgattattttccaaatatcttcccccatactttattccttttctttggtttattttacagatgtatctctgtagatagatgtgttcctcttgaaaatgtttgcagtttccctgttttttctttttttttggaaatgttactttgttaggaaaatacaccctactaattgcattacaaatatctagttttatcttagttataaactttatattttaatatttttaagtttaaaaagaagaactaaaccagatattgagacatttagatcctcatactggtgaaaaattaaattttgcttcttgtgcctctgtatctgtagcagataatggaaggcatttgtttgagagggccccaaatgatcacatgaaatatatggaataacattggccatatgaggatgggagatggaacttgtgttatttgaacttggaaacatactgttttccaaagtatattcttagagaactaatctgcaaggattacttggtcagacagatagggggaaatacgatgctttacttttctcttgaagactaaaaataaacatgtcattaagttttctggcaagttctgtaatttttttaaaaagtgtttaacactaacatcacatttacgaaacttattttgaccacagtttttttcccaaacttattttgaccagttttttgtttgttagcatgagcagctattaacatcccctggaatcaaagggccaactttgagaaatgtgttcttcacagtattgaaaaaggaacccatcatgtatgttggtaaacacccctttcacaaaatttaaactcttttcagtttaatcaaaaggaaagggagcttttcactgtacaaatatgattgaaagccctgtatatattcactcagatttctcaggtaaggggaagggtatgtatcctggaaatgacagcatgaacacttgccaagccctcatatgaatcagtgttcactcttgtaaatcataaatccattagccaccaagagaatttctttgttttattctcaaatttgcaatgaaacctgttcttaaagtaattcctttagtaatatacttgtgcaaagtaaaatcatctttaaaattaaccatttctcatatgtaatttccaaagttaatttctgaaaagcagaatataaaaattaaaaacaaacttcagtgaagttcattgtaatctgtctaaggtttattcactctgataagaactgctggtaaatttagctaatttctcagaagagctgagtctgaaaatatttccttataaattagtttatttggtttgtttatactaacagtacagttattttgatatacctttaaattatattatctgtactatgattttatatgcttttagtttaaaataagtatttcgcatgaatgcatgagaacccacacttattttatatttgaatgtgaaaagcgattctgctaaagaaattcactgccaacttactgaaattgatggagtgtatgtttttagtcagcatattatcaaagtgacatgcaaagcctgagaaagatgtagccccaggaggaaacttcatctgaggaccctgtaaatgcaagtaaatcaatttttaactacagaaaaattcaaattataaagacatcttatccacattaccttattacaaaatagaaccaataatatttgtattaccaataaattgaaaagtgccagaatgaaaaccacaagagtacttttcaaaacaatatcattaaataataaagaaggctaattgcagaaaatttggaacaccgtaaggcacataaagaaataccccaccatcctaacaccaaaataactgcaatgtgttggcatagttcattccagtctcactcatgttatatttcactaagccataaactatggtgttttcccatgtcgttttaaaccaagtgaacatcactttttaatagcagcattatatgccttcacatgccaaaacaaaatagtatttttcttaatgaaaatataatgaaaataaacttttgtttctattgttttgctttttcccctgagaataaaagcaagttcattgtaagaagggctggcatcagctttttataggagtacgtgcacagatttcaaattactgtgttctgttaggaatatttcataggaaaatcagcaaaggtttttctctagtttcctttccttagttctctaatcaaggcatagaaagaagacagcctaggatgagagaggccaagaactcccttataagtagttgtttggaagaagagtagaggaattgtaaaactcagccagataaacaattctattgaagaagccttatctgctaggtaaatctgaaatgtgttaaagtgattttacctaagccatactcctaccctttggttccttaggcctcatcaagcaacccccttgtgagcctcccccttctgaatctccttccctattttcctgatactctccccaccacacacccttattcctctcctgcgcttagggaactctggcacttggaatggtgtagccaaactgtaatcatgccttcataacattgtattgacaggcatctgtgacaatttcactctcccacctgattcttagagtaatgtttaaaaatttttggaatatccactcatgtttctcttgaatctcaaccaatccaaaaggttcagctcagtgtgattttgtgtgtgacatttccaatagttacacaccttagaccttggtccagcatgaggggataattaataagtacactttttctgcgggtgcttttggcaatactactcttaccactaatctctgagcataattgactacaaaaaaaatcatgtgctatttcataaaattccaagcatgtgcagacaccaggtagtatccaccaactttgggccaatactgcatacttggcatgtcataatgatttttttttaccccaggaagccatgctgaattctggtgataaaacacagtgagagaaacatcagctcttaattattttcattaaaaaacataattccaagaacaactctgaaatcatctagagtttggaatatattccagagacacacattctttctctttcttcctctcatcttataagatagggttatatttagttggcttttttcataaacatgtattttacctgaatttgaagattaaatttcttaatatttatatgaagaatgtagacaagcactaatggtgttttgttcagtctgaggagaagaaagttaacacaccatgaaagcataggaatgttttagaagatttttagctctcgcaattgggaatctcctggtttaaatttctatcatttcagcctcagggcaatccaaatcatacagggcttggacttcattgcatcaattctaatagtttttgcttttcttccccatgaaaacccccgtactttccttgtattgaggtgtggcttcagccttcaagggtccattctcagtatgcttgaaatctgaagatgaaatgaatttcataactggaaaatccagttatcaggcatgagcaaatggctgcatttgtttcagattcttttgctagtcgcttcattttcttctaatttaacaaggtcatgtatgaaattagactcagctgttatttattttattactgagctccaaggtataaatgttcctctcctatctagaaatttgctttcgactttctttctctttatatgtacgtacctatatcatgttttgcagcctccatagatataagctcaaagttaattttaccacgtcttttactcatctagaaaagaaaggtagccattctctcccagtgaacaatcaaattctgctgccttgaggaacaagtgatcagagcatttcgttttaatagaaaagctgtttttgttttgttatatttttttcttgcaaggtttgctttcagagctcttaaataaggatccactttcatattttctgcttgtgatttggactctgcttccgaaatgcatttgaagctgtctgataacacaaggcacatgtattataacatcattaaaatagaaagttaaaagttgtgggtgaaggaaggcaaacatttaccagcagaatgaatgaataccatgaatgaatgaataccaagaatgaatgaataccatgcataaatgaataccatggatgaatgaataccagctctagtgaggacctagggctaagccagagatcttactgagagccctgggcagtggaggcagaaaggagaaatgatggattacttagttctggttggagtggtgctggagtagggaaacctactggatcatcaggagaggcaacttttctatagcactgatttatgaaaggcatttgtaatatgtgtttttaaagatagggtagactttgaaatgattttaatgatttttaaaacatttcatggaagcatatcatgccctgagaaaagagcacataagaatagggctgcataaattttcacagactgggcacatccatgtaaccagcacccagagcaaaaactggaatgtctaagcctctcaacagtcccccgtgtctctttccggccacgactccctcctccccaaaggtaccattattgttgacttcttagaagataaattggcttaaacttgtttactttatatattttaaaacacatttcaatcatttgctctatctttacttttaaaataataattttgttcacttatggtttcatccatctattcattcaacttattgattcaaacaaaaattcttaagcacctgccatacgagtaacaaccatgaggtttagaatattttaaacctttcaattgtttcctattttttttaatttgtatgcactaaaattcacttcttttctctttctttctttttctgtgaatgattacatgaattttgacacatgtaaattaatgtaaccaccaccttacaagagattcagaacaatctcatcaccccccaaaagcacctgttaataccctctgtagtcctacattctttgcagacccctaagttctggcaactcctgatggagctttatattttgagtttcaaggcagtaatgaggatacatttttcattcttcatttctcagctgcaaacattccatttcaccttcctctatctctgcatctccatcatgctaaagtcatttcattttctgactgcaaaaggccaaagtttttctatccatattaagaaagatatttttctggtcaaaaattgcagtgttccaccagactgactaactttgttttctgcacaaaatgttttttttttttcttcccagaggttgagtcacttatgctgctgagcacaggaattttgacctttgggtgaggctcactctgaatcttccactgtgaataaaacagatcccaagatagagtggaaaagaaatacccagagctgaattaggagcagctggcagatgggctctgaaatgcaaaaatacccttttgagtttctcaaaattctagttctctaagaaaatatttattttttcccaattaatccacactcaataatttccccaagttatcttttgattgggaagttctgtaccacattgtagtaacaccgataacagtgaagtaggtggtgctttggaaggaaatcaatcaacttacattgttttatgcataacggcagttggaaaactgttcctatgatttcggtggtattctgccttctccatctgaagggaaacacttcatacacttgcctgtgtaagaaaggtgagtctgaattgcaaaatgggctttgttgataacttccttagtcttttatttagtatgtcatattacgaatgcaaaatatattccgtagagaaaagcatgaaaatacaatcaagcaaaagaacattgaaaacaccctactcctttgtcttcagaagcaatcactctttttttttttaactttttataatggaaaatttcaaatgtataccaaagcagagaaaatagtacagtgcagtcaacacacctattgccagctccaccagttatcgactcacatctactcagagttcatatctaccccaaccccaccctgcgctgagtattttcaaacaaatccaagacatcgtatgatttcattcataatcccagtgcgtatgtacctctaaaaggtaatattttaaaaaatataactataatgccatcatcacagctaaaaaacattaataactcctgtttatcgttaaatattctgccagtacaagcttctctgattaactctttttggccatatttgggtataaatcgttggaaaaaccactatttgtaacatcttggtatatatcctttccaactcttgtctttcttctccgtgcgtgcgtactccctgcgtgcgtactccctgcgtgcgtacatatttatgtgggcatgtgttcccctctagatttcctgccatagataaacacatgtactcatattcataaattggcttatatctgcaatacttttctggaacatcttttcataagagtacatgtgcttccctcattgttttctcccgtgactatttagaatctcataggatggattactattattcattttgtcatttccttttcactgttgattgtgaaccatccttcactgaaagtaaataacatttaaattatcactgaatataaggtcagttacctttagatattagcaaaggtaatatattggtgagtgaagcaatgagcaacacagaatctgtctctgatgactatttttgggcaagtgtgttttactttcagttaatatgcttgaaccacatgctcctataactttgtatgtttttgtagtttgtctgacaccaagttacactgccaggaaagtggccactgttcatattaatctggaaagtctgagttgccatgataagttgggtgcatgatcacaggtaaatagacacaatatttgagtcacagtgttttcagaccctgatgagttctgatgattcaggaccacttggccttatttacatttgtgatattctgcatgggtgggacgtgtactttggagtcagataaacaaagcgtgaatcctgcctccagcattttttgccgggtgacttagaacatattaacatctttaagcttgaaatgtcttcacctgcttaaggaagatagtaatagtgcctactcatgaggtggttgtgaggattgaatgtggtaatgatgcagttatggggccttgcatagtgcctggcaagagctcagtaaatggtagcagctttcagttatagttaaaagaccaaactaaatgccatatgccagagactatgcacagagagattccatttatgtacagtataacaacaagaaaatgaatctaagccatgagaagtcacaatggaagttatcttccagagggcagtggctagaaggaggaacaaggggctcctagggtgtcgataatattattttcctgaatatgtgctggtgacttagttgtatgcagtttcagaaaatccgttgagctgtgacttcattacttacgactatgcatcttcaggtactttatgtttcagtgaaaagctaaaactgaaaaaatataaaacaaacagtataacattaatcttatttgtggtaataaggcacctggcatatagtaacatagaagatagacagataaacagatagatatagcgatatggggaatactaatcattgttagcaatttgaaccgttttttaaaattaaattttaggaaaattgagttgaaaataatattgattcaagtcaaacactacatatattttgaattggtcgttctaaactcttctccctcatattttcaagacaacattccatatttaagttggaagcagatacttgctttgctttctctggttttctctcgggagaaaatattaggggtgcaactgtggcatcaccagcctcatcttgcctgtctagagcagagcagagctgctgctttgaaatgagttattgggagcctcagaaaccctgaagaggtttggccatacccagtagcaagctctgcttatcaaattgtcccaaagagtaattcttttctcataatacctccaagaagcaacaatcaattcatgacctttttttgggtagtgacatttcaagtgctcagaagaacatctgaagtttgagaaaatagacccgagaaataggtatttaatttacttgttctccagcaatcacactcattttgtcaagcagaatgaaatgagctaggcacagcatttcatatggtgaagcttgctgtttggtacagctttaactgccaaactgaggggagccctcaggatgtgtttgtggaatttcctttgtggaaaaatttcagttctcactgttgttagtccttttgtctcacaatcatacatgtgtacttaaaaagcctaagaggtaaaatatttgataattctccttttgaaatgcaatgcatacagtgtagtcagatttcatggaagtcacctagtgtagagattttaacaattaaaaactagtttaagcagatgggtcataatcggtatttcctaatgtgaatatggatatggaaaatataattataaggatgttagaccctctcttttgctgtcacagcacacagctggaaattgcttattattagcttgcaaatcctacaggaaaacacagaattatttttagtactcagcaaatttatggtggtaattatgagtacttgcatcacttccggaatgcaagagtcctatatctttagtctccatgttgagaagataatttttatcacttgtatgccctgcatattgatttctgtggtcactgggaatcaaaagtacttttctggtaatacaatgggtgacagtagtcattttgcaatgtaaatggtttggaaggctctgcagccgtgggtttcttaaatcttgaaaatagataaagtaaaaaaagaattgccttattttcccatcaccaaatttgccaatctacctgcatctgaagtcacaccttctgcctccttcccgtgacaatttggagtcattcttctggctctgttaagagtcaaatccttccctggtgtccgggatcctatctgcctttagcattacttaagaactccactcccactcccacactccatctccctgggatcatctgtgtgcccccattagtctacatgccgtaactgtggcctcatttactgcaaaagtcctcagagaattagctatgttaatggtctccacttgctctcctccccttctctcctcagtctagtccactgggtttccaaacccataagtcttctttataagtgacacctccatctactatttcctcaggctgagaacactggagtttataagttttcttataaactcaatctccaaaatgtagtggccaatggaaaacttcctctttaccctctgaaggtttgctgaaaatcaactgacaaaaggcagattaataggtgaaaaggcattcacattggttaacattcctggggagaaccagagtgattaccccatcacatcataaccataacaaatggttatggctcttcttcttaggggaaaggggagggagaattttagatgatttgggggattagtaaatgatttttaggggaattcagtgaacttgaagaatacacaatggcataggataaagtctgtggggcctgcacaacagacaatggttgggcctgcagaacagacaaagtctgtgcaggtgtgttgacagacttccatttttcttcctgcaacatgagttcagtcaatacaaactcagggaagggaccagacatgactgttttcttctttggcaggtctggactttaggcagataaaggaacttcagagaacaatccatcatgtgctttgggagagacagaggattgagagagatggggaagggagatgtcagagagaccttgaggcttctttttcagttcggaaggtggaaacaccatattataagatactggtttctaagacctgacaagaatatatttgcaatccaaccatttttcactgtctctgttgatgtgttcccaactccatcatcagtacacagacgtccactggttgtcacccaagccctgcttcttgctgaatctaatgactgtcaattatttggtctttttaaatttgacctctcttgatgaaactttttttctctttgtgcctctgtgacctccagttatttcagtatggagaacttaacaaaagaatgttatctgggtaactgaaagggatatgtagaattgtgtatccttatatgatgaatgtgttaaccaggtaactgaaaggtgtgaaaagaggtctctaaggcgttatggaggcagtaattgcaggaaagagccaccagcttgagggaagaaatctaaatgacttaaatgtagattttcagaggagcgtccctgaggagctgaaactctggcctctgaggagggaacttgtgtatttgaggtcacaggaggggcctgtggagctgagatctggtccttgaagaagggtgtgctggctgttgccagctctgcagttgctgagctggggactatgttatgtgagtattggaaaaacagcaaaatgaaataaaccactggctgggcacagtggctcacacctataatcccagcactttgggaggccgaggcaggtggatcgcttgagcgtaggagtttaagaccagcctgggcaacatggggaaaccccgtctctactaaaaacacaaaaattacccaggcatgatggcgtggacctgtagtcccagctacctgggaggctgaggcacgagaatcccttgaacctgggaggccaaggttgcactgagccgagatcatgccactgcactccagcctgggcgacagtgccagactcggtctcaaaaaaaaaaaaaagttctgccactgccagggtggagaagggagactggaggaggctcacgggagtcttgcctgttccctccagcacctcctagggccagagcctaacagggagccactcaccaatcaagaatgccaggtcttagccccatcccacaaagcagagtgcagaagggtgaatatacatttattggataaattaactaggaattcacctagtgcttggtccatgactgtattcagctagaccctgggaggcatgtcatgagtgcctggtgtgcatatactttgccttccaagctcttggcattttccttgacctcacaactagaaaaaaacatcaatttggttgtatatctgtaactgagagtgcttgtttctaaaaatgcagattatataaacatacagaagcttatatatacttggcaagaaatgtgcaattagtcacgtggtggaaagtccctccgcacgactcatgtagtctacctgctagaattctacttcttttatgtcttttgaaggcaaatgccatgctgtcacctgaagaatccactggcattctgttcatgtaggtagtagccttcctgtctttttgcagtgtggagaagggattgggagaaaagacgtgtcctgcaaaccctgagacatcaccaaggtttgcaaactgtggttcaagttcttcacctcttcacatccacaggagaaatatctgttctgacattgtctttagtgctaaactattgtaatcaagttctgtcggggttgagagatattccttacttagtagaaaatatctcctggagttctggcaattgaaaatggcctcggctctcacctgacttcccctgcaattgcaaaaaattcatcagctgagtcgggatgttaaggcaaaaatatgatttcttgaagagagagggaggagaagagaaaaaaaaaataagtgcagtgtggtctaccggtttgtgtcgatgctattcaaaaacatctctcaatccatttatcctttccaaacccaggagggtaccagtgccatccccttcctaattcaaggcctgctctaccttcaatggcctgtgcaccttgcctacctctggaactagttctgtggtctctttccctctcagttatctctacaacttcttagcttagaagtcctcttaacaaaagactacataaagaaatgtgaaaaacggagaaagtatagggaacacatttaacgggcagattatgtatcaaagctaatgtccctgaagtctcgatattcatccagccttttagcatcgttgcaagattcatcagtggagaaattggggaatgcaatcctgcttcattttctgcggagtggctccgtttggagcaggaacccatgtagcttgtaatctcctacgtaatcttccaaaggctttctgttttcttgcagacaagcctttatgctcttcccagtgccacattcctgagaaccctagggctccaagaagtgttctgtttgcatccttcatgccatgtgttttttgtttttgtttttgtttttttttcttattgagatggactttcactctgtcacccaggttggagtgcagtggcatgatctcagctcactgcaacctccgcctcctgagttcaagtgattttcctgcctcagcctcccaagtaggtgagattacaggtgtgtgccaccacgcccggctttttatattttctggtagagacagggtttcaccatgttggccaggctggtctcaaactccagacctcaaggccaagtgttttggcctcccaaagtgccgggattacaggcgtaagccacaacacccggcctgctgtgggtattttgtgatcacactgtcccctccaaacacaccttgtggaagacacttgctctgccattctggatttaaaataactaaactttaaaagttaggagtaattttctatctgggtattaccctaaagagtcttccaaacgactccaaagattttaccccatagaagtattcctctaagtgtcccctgcaacttcattaaatttatccgggatatttgttaaaaatgcagccccctggatctcactggagacttctaaaacagtttcagagagtgggggccaggtttacatgtattttttaaaagttctacagtctattcttacagaagcaaaagttgaagaacctctggtttattgtgtagatttttggcgtcatagaaagaaagcaaattatagagctaggaaaggaaaatattgccagcttaacacttgagttatctgagataaaatggaatagcttttagaaataattaagcatctattttcatgtgttttgggaaaaaaatgagatgtaatctcaaaccagtgattccattgatattacagttgacaatgaaactgaaaaaaataaataaaataaagtgaatctttaaagaaaaaccctaagcaaataaaagtaaaagggatttaaattggtggaagagttctattgttgttttcaaatccctgttcagccactaatgaacagcgtcacatcagacacacacgtttcttcatgttcccttccttgcgtagtgtacccacagggggcactggtacccatgccggggctggttaccaccttcccgtgggccacagcagcttcccagcaatgctccaggagcatggggctggctgcttgtaaaatcatgacgttattgtcttctgtgtctacttccactttcctcctcacccctatttttccctacaatgtcccatctcccccctgacctgtccatgccagtgactataaccttcatagtcctctagcttgacagaaaggaatagccatctttatggatttctccaacagacgggctggttggcaccagtctttccaggatggagcttgctaatcagatacacataatgatgctgatgtgccagtctaggggactacactgctatggtccaacttgcagtgacacagtggatgcagcagacacggtcagtgggtcagtggtccccctaccccctttgatctctccgtgtgctccatctgacttccagccaccactatctgtgctggagggttcttttttcttcttcttttttttcttttttttttttttagatggagtctcgctctgtcgcccaggctggagtgcagtggtgtgatatcagctcactgcaacctccgcctcctgggttcaagcaattctctgcctcagcctcctgagtagctgggattacaggcatgcagcattgtgcctagataattttttgtatttttagtagagacaggattttaccatgctgcccaggctggtctcgagctcctgacctcgtgatccacccacctcggcctcccaaagtgctgggattagaggcgtgagccaccatgcccggcctggagcgtcctttttaccaagtgcagagagccttgaagcccacagtgctcaggaattaactcccctaggagcatcactcatccagtgactctctgaatatggcatataaatatccaagctctctcccccagggatgggatcattctgtggcctgtagttgcaccttttccaagagctttccagtaggattaagctccagttgctccctgaatcatccgtcttaatagcagacactttgttggttgccttcttttccctatttcactgcctcattttttttttttaattcacacttcctgggactacctcaaaaataaactactagccctgaatttgtatctcagggtgtgcttctgggaaaacccattaccaaaacccgtcacactatcaacagaaacctcatagtgctgcaatgcctttcctttactattaaccaaagtgagaatttaggattatgcatccaattcaagtaaagggctggagtatctttctgattggggaaggacaaagtttgtaacagacgaaagctcttagcaccctcctagccaccctccagctgtgccccatatggttgttaattgaatgtcagttatggcttttccctactaataccctaaaatgcccttgttcatcatctatttgatctgttaatccagctaagcccatggttcccaaacattaacacacgttgagatccactagaggaccttgttaaggccacacattactggaccactacttcacccccagtgactctgatacagtaggtctggtgtggggccttaggatttgcatttctagtgggttcccaagtgatgctaatactgctggcccagggaccacactgagaactgctggtgtgagcctgcattcaccataatctcttgaaacatgaagcttggtgtttgcatctgagataaagcattaattgatttttcttttaaaattttatctattggttttgattaggtaatttatttacctggcttaaaagtcagagcatataaaacaatagatggattctttcttaacatgataaaacacactgatctcaatataaaagccagcctcatgctgaccaggaaaacactggaacatttccacagaaggaatacaacaaagatgcttattatgtctacctaatttatcattattctggaggtattctttatgaataatatagagaaagaaagcccaggagaagcaaatgaaaaacaaactatttgtacaatagaaatgttcaataacttggctgtgtacaatattaatgtgaaaatatcagtaaattttctgtacaagcaataaacaaagagaatatatagtggaaacagaagccccatttttcaaaaatatataatataccaaagaatatagcatattttaaaaatttgtgagatctacataaaaaatcttaaaaatatcctgaagtttacaaagaaagacttgaaccaatgaaagagacaatgttcttgagtggcaagactcaacttcatacatgttgctttcctttaaataagaaataaattcaatataattccaataaaatactatattagtccgttttaacactgctgataaatcatacctgagactgtgaagaaaacgtttaattggacttacagttccacatggctgaggaggccccagaatcatggcaggagatgaaaggtacttcttacaaggtggcggcaagagaaaatgaggaggaagcaaaagtgcaaacccctgataaacccatcagatcttgtgagacttactccctatcatgagaataccatgggaaagaccagcccccatgattcaattacctctggctgggtccctcccacaacacgtgggaattctgagagatacaattcaagttgagatttgaatggggacacagccaaaccatatcattctgcccctggctcctccaaatctcatgtcctcacgtttcaaaaccaatcatgccttcaaaaccaacagtcccccaaagtcttaactcatttcagcattaacccaaaagtccacagtccaaagtctcatctgacggacaaggcaagtcccttccgcctatgagcctgtaaaatcaaaaacaagctaattacttcctagatgcaatggacgtacagttattgggtaaatacagccattccaaatgggagaaattggccaaaataaaggggatacagggcccatgcaagtctgaaatccagcagggcagtcacattttaaagctccaaaatgatatcctttgactccaggtctcacatccaggtaatgctgatgcaagaggtgggttcccatggtcttgggcagctctgtccctgtcgctttgcagggtacagtctccctcctggctgcttttgcaggctagtgttgagtgtctgcagcttttccaagcacatggtgaaagctgtcagtggatctaccattctggggtctggaggatggtggccctcttgtcaaagccccactaggcaatgccccagtaggaactctgtgtgggggcttcaaccccacattttccttccacattgcactagcagaggttctccatgagggccctgctcctgcagcaaacttctgtctgggcatccaggtgtttccatacatcttctgaaatctaggcagaggttcccaaacctcaattcttgacttctgtgcacccgcaggcttaataccatgtggaagctgccaagggttggggcttccacactctgaagccacagccagagctgtatattggcccctttcagccatggctggagtggctgggacacagggcaccaaatccctagactgcacacagaatggggatcctgggcccagcccacaaaaccactttttcctcccgggcctctgagcctgtgatgggaggggctgctgtgaaggtctctggcatggcctggagacattttcctcacggtcttagggattaacattaggctgcttgctacttatgcaaatttctgcaattggcttgaatttctcctcaaaaaaaatggggttttcttttctaccatatcatcaggctgcaaattttccaaacgtttatgctctgtttaccttttaaaatggaatgcttttaaccgtacccaagtcacctctttaatgcttttttgcctagaaatttcttctgccagataccctaaatcatctttctcaagttcaaagtaccacaaatttctagggcaagggcaaaatacctccagtctctttgctaaaacataacaagagtcacctttgctccggttcccaacaagttcctcatctccatctgagaccacctcagcctttatcttattgttcatatcactatcagaatttttgtcaaagccattcaacaaatctctaggaggttccaaactttcccacatttttgtgtcttcttctgagccctccaaactctcccagcctctgcctgttacccagttccaaagtcgcttccacattttcagttatcttttcagcaatgccccactctactagttccaatttactgtattagtccgttttcacactgctgataaagacatacctgagactgggaagaaaaagaggtttaattggacttacagccccacatggctggggaggcctcagaatcatggcaggaggcaaaaggcacttcttacatggcggcagcaagagaaaatgaggaggaagcaaaagcagaaacccctaataaaaccatcagatctcctgagacttattcactatcacgagaatagcataggaaagactggcccctatgattcaattacctactcctgggtccctcccacaacatgtgggaattctgggagatacaattcaagttgagatttgaatgagaacacagccaaaccatatcaaatatcaatataaattttataaaattttgttaataataaaaactttttagggcacttttattctcacatcaaaatcgagtgaaagagagagttctcatataccccctcctcccacacaagcacagcttccctcattatcaatatttccaccagagtggtacatttgttacaactgatgaacctacattgacatgtcattatcacccatagtccacagtttacattagggtgcagtcttggtgctgtacattctataggttggacaaacatctaatgacatgtatcctataatatcatacacagtagtttcactgccctaaaaatcctctgtgctctgcctactcatcccttccttccagcaatccctggcaaccactgatctttttgccatctccatagttttgccttttccagaatgtcatatagttggaaccacttagtctgttcagactggcttgttttattttgtgaatatgcattttaattttctccatgtcttttcatggcttgataactcatttatttgtaatccccacataaatttttgacctaaatttgtggtttctagagtacacaaggaaaagtaaaatagcaaggttagctagaaaaaaatctataagagtaatgagaaaggactaacatcaacagttattcaaacataatataaagtcataattatttaatcactgtgatatgagatcatgaatagagaatagaaaacccagaagtagccttaaatacataaaaatacttagtatattataaaattatcattttaattattgataaagggatggaatatgaaaggtgtggaaatttgtgttattaatattgttactttcagcactgctttggatttgtttacacctagtgttgtggagaactcactatacgccaggtagcatgctagacatttccataggtgttgacttgtttaatcttcataaaaatttgtgaggcaagagttcatatttccagtttaaagctgaagaaacaaaggcccagagggattaggtatctttcttacagttgcacagcagtgaatggctcagctggaattcagacccagcctttaactccctacttagagcgatttctatacatggagcttctagcctcactaagtagtttgctggccatttcttttaccatatgtgtactttctgctcatcattatttcatttgagtctttcttttctggtgcagtcaacatgaatttctagttagcaacttagatcatagaattgattttaagaaaagattcgtggccaggcacggtggctcacgcctgtaatcccagcactttgggaggccgaggcaggtggatcacttgaggccatgagtttgagaccagcctggccaacatggtgaaaacctatctctacaatacaacaattagccaggcgtagtgttgcatgcctgtaatcccagctactcgggaggcatgagaatcgcttgaacctgggaggcagaggttgcagtgaggtgagtccatgacactgtactccatcctggatgacaaagaaagactctgtcaaaaaaaaaagaaagaaagagagaaaagagagagagagaggaaggaaggaaagaaggaaggaaggaaagagagagaaagaaagaaagaaaaagaaagaaagaaagaaagaaaagaagagagagagagacagagagagaaaaagaaagaaagagaaagaaagaaaagatttgtaactattttcttttacaggaaattgactaatttgtttagttgagaccagccaggtagaggaggattgatggtcttcatggtctgaactagtagttcagcggatttgagcggtacctttctggtattctatccctgggcctcagacagagagaatgtgatcactagcttgggaaatagcatggccagttctgagcaagagctgggaaagtgatagtgtgagtcttgggttctcccattcctggggcttctcccttacctcaagaaaatgtggatgggtaatgaggctcctctgtccagggaatactggctttccagctactccagatacctcacaggtattccctctgctcaactggtaaccaaccggtcaacaccaacatgacaagaacctgacatgacacctaattcctctgcttccagggcctgtcactgcccctctgtcccaggaggaggtaatcatagacacgttgctgcttacaatgatgctgagttcattcacagccaacttacggtttaactcctagttctgaggaaagccagtactaaaaaaaaaaaaaaaaaaaaaaaaaaaaaagacaattacagttcacctgttgagtaaattcatgatttactagtgatttctgacttttattttttcatctttaaccggaatgcagaccttgtttcattaggtttattatgtttttaattactttaggacctatttggtggctaattatctgtatgacaggaaattaaactgagcttccatttgtctgtaggcactgtgaaacctgacttccttcctcccaccctggcccctttcttttttcaaacaatgataacatgaattgtaaatctggaccaaagtgatttgggtgcaacatgctcaggctatgcgttataaaacacttagtgaacatttgaaagatggccagatttttgtcaattgattatcaattgtcacctgttgatcgattcaatgtagttgacataggaggctcttccaccatctcggtcaagtgtaagacctctcacgtctgacttctgaggtttaaaacctggcatttgctactcggtagctgtgaaaccttgtccagtttctaaaacttccaatgttttagtgtccttacctataaaatggggataataataagacctcatggggtagctgaaaactaaatgagacaatatgtgtaaatacatgtcaagtatttcgatcctggtacatagtcactgctcaataaataatcacttctattgttaagacagagccaagagttgcagagatgggtcagcgattttgttgacagccatctgttgtctatttcagataagagaagagcattgagaagagctgcatgtttctgctgaccttgatagtagaggcagggtttgccccttagtctgaaattaggcaggaaggcctgcaacatatggactgtcacatgctgcaagctctgattatgtttgctcttgacttctcagactggccaggagatgctaatttaaagctcacagtcataaaagattcgtccttgccttactttccactgtctaactcttgcagaagctctcagtaatgacttctacaggtggtgtgattccctccccaggaaagtataaaagcaagagaacaaagtaaataaaaactccctaattcctttagattttatttatattcccatagcaaagctgaagacattctttatttagaatatttgtctcagttgtcttcattatttgcaatctcaggtataaaatatgctggaataactggagagtggtgaaaacatctaaagtgtatttacaggcctaggttcatttttcaaagctttctcttcttgtcagcctttgtcaaatgggttcaagcttttaccagtaagaagcaaatattacattggtgcacttcaatctcggtagttcagaaggaacccttatgcccccaagagctaaatttaccaatctgagtgacatatctgcatggaggaaatatagcagcaggaagagagacacacaagcacacacaaaccaacccgggctgcaatgataattgcagtgtggcggtccctggtatcctaggagtaattactctgacattctttatcattgtgtgttagatgtgatatgaagcaattatcaagttgttttttggaatattgatgcctggccgtctttgcacattatcctcatctcatgctgtgacccacaggacttaattctgacaccttgagtctctcatggcagattgataaggagccctggcttaatcttccctttcttaggatgagactctggtgtttacccttgttattaaggagaagtactgataacatgcgctactgccattttctttttccacttgcagaattcgatttgtatctcaaattctctagtgcctggtctcctactgaaaatattggcacaatggcatttattgctaattgtaaactaccctcataacaaaggcagacattattgtttttccttataattacttgcaatagtccccgtgttaaccctattttaatagtaatctaaggactatggaataaggtttattaagaccacatgcttcagatctgtgcagactttgttggaataatgcttgtgggtatagaaatttcactcttcaagaggtggtctattttcttaagttgaaattggcattgtgtcagtattttgctttcatctgaatagctgtttctctgctcctttatttcatttttttctgagagcagacttttatttggagcatggatcagcatgcccacatttagaatatttcatatcatatcagcttgtttgtaccacacacaataagaggcatctggcatctttcagaaaggctggaggaagccacttattgatgctgtgtatggctggccctccctcgccccatgtacaaggtctttggtgaggtatgggttggtaaacagaaaaagcagtggccaaaccatgcttatagctgtggcctgtggtgacacaggacacatatctatctgtgtgttcttctgtggtcagtgctgtcatccctgggaagagatttcagcatggtggtttggaataatcaagagtgtgggcattgaagacaggctgcccccatccctacatgcaataagacccacccatattttatgactataactataatttacacaaatatggttgcactaaatctcatccttttctctcttttttcctttccttttttcttttttccctttactttgcttagcatgatgtttgaaaggcctatttgtgttgctggatgagcccattgctgctctgtgctctatggaattccatggtgtggaatctgacttagccattactccatgacagccacttcaattggctccagatcgtactactgcaaacaacattcttgtgtatgttcctcacagacctgtggaagaatctctttgatgtacaccttgggtggggttactgggctgccctccagaaaggctgcaccaagcctcactcccattcataacatgtgcgggtttccatggcccccatcaccacattcccaccaacactaggcattactcagctctcattgctattttaatttctgcttctgtgagactaatgactcttatctctctgttgacttttttcccatgataccttttatggaatgttaactcctaactttaatgtaatcaaattaataaatgtttaacatattgatttgtgttttcaaatttttaagatgtcctttctcacatctaagtgacaaagaagttttcataccttttcttcttttaagtttataattttacttttacattagttctttaattcaccaagagttcacctctacagatgataacaggtagtggtccagtttatttttctctatattaggtaataatgtcactaaaaagtccttctttttcctattctgttatggtcacctctgttgatttcttagtgttttctttgtttcgtgtttccaaacattacttcattgtctttactcttcccagtgttgctttttgagcttgataccaatccagttcttactctgcactgtattctgcatttcttagtttttctttttacattttctttttaggagcttgggcaagagtgaaatgagagattattgttaaggggtacagagttttagttttgaaagatcagaaagttctggaggtccactgcacaacagtgtgactgtacataatactactgaactgtgcactaaaaatggttaagatggtaaatttatgttacgtatagttcacaattaaaaacttggatcttgcaattagtttaagaaataaatttaggaatcctcatacaaaaaatttatagcacaggaataaactttatggaaagtaattagcaatgtatgatgagccttaagaatgtccattccctcttctaggtgtgtcctaaagaaaaactgagaaaaatttggagagagaatcatttaagtttattcattgcaacattatttatgatataaaaaatacttaatctaaatgttcaacctgaggaatagttaaattaaggctggtacttccacaggaaggaaaatgcagctatcaagaacttgttttgaaatatatttaatgatatgaggaatattttaattataacattattttaaaaataagaggcataactgtgactttagtatgaatctaattctttaaaaattacacatatatacaaatagaagttaaagtgggagaaaatacactaaaatgtaaacagtaataatctgttggtggtgggactatctgtgatgtgtgtaaatgctttgtaaactgtaacttggcacactaatagaggcagtggttgtaagtcactcagaatgaaaaacttgagctatgccaacgtaatagcctaatttaatacttaaaaacccatatttagcatttagcatatagtaaaaattttcctatactatctacatatattatgttactcagttctgccaactacctgtaagataggtactattactgttctatttccttcatgaaaaaagtgaaactcagatgtcatacataggaagctgaagaaccatgatacatgtacccagaacttcctgacattaacccctactttttaccaattccaaaataatctaaacaaagaagaacaagaaaaggtagtcataattgcctaaatgttttagtatcttgttggcttgtggctcggtcaactctactgagagctcctgttgatggccagacccaagccctgtgttgaagatgactgagcaaagagctcaacagaagagtggctgctgggaatgccttcttatggtgggtgttgtaatgcttttattttgcagactctactggggccagtgaacaatgagggaatgaagtacatcattccacatgttagctggttaaagtcatggcacttggcagcctccttgagaaggtactcagaggtccgtggtcattccttagaggcatattgactcattgattaaaatgtgctggatttggtcaacttcctccataacaagtcatttataacacatattatttaggaaatccagaatgctctgagagctaatttaaattataagtactcttgaaagccatgactggaaatgactctcttagcccttcaggcccttgcagtgattggcagtgtacttccaaagaagggcttttaagtggtttggttcattatatgtgcattctacatccaaaagaacccatgccttgcatgggaggaattatgaggccggagcactcctctttattagaaatgtaaaaacacacagccttgccctggtcagacattcctacacccctggagagtcctaacacgggcttaaggtccacagaatcattgcaaattctgaatatgcatattctctcaatggcagtacatattttcccggcttaataggatgttaaaatgtggctcttgattttggctcaggcataagacaatgcctgctatattccatggagatcatcctacaaaacttttaaaaaggaaaggtatgatcccttaaagaactcaaaccccttcctcatactgttagtctgaaaggattgtggaaagttgtttttatgtttttatttgtttgttttgaggacaaactttttgaagataggtgctggtatatggtgaatctcattcttctcccacaaggaggagaggtggagaaagtgtttgcttctcaccttaagcctagtgagaaaagcttcagtaaggccattccaagaaagtcaaaaactttccttgaagttagggaatatattggcctgaggcgtgtctccacatgaaaaatgtaaaagattagaaatggtttatcagcttttacagtggtgcaaagggtaggtcattgctctgttaggattggatttattggggcaaaggatacaagagtggtacacacagaccagaaagttggaaaaatgctggtgtaggactatcttggattctgtccagtagggctatccagaagtgtaaacaggccttagcagttagaatctaaagggagtgccggattccttggtcaagtgagagaaagatgatgaaatagagtagacacgtcacctgtaaaaggctaccagaggtgggcagtatctgatgatggcatggggttgaggcctttgaagaatcaacaaaaatgcttcataaaaattaattaacttcaaagatcagcttggcccaaggaaacaaagccatcttttctgttctctgccctctgcttcctcccttctttttaacccagaaggcagtagaaacaaaagttaataggaaaagagttgaggtcagccgggcacggtggctcacgcctgtagtcccagcactctgggaggctgaggcaggtggatcacctgaggtcaggagtttgagaccagcctggccaacatggcaaaaacctgtctccactgaaaatacaaaaattagccaggcgtggtggtgggtgcctgtaatcccagctgctccagaggctgaggcaggagaattgcttgaacctgggaggcagaggttgcagtgagccaagattgtgcccactgcactccagcctgggcgacagtgtgagactctgtctcaaaaaaataaaagagttgaggtaaaggaggaaggatgaccacaccccactttcccaactttccacctatgaaaagcaccagctggcaaaggggaaaggctttaacttcaaaacaaacatgtttgaagtttaaattattatatagtaatcaacattctaaattttgtgaaatactgtatctagtgacttaaagtatctttaagacacttcatttcctaagcatgaccagtaaagtcatggactgctcagaacttttttaagaagcagggaagaatgcctttctctaaacgcttttcttcgggggatgatgggagacaaaattaagttgctttgttccatcccatgagttgtgtctgttgcatgtaggtgtaataccctcagatgcccgactgaggttatcctgccaacccaccagtctgcacttctgatcttgccagtctggtaactgctctcagagcgtggtgctaataagacctggaaggtgagatcccaggattctaaagactagtcagttatctgcaatgtacattttgcaatgtgaactgagcaggagaatagggttgggtcagggcattcagagggaagataagctcaaagtgggtgcccttcctattgccttggggcctgacaaaaattatttcccatgctcactggaaacaaagtttgaagttaatatcctttactagggtttccagatcaaccttgccatccaataaaaatacaggacactctgtatttaagtataagcatgttctaaatatcacatggaaattcatactacaaaattagtcattgtttacgtgaaattccaatttcactgggtgtcctgaattttaactggaagccctaagcgaatcctctccctcttctgcataataggatcacatttataccattatttctttaaaaatgcccagtgctggagccatcaatatctgcaatgatcccagtctccacatcaacatttggcatacgttgtctgatacccatcaagagaacagtttaaagtgtttaaattgaggccggccgtggtggctcatgcctgtaatctcagcactttgggaggccaaggcgggcggatcacgaggtcaggagatcgagaccatccctggccaacatggtgaaaccctgtctctactaaaatacaaaaaaaaaaaaagaaaattagccgggcatggtggagcacgcctgtagtcccagctacgcgggaggctgaggcaggggaatcgcttgaacccgggaggcagaggttgcagtgagccgagatcgcgccactgcactccagtctggcgacagagcaagactctgtctcaaaaaaaaaagtgtttaaactgaaaccatccgagaatttcaggcctgtgatccttttaccactgccctttacacgaaacagtggtcaaacaccaataactgttcttgagtaacttttctgccaagctggaaaacttccagccgtgtggtcttggacaagccacttcacctccctgagttctcatcacctgtaaattgataataataaactcctaatgagaaccaaataagctaatgaaggggaattagcatgcaacaccataaaagtccttacaaatgtcactacatagcaatagtgtaggaaccaatatgtctatattttaaattttttgctgttggtattcagtttacacacagaaacacgcaaatgcatgaaaattactttttaaggtaacatacaactccagaggacctgactccctgaggacagccatggctattagaaccaccacagaactccaattaatcagttcagatgccttctccatggaatgcttttccagaaccccctctaagtatccagaccttttaaatccccctgtcttttcctttggctgccaactctaggatggggcacacaacctgagaaagatctcaaagatgatgagaaaagaggaagaaagagtgggtgaagaaaagctgcagatcagagctcaatatgcagccctcaatggtgcaccttcccctcacctagaagcagtgcaagtggttaatagccactattcttggggagctggcaattctccacactcctcaggccagtacagactaagccactggagcaaggcaggcctgtctttctaggtgacactgctgctgtgcaccgagacccctgggatggcttccagaagttcattctcactggtttcagcactcattctacatttgcttcttccaagttcctggcagcctgtctttacttccttattaattcattcatttttgctgttgtttttgttgttccggctaacaagacttaagaaaagcccatttgatcttaatttcgtgttgctcattatcagttctcttttaatcgttttcttatgatcttcatcaaaaaagttacctgtaaaacccaggaagaaaagtccttcatatctccccgccctccccttcttctttctctatctcttttgatgacaaagtggcaagtgactttccagagagctttaggaaatctaaccaaatgacaaaatagttgtgtgatgtccaatatactgaataaatgtcttacagaaaaacctttagcaaaaagcctggggaggaaggtaacggcattttaaaaaatcagaagctcagaggagacaaacactgcttgatgagcacttgagatgaatactacaagctaatgcgagcaatcagcaggtttgtggagaatatgctgatatctgcagaaaaaaaatgcagtggcagagaagagcttacagataaacacaggagctcaaaaatatatatattattgctagaaaaaccttgacattttgaccatcttttatgttgcaactagaagggaaatacagagtccagttcttacaactgaatatccttctggtaatgaattcattctaaatgttgtttcagaactcctctacatcatgcttcatcacatagcaaattagccaggcaacccctcattaataagaatagttaaccataagaaccaacaagaaacatacattaataacatttaaaaatttaaatcagggattcaacacaggaaggtaactcaattcaggatccatatttgttaccttctgttgagcattctcactactgactccctcagcctcactggggttccagttgtcagccccccttattggcaaaggagctgtctattggactgtccaagtggtatagggctcatcttttcacgcctctcaggagctcctctgtggatgtttcttgtaaagcctgcatttctttctttccttctgcagaaagcctgaacagttcaaaacacctccacttaaatgtgtgcgcccattcacccatcccaaatggcatatagtcttttagtgaacctcagctgaaatgaacaaaaaagaaaatttaagttcacaccttcatgcaaaaaaaaagaaaaaatcatactttgtgcttatagagatggtaatgaaagatatgatttaatagatgtttattggatgttgacactcacccatcccaggataagagttcttcaaggcctgctatccagtgatcggtgatcaccttaccgttagtttattggctctgactcgccaggtatcaataataaagcaacaaatattctgaccctcaagcatgactcatttatacttttaattaaggtttaacatggtgaaacaggtaaatttgtttaaaagtgaacttgaggccaggtgtggtggctcacgcctgtaatctcagcactttgggaggccgaggcgggtggatcacaaggtcaggagatcgagaccatcctggctaacacagtgaaaccctgtctctactaaaaatacaaaaaactagccgggtgtgttggcatgcacctgtaatcccagctactcgggaggctgaggcaggagaattgcttaaatccgggaggtggaggttccagtgagccgagactgtgccactgcactccagcctggacaacagagcgagactcagtctcaaaaaaaaaaagaacttgaactgtttcgattcttcagtcattactgaatcactaaaaataacgtgatggatgccaggatacactgtctaaatccctcactgaagaatgtagaccccaacctcctgccgtgatgggagtgttaagctggagctaccagcctctatacggattgacttagctaaagaaagcccgaggttgtatccgcattctaggtggcccacatctgatgaccaatcaacccaggagaacaaaggcctggcccgctagtttcaactcagcacagctctgaaaggtcatgctagtttcagactttcatcaagttgagttctgtctcctttgagactgacatactttgacttcaatcctctgcccagttttactgccctcccttcccgtctaagggtgttgatctcaagagcgcttcctcattatctttctgcatgcatatcttcatttcagagtctgccttctggagaacccaaacttcagtagctacttcagtttgttttagactattggcttaacacacagagacctagtgagtttctttattagcccaggatctatgaagaatgtgctaaataatactctttccctccaaaaacatcatacaaattgttcgtagttttatccagaaaacagaagcctcttgaggagagagtagtggagaatgagtttggtaagagaagaggagtctagaataaaaatgcctgtgtaatgagggcagaagtgagactagtaggaaagtagacatatgcataagatatttccttcaactacctaaataattgttgataaccctgccattttacttcctgcaatggaatgaggtctctactaatggctaccctttgggagttcttatagtttttttttaatatgtcccagaaaatttaaccaatgcccattttcttaaaaaaaaaaatctatcctatttcttgcttgtgtttctgtctaaaaattacattggtgtaagtgtgggtgtgagtgagggcatgtgagggggaggctttatttatattgtgtctttcagagcctacagctacttctaattgaagcacaataataaatatgactagatcaaagaaatgttaatattatctgtggagcttccttatttagactttgaaacactcattaattttctttgattcatattcagaatatcaaatcaagatctaaaggaaataggctggagtggtggctcatgcttgtaatcccagcactttgggaggccgaagcaggtggatcctttgaggtcaggagttcgagaccagcctggccaactggtgaaaccccatctctactaaaaatatttaaaaaaaaaaaaattagccagacatggtggtacgcacctgtagtaccagctacttgggaagctgaggcaggagaatcgcttgaacccgggaggtggaggctgcagtgagccaagattgtgccacttcactctagcctgggtgacagagtgagacgtctcaaaaaaaaaaaaaaaaaagatataagggaaatagccataaatctattcatagataaattgcaatctggatggaggaaagaggagggaatgaaacttacccctaaaggcagttaaatatttcataagggatgcaggagccatgggctttttcaccttttaccatttgtgaaagccagtttttccagtattgcaggaaaaatcactacactagttagcataaaaggaaaacagaagagaatttcaccaagcctgtcaactgagagagtcactgaagccagcaaagattattcatgttcaacctgcagaccttttagaggacatcaaagatcaaaggtttacccaggaatgttttcctggaaagagtgtctttaattgttttaaaaaaatgtattgaacaatatgtgttctggaattgaactttggaataactcatcactattttaaattagtggtcattcctctattccttgttatttccaagcttagtatctgattcctaattccagtagagtccagaattaggcaactgctttttatgatgtcctgtttgtaggctagctttctgcatcccactgcttctactagattgacaagatgaggcaccttagatccactgtggaagtatatgtaccacatgggcttctattaaggcatgagtatagaaaggggaaatggcccaaaccagagagttgcacagagttttggcatccacaaactcagtgcagaggaggaaggattgatcaaatgagcttatttggttcccttcttttctccttcctccctctttccatcttttctccctctggcttttaaccctggttgtgaaacaaaattaccaattcagtttttttatttgcctttttaatgtttttaagaatgcctgtgcccaagcactgaaacaatttctgggaatggagcctgaacagctttatttgtaaaaagcaccacaggcaattctacagcagggccagatttgagaagcacagagctcctctatccaaaagtaaagcaccagtggacaagaggaccaaatgggacgtgcccagctgtaggctcaaccacaaattgtcatccatctccattaagtgataccacagaatttgtataccacctctcagagtcattattaacttcccaagaatgccacagtgttctgagggacgcagatacatgccaccaacatatgagaacattcttggtgaaatacgatttggggttcttggttcttctggggtttctgaagtctttatgacacagcaaagtctgtgctacggggacactattaactccttagtaactggttatcttagagttgcatatttctgttataaatctcaacaattatgatgaaataatttcataacacatttcaaaagtgtccacccttctttccctttagcagttcatgttaatttttaagtagtgaccctttacaatttctcacccaaatctggccttttggaaacagagctataaacggatacactgtggatggagttttactggcaaaaggcattttttaaaaattcccatatgttcctttaagtgattttttttgttctctgaaaccaaaaagcatatgttgaatgattttttcctcacactaatatgtcgtttcagacccttaccaggtctcttaaatcttttcactttcttcttttttcatctacctacaaggcaacttatgtgtagtccatgacttgatctcttttatttcctttgtatgaggagaaattgtgcctggatggaaaatcatgagtcttcctctctctgagcactcttgactctcctgtcttggggcatcattctttgtaatatagatttttttttcataatttcccacagttgccatagacagatgcaaaatgaaaagagggtattgattctctttcttttgtggggcatagactctttcagataacttcagttagaaaaaacaggatgtaagcgtgtgtgtgtgtgtgtgtgtgtgtgtgtgtgtgtgtatcagtgttggttctcaaccctgatttttcttttggagtaaatcagtgttggacccaaaaagcaaaaccaaatagaataaacaaaatgaataaactaacaattacctaatagctaagaacatgaactctgtaatcacatgaggtcacataacatgtataagtttgaaaatacctatttggaaaaatctggtgaaaacttggttctaatttagaagcagtagttctaatgagttttgtgtataagaaataggtgtgtcttagtccatattttatgacatagccattgttgtctagagcctcgtgaaactcactttccatcatgtccgctaaaaccattccctacttcttacaccatgtcagaccttccttgtgttgttcaagggatcttatatttctatttctaagttacaggtaaatcacgatgcttgctggtatctcttcacagatgttccactgccacatcaattcagcatataacacagtgaactgattacatactcccttaattttacttcctagatacttgtcaacctgtctctccccttctctacttttaatgcctttgtttggatttttataatgtctcatttgctctattgcaaatgcttctggcttagtttttctgtctctagtctcttaccctccaaatctattctccgcctgtgtgagccatctgaaaaaggcaaattcactatgatactttttcttgtcaatttttcagtgtctcagtcgcctttttagcagaacatataagaatttggatggccccactctcgactcgacttctctaggcaaatctaaccatccctgattcagacgctaggcttctgacttctcacacatctcaggctttttcctgcctctactcctggcttgcttctgcctccacctgggatgctgtttttttcttcttcagttgattagttggcgttcatttttcaggactgaacacaggtttcagccttcctgtgggtctgggcttgttacttctttaaccctccaaggcctcctgaagatttctctgtgcagcacttgccacattaaatcgtatggtatttgtgtcccaacgcactaattttaatgttgagaacagagccttgacaacttcatcttgccacccctatcatgaagctacaagtatatgctcaataaaaactttgcaaatgcttaatccagaaggaaacttacagattaactagtagaatgactttatttcaaaaattggggaactggctaggcgcagtggctcatgcttgtaatcccatcactttaggaggccgaggcaggcggatcacctgaggtcagaagttcaagaccagcctgaccaacatggagaaaccccgtctctattaaaaatgcaaaattagctgggtgtggtggcgcatgcctttaatcccagctactcgggaggctgaggcaggagaattgcttgaacccaggaggcagaggttgccatgagccaagatcgcaccattgcactccagcctgggcaacgagagcaaaactccatctcaaaaaaaaaaaaaaaaaaattgggaaactaagactgggcatggtggctcatgactattatcccggcactttgggaggccaaggagggagaactgcttgaggccaggagttcacgatcagcctaggcaacatagcaagacctaattgctaccaacaaaacaaaaacaatgggaaactaacatacaagaaactgaaataacatgtcagaggctaaatgtgaatttgtagctgagttgaaactagggcccagatatccccattgccttctgacacattttattttgagttgtataatttggcgtattcatgagaaacattgttaattggattatattaatttcccctaattaggtttgcttgggaaattgcagagatgctcagttctttcctgttcacagtgacccaagagcttgatacttttcagccattggccatttcatcctgcatctattctgctcttaatggtactctaaatagcttattttgcaatcttaaaaatctcatgcattatgtcagtagagatgtttgtttgtttatttatttattttttgagacgaagtctccttctgtcacccaggctggagtgcaatggcactatcttggctcactgcaacctctgcctcccgggttcaagcgattctcccacctcggcctcctgaatagctgggattacaggtgctcaccaccacacccggataatttttgtatttttattagagacggggtttcaccttgttggccaggctggtctcaaactcctgacctcaggtgatctacccgcctcggcctcccaaagtgctgggattacaggtgtaagttaccgcgcccggctgcaataaagatgtttctataagccaaactcattgtaattctgtgtgatacattaattcagatggtataaatgtttgctaactaaaatcaatatccagagatggaattcaagaagtgtcatctgagttgggaaaaaaatagtgcaactgatattttggtacaacttagccatggcttaacccatctcaatacagccacatgattcttctcctagcatagctactgagggaagaggaatataaagaattctctacttctcatactggttacagggcatgatattctttaactttgtagattgcgagatataagcttgtgtcttggttatatgttgcattattgtcacaaatttgtgataacgtcctgtatcttctccctgttttacctctgtgattaaaatatttttcaaacgtgcactctctccctgtcacctccatgggaagagcattttcttgcaccattaagccttgtgcttggccacaggacataacttggtcaatggaatgtcagcagatataatgtaaacacaggctttaaatgccttgatctcttatgctttaccattgccatggaaagacctttctctgcgtagctgttatttcctcacccttgttctaggaggagcacacgtgcaaagacctagaccaacctgcatcaaggagccgagcctaactaggcctcagattgaagcagtttcccagacaagcccaacccagatcaaccaaccactaagtgacccacagaggcaagaattgatacatttaagtcattgacttttgagtgatttgttttacagccagctgattcaactcctccctaataggctacttaattaaaaaaccttaagccttttgcataattgatcctaggacacttgcttctcctgctggtcttcacttccttctcttttgctgctgtcttaggctttttgaagtcctgtttaactttagatacctgtgcttgtgttcttttaagttgcttttcttcaatttctttttcttttcttgctcctttacctgatctgctacttctcctggaatctttttctttatgttatattttatttctgcttttatcttttgctgcccctctaaatgtctttaatttataatttctctccccttatgtgcctgatgctgctcattctgggctcttctttttgtttctgcctctacccaattcttgtgggatgatgtcccagctacatcctgctgttctttcacctgctctattcctccagaagcagaaaggcagacttaacaaatgatctgaaatcctccccttgaaaattccaatttgctttctggctccaatggcccacccacccccaggtgctctgggatggagcttattaattacactcccttcagactaccctgacttgaacagagggaaggaaagagagaaagtcgatagggaaggtgagagaaggaagaacttgggaatcttattaatggtatctttgttttctgaaatgagaattggagaaaacaaggcatacggtgcattcattgttttagaactgagaaacaagctcctattcgtcttgccaaaaattgcaaatgtgtgtgattcctctccattagctcacagcaatattggaaatgtatttgactaaactggaacacaccatcagcccaagatgcccagaggcagctcaatacagccatccatatgcttctctgagttaatttggaatacagagaattcagtttccaaactgtccccatgaacatttgtaaaatcctgcccatgtgagtggaaggtgatctgtaccaccacatgcaagctctcaataatgccggaggactgtgtcatgatagaatgcaaaggaacgacgggaggtattgagacctgcaactcttaactgctactgttttcattggtttaaacatattgctttatagaatttctgatttctcaatgctttattaaaggatcagcaggggttaggcagttgtagtgtaaattatataattgcagccaccacaaatgtatataatggccctcggtcgcttaccagccctctcaggggatacagattgaccatagttactcaactcacaggcaggaagtcccagaacatgctattacttccttctatagcatcatagtctgtgcattcttctacagattatcccaggcaatgaattgcatttaatattgctgtgggtaatatttcttcttctgtctcccttttgctagcactcctggaaatagctgaagcacagtacaaatacttacattgcaaaattatgttaagaatttcacttaacgtaaactgctccctagctcatatatcaaacatgaagtgggtagattgaacttccgtttgctgggcaacctcagtatgttacccatctacttctcccacaaccgttgccactttatctcttcccttcctggacacgatcttagttgcctagagcaccacaaactgcaaggcttaaaataacagaaatgtattctctcagtttaggaggccaaaagttgaaatcaaggtgttggcagggttgattccttgcagaggctctgagggagaattcattccttgcttctcttctagcttctgatggccgtcggcaaccctaggtgttcctggacttgtggctgtgtaactcccatctccgccttagacttcacatggccctctcctctgtctgtttcttctccttttctttctcttacaggggcacttaccactgggtctaggatccatccagagatgcatccaggatgatctatcttagcataataacatctgcaaaggccctttttccaaacacagcagcagtcacaggttccaggtgggcatattatgggagaccaccattcaacctactacaggcatcttgtgtaggcaccctgcctgcagctctcagtattctctgcatttaccgtgtgctttggatttggagttgaccagaaatatctcctcacctccactgcagcctgttctccaacctctaaatcggtgttggcagtggaaaaccactggaccagtaaaaataattgcgtttctggcctggctgtggcctcatgcagaaggcagaagagaagccagatgctctttctcatttcaggctattcagatgactgggactttcactgactcacttcatcttgtgcttttctttttatgtcttttagccaaaaatctttttttttttttttttttttttttgcccccagtgagcaaagtccactctgccctctcagtctgccaatacccatggatcatgattgctattttgcaatcctaagagactcatgtcagtctgtacagctaagagcacactgctcattcatggagagcctgctatatgtatgtaccagacactgcacatgatgtgaattgtgccttatttagtccttgtaacaaacctttagggtagatagcaatgcttcattttacaggtgaaataactgagtctcaaagaagttacctgcctcccccaaaaaatgcccaaagataacacaatggcagagtcacgattggaagcctgccctctgattctgccaccaagctgtgtccattggcatccagcttcctctgcacatcatttaatcacttgctaatttggcatatatgctctggccattttttatacctatggttttctgaccaaggttgttaataaacaccctgcatgcttgccaagcacctacctggtgcctagtctattcttctacttccagttggtgtgcatgaaggaccctatagttattttagtagagtaggtgctggtcacagtcccatgggagtgaatatgccagctagcatccctctgatgttctcttgtgattaattacctgtgactctgattattccctcactgtgaccccctcggcacttacatgctaaggttgtgcagtattcatttgttcttgtggaaatatggctctgtaattgcttctaaacaattttatttatgcatctgttgtaggcagagatctaaatctagcaatttaagccattactagatgatgtctataaggctccgagcaaattcccgggagctgggcacgtagtggggattgggcatcctagatcaacatgcatttgtgtgtatgtctgcataacaaagcaccttttaatgcaggtcagggcttttttcttgtatttattccctagttctccatcctcctaccaccacccggcaacacacatgttgcagtactgcccacagggagctaacataatggtgaccgactggtggagtcgattttcatacagattttgagaaagaagcagatatccaagccacagcacactatgggttcatttgctaccttagtaaataaaacccgtggctttaattccaagaggagttagtcttgtttcaaattatagaatacagccaatacagctatagcatgagccatgccggctcatgattgttacctcttggctgttgcccaaatctgaacattgtcttgtccccaagactttacttctggcctggttagaaaaatgttctaatctaattgtctgcctctattgcgtcgactcttctgggagataatggtccctgatgctgttccacatcctcacttttagctaactttgcataatgcacattacattatctctgtcttctcccattaaggcctgcaaaatcatgggcgattgattaaggctgagactaggctagaaatttcttttgcaatgaagctctttcaggagtaacattttttaaaaaacatattcataggacacgtagcaaaataaatgagactgcagacctccacgttctgcggaagaaatgctctgctgccactaaagctttagctattcatcaggggcaatggaattagagtcacagacgttccaatattgtaagagagaatgaatagaaacgatggctctgttgttttcttgtagtcgtttttaaaatggtctgtagaatgtgcctctgggcagaaaggaatgaatgcaaaaaagagaaaattttacacatttctgttaaacatcttaggcttctggctatagaaaataggacagcttcttttgagagaagtgtgtctagtgcattttcccatcacttactaataaaacaggacagacagactgacaggctgcctgaaaagcagcctcacagtggaaggacagcatgatcacacatttcagcctgggcacgggagccaagagactgtcatttaataagtggatgaagaaatcattttccctgtggcaaaaagggagagaaatattcagctgcatctctagacctctatcaggttaaaatgaatatgttaagagaattaagctgcacctcctttattagtgtgacagtaccctggctagttggctatattaaaatggcagacacagtgaccctgttgaactcttcatgttgataggcagtcagaaaataatggctttatagttctgcatctgctcagatctttccagatttgctaaaatttccaacgtctttgtctacttattatgacagcttgttctctcctgattggggtctttattggcatgtgagcatggcagcattatattttggcatgtctgtgtaatactgcagaaatcaccttacttcaaacttatttcggtgcctgtccttcctgccttgaaaaaggtggatagcagtataatgcttagacatcaaaccttcattttttctctccctatgaactctaaaatcattttaattgaaacaagaaggtttttgccccctgcattagcatgtggtgttttttctttgtatcaatcaccacattaagaattttaagatatcatcccattaaagctttacaataaccatgaaagctatttataatgacctattccactgataagaggacggaggcttccagaagttaatctggcataaggccacttggctgggattcgaatccagtcttttttgacttcgaaatgtttgtggttccacccactctaaggctgccttcacacagtggaacttgcctcttagtgaccctgttgaaaagaatgtaggagggtggaaagtctgaccgtgttatcttaaaattgataagttggctgaatacagaggcatagtgactgataatccaaatggcatggattgctgacctgctgctgtcatggctcaatagagccacttactatttttgactgcaccttacacctatgggagcaggtggtgtgaatgagagatgggaagaaggggtaaactttctttctaaagtaggattatatcaataacccagactcacaggtgtaacttgctgcttttcagttgtccgcaggaaaaccagtgtaagtcagttcattcctgctgtgtgatcttgaaaagtcaccttaattaccttaattacttccatattctgttggaagaaaagaaaatgaatgtaaagcacctaacgtcatgccaaacaaataggaaacactcaacaaatggtagatttagatgattctcttcttgtctgttatctattctattatccatttgttattcctagaagtgaaaataagtattacacctttgttgataattttctcccataaccagttcccctggttactcccattgcttgctgtgtttcctagcttctaaaacacatatttttttccacatttggaaaatcctggaattgcaattcattttataattggagtaaagggaagcatgccagctctccagaatggcatcacctgtgaaggtgtgctccaagccacatgttcaaggtatctcttcttctgattgtcaactcaggtgagctatttgcattggcaataccacatacatctaaattttaacgtaaattggaatcactacctattgctcagtataccacatgccctgttacaataaaaaagtattgtatacaaaaaggattgtcatgggagtgaaaatccaattaaagacagtagacataaagaattgcaaagctcgaggagattgatatatcttaaagaaccaggactcagatactcttggttttgataacatacagaataatgggtgttaacttttttattaagtttctaagatctctgccaaactaatatattcatgcctctattcaagagaaaaaaaaattcctgccagataattcttacttcttgctttaaaaataaaattctgcatacttctgtttttagcacattccctgttcctctgaggtaactttgtctctgctttgctgagatgctttctgatcccatttgtggtgtgtgcagggtatggggaatggcccctaaacatgccttccctgaattcctcatttgctactgactttcctctatcccgaaagggtagccaaggtgaaggcctcgtggttctgaggagacgacagcacccaatctgcaccaagttctactcaaaacacaggcatgctcatgtcatcagaatatcgaaatgcagaccaggatggaagagcttttgaagaaggagtgtaagatcgcatccccaacctgagtgaattcaccccctctccatgtgaagagagagagaaacttctgcacactgttaacctagatgtgaaagaggaattttcagagatgaaaaaccatttccaggttttcacagggtcaagttggtaaggtgggaatttctagtttttcaggaaaaatctagagtagtggtcacaaaaggtatgttgtcctctcgatgcctcagggtgagagggaggacaccttcatcagagctgagagagggactcccgtggggatgtgtccatggagatttctagatggcacccagagatcatctgtgattgagccggcactcgatactagcagcacaagaacccagaccagtgaaagtatgagcagaagaggccagccaagaagtgaccacaggccacacactaccacacccaccatggtccaagggcctgtgtcggactgaggagtgtcctgctctttcccaattccactttgaagccctcacacacaaaaacagacatttatccctccctgccactgccagatgacagttgcaaaattagaaatcggactcggggaagaaggcagggaggtacctgtgagaagcatgagggagccctgagatgcacattatgagctgcagtgtaaaagtataataatatattaattccagtgaaactcccaagagagactgtattaaaccaggagtgactgaaaacaaatttggttactaaatgaaataaataagctgttggttccaggcagatcgtaggccaaagtggaaagctggtatttgttatgagtaaaagtgagggcagcctcctaggtatacacccctggtgggtggagtttgtctctcactccatcagttccccattcttttttttttttttttttttttgagacagagtctcactctgtcacccgggcctggagtgcagtggtgtgatctcggcccactgcgccctctgtctcctgggttcaagtgattctcgtgcctcagcctccctagtagctgggattacaggtgtatgccacgacacccagctaatttttgtatttttagtagagacagggttttgccatgttggccaggctggtcttgaactcttgacctcaagtgatccacccgcctcggcctcccaaagtgctaggattataggcgtgagccaccgtgcccagccagttccccattctttatgataacgtacagtcatatcaaagaagaagttcaaagaagagttcctttacatttgggctgaaacctactcttggaccttcacctggtagctcattagtgttaacctaagaaccctgtttttcacctcagcaggcctgttactctggtaaacgccccaggacatgactgctctgtctgcccttccatacctctagacgctggcttggattgttcttcaccctgaattgcctggttctaactttaattccatctcaaattggatttcctctcttgcctctatacaatcttctctaccatccctcgtgctagtaaaactcttcttccagttctaactagtgttgataggcccatatggtattctgggctttgtcactgaaaatcctgaaattctttgcttcagtcatttgcagtgattcaggtttatggagcttctcatgttacacatggctactagagtggtgtacccatatggggttcaatttcctaactcccttctccctgactgctaatgcttttccttctgttcaggctgggcacttcagatctcaaacacaatttgttagtatccatctccttagctatggtagaacagtgacttctccagggatgtttctgagttcgagactaatgttccatttaccacatctcaagatcctgttcctgttttgcggaataatccctgctgcactgtttttattttgtttttttcaagttaccaggctttgtgctctttttccctgtagtttttctcccatgtttatctattgtttcctacgaatatatgctgagagtcagtgggcctagtgtgcataattcaaatgtggttcgacagcacagggacacaacagacatgattagatcattcatgtttagatcaggaaggatgggggaaaaatttgatttggggcttggggagcacagttaacgtttttccaggatagccaaggaggatttatagtaatttttaaaaattgtgtcaggccaataaagtttatgaactagatcccgtcacaaaacttagattgaaaactcatccaacaatggctaatagctggaaagaaaatggttgccctatgtttcaaaacaaaagtagagattcagttgaactgataaatatgaatgtgtttatacagacaggtgaacataagttttcagattgggggaaaatgcaaagtatacacatcccatatattcatggccagagaattctatcttgttcatcattcattcatttcataaatagtaggtataggcatatcaactacgtgccaggcactgtgataagccctggggctacagaaataggagacatggcttttggtctcttactaggaaacagaatagcttcaggctgtgtagtgcaaccatggtcttctgtgctggttgtgttaggtagggaaggtgggggtggagaggaagttcagggaaggctttctggaaataatgatagctgactgaatattgaagggtggggacagggttttaggaacaaagaacaattgatgcaggcatggaaaacaagcatggaacataccacatatggaacatgtgggtgtagaagggaggatgagtgaaacagggcaggtaggatgggcacagatcgagatggggggtttttgatgtgttaagagattcagattagttctctgatgtctctagaaggccatcattagtcttttttttttttttttttttttggtggggtgtatttcaaatactgaaaaagtcctttgggctcttggggctccccacactcatggttcctttccccacaactcactgccctcctcccaacagaaaatctatttcgaggacagtatgctttttaaatgaataactaacattgtgttctcagctaactgcagaaccagaggagctgtttgcatctgtctatgcagattgagtttctttaatctcacaccaggcctccagccacatggaaacaaggcagttatctgcaaagctgaactagatctcatctctagtggactccacttccccctctcatatttatcccacaccagcctcatggttaagaaggaccgtcaggaatgtttttatcaactccaagctctaattcatattcctccaagtctctcaccccaccctcccaaccctgcccccaagatttcattgagatttctcccaacagttatttggaaaaaaggtaaaacaaaacatgttcaaggtcttggtgcttagcccaaggggctccatgtgctgggacactgatgggcaggggcttctgcctctctaacccatgcccaagccacctcctgacccctggctgcaaaagatgggaggggcagaagccatcacaggacttgtaactgcccaatgggctcaccttacccggtgcctagacagagctgatttatcaagacaggggacttgcaacagagaaagagtaaaattctcagagccggctgtgcggagacaggagttttattattcaaatcagttttgcccaagcattccaggatcagagattttaaggataatttggcgggtggaggaaggccagtgagtcaagagtgctgattggttggctggagatgaaaccatagggaactgaagctgtcctcttgcactgagtcagtcagttccagggtgagccacaagatcacatgagccagcttatcaatctgagtggtgccagctgatccatcaagcaaactatctcaagcactgatcttagaagaagtttagggagggtgagaatcttgtagcctcaggccgcatgactcctaaaccgtaatttctcatcttgtggctaatctgttagtcctacaaaggcattccagtccctaagcaagaaggaggtttgttttgggaaagggctgctatcgtctttgttttaaactatcaactataaactacgttcttcccaaagttggttcagcctacacccagtaataaacaaagacagcttggaggttagaggcaagatggagttggttaagtcagatctctttcattgtctcagttacaattttgcaatggcgatttcagacccagaggatcagcatctcaggatctggcagagccccgggcaggatcattcagcttggccacccgctggcttgctggtgatgagtgaggattttctgggcagatcctgtgtggtggggatgtggtcaccagtcatcaggttcttgtctggttgtgcacttggcagctgcttattctcctatttggctttggccatgttgtagtctcctgaggcaaagtactttttcccttttcggagtcccttcataaggaagctgggcccccaggcctttgtcctaggcttggatatttggcctttagcttttccttctccactgtctcagggagagtacattctttctcccgcatgccctgcttcttcttgcctgtctcctccacggtgttctcgtttagtttctgggacattgtgggactgggacaatagagtataggaggtccaggaagtcaaccaactgagaggtggggaggggaaacgggacatcctgcgatgctgctttggtccctgtcaatagggttgctcctcatcagtcatcttaagcagggcgtggtctaaacgaatcttcattccagatagctgaggcagaggcagggaggctggtaggagactgccgttgtgatctaagcaggaaatgatgaaatgatggcaaggctgaatccaagcagttctccaggacagaaggacactcagaagatatgtgactgcatggagatgggggacaaggcagggcagtgctttggatatggcccagtttccaagcttgtgaaactaagtgggttatgtcccattcactgagttaagaaggaacgaatgagtgtggggtggaagagaatgaagttttttcctgaatgtgtttgtgttggggtttgttataatgagtctcagggtctggggccatcaaagaagggatgatcatgttgcttctggagcataagagagaaaaacccaggttggatatttagatcattggaggaaaaaaataaaagggcaattacaacatcttgttagttaacctctcttgccccttgcctcctggtctgcagactgaattgtaatggctcctacctcaggcagtaataggacaaactgagataacaatatgtcagctatgaagaacacacctgtgcaatgtgcaatgactgctgcttattattaatattgttattaatttgttgaaggtggaagaagcacttagactattcatgtaatttatttctaaatttaaatttaaatgacagttcctagagctacttacagagactccagagagaacccaccttctcagaggttcccctgtcatcacccaaccaagtggacaaaaagctgttagagtcaccaagctgtttttttgtttgtttgtttgtttgtttacatcattgccggttagatggcatctttaatgtcagggcagactcacacataactaaggcagtgctataaggagtagaaataataactgaaaatgtgttatcaagcagtagatgagtctcaggattctgggaacatatggttggtattggtttgactttagagaaggtcacagaaaaaaagttttgtggactccccggtgataactgggggcctgggggagagaggcagtgaacatcatctggcccagaagggaatgttctgggtcacaggcagttcctgaggatacttggggatgtcactttgttcatgctgttctaaaagtcaaggtggatgttgggctgaacttttaggctgcattcacgtgattggggtagaacattttaacacattgccgtttgctctcattgagtcatgtgcatttgttcattcttagtctcttctctctatttcaaattatttcttcccacctgtttggaacaacatcagcattgcatattggcctcaaatgagttaagattcctaagttcctaactagccatagcacaaggtttttcagcttgactggtctcaaggcttttctcagaatccatcgattcttccagaaaactttgctcaggacatgcagattgcaataatttgttttccccaaaatgtattaagaattatttatttaaaaatataaaaacttcctctaaacagtttgagaatctcattgctgaaaatatataaaatgggtacacaattaatttctctccagatgtgatactataactagtaacttatttaaagttgaaagagaataatttgcatctggaggaaggtgttgtaaatgcaagttctggtcctttcatgttcctgatgtctttggaatttgtctttgtctttagagtagtgctgttttggactcagctccaatacagatgacttccacgctccccttggactgattaagtgaaaatgagagaatgaaataatattatccaggagattcacataccccaccaagccacgcagaatgtacttttaatacataggggtagtttagacacctcaagtctgtatggatacctcagggtttaattgggttttgtggtgatgccccaagagcttcatgccatttttagatatatttgttcaaaaacagatcaataattgatttagatgtgggaggtaaagatagatgcgcactaactgtggatgggctctgcagtgagaaggcagtgctggggctgctaatggtggctcaggtggatgcacactgaaggggaaggaccaggggatggggcgaggcattgctgtcattcgtcttgaacggaacagttgtttcattctgaaagtgcttgagaatatactctttggtgctttgagtttggctaatggttcatagtctcattgttctgatgaaatgacttcaaactcattgttgtcattattgagaaacaagttctctccaaataagtttgaggagacattctccaaggaaacaatctcttaaatgtgagatatttgtgaactttttccataaaatacagcagtgcccccttatttgtggtttttcttttcacagtttcagttgcctgaagtcaacttgagtccaaaaaatggcattactactcttgcactttggagccatggtgaggtaaaatacgggtgacttgaacacaagcaccatgataccatggcagtggctctgataaccaagacagctcctgaatgactaacagggctggtagcgtctacagtgtggatacactggacacagggacgattcacatctcggggagcaggatggcatgagatttcatcacactactcagaacagtgtgcaatttaaagcttatgacatgtttatttctgcagtttcccatttatttcacaaggcctacgtcatccacctcacttcatctcctcacgttggcacatcacaggaaaaagggtgagcacagtacaataaggtattttgagagagagagaccacattcacataacttttcttacggtgtattgttataattgttctattttattattaattgttgttaatctcttactgtgcctaatttatataaattaaactttatcttaggtatgtatgtatgggaataagcatggtgtatgaagagttcagtactatccttagtttcagatatccactggggatcttggaacatatccttcacagataaaggaactactgtagtgatatcaatgcgttaattctggaaaaatattacatttcagtcttggtgtcaaattctagcaaagaataatttttaggactatgagtaaaccaaggaccaacaatgaagtagattccatgtcactaggaatagaagttttggggatgtgtgttcatgttttcatatgacttgcacctgtctggaaacaaaactgtttctaattatttttaaataactagagttcaatctaatgtaaactatatacaaaagccagatagcaatcactaactttgttacatcataggcatagataattttaatgaaacatatccaccaagtatgtccaatttctctgatgacagtgctaacttacatgcgcatcaaacatttgataaatgaatatgttaatgactgtaatgtcttttctgggaatgcctttgttggggctcaacacattgttaaggagaagaaagcagatgactgagaggaggtttgtaaagtggggatggggagagtagctggaagccatgaacaaattcattctcagaggcacagatccccctacatgagctaggacctatgctaggagctagattcacagatatggggacgctatgggctttgccattcccaagcttcttgtccagtaaaaccacaactcagaaatcttgcttaactaagtttagcaagttatctgcctatctatctatctatctatctatctatctatctatctatcgatgtgtctatgtatctatgtatctatcatctatctgcctatctatctatgtgtctatctatcatctatctactgtctatctctagataaatatatagatatatacacataatgcatagtattcaatagtactatgtgaaaattatgttaaaggagatgtattagtcagggttctctagagggacaaaactaatggatacatatctatatatgaaggggagattattaaggataattgactcactcgatcacaaagtgaagtcccacaataggcggtctggaagctgaggaacaaggaagccaggagtggatcagtctgagtctcaaaacctcaaaagtagggaagccaacagtgcagccttcagtctatggccaaaggctcgagagcccctggcaaaccactggtataagtccaagggtccaacagccaaagaacttggagtctgatgtttgagggcaggaagcatgcagcagaggagaaaggtgagtgccagaagactcagcaagcctgctcattccactttctgcctgccttttctagccatgctggcaggcaattggatggtgcccacccacattgaaggtgggtcttcccctcccagtccactgactcaaatgttaaactcctctagcaacaccctcacagacacacccagaaataatactttgcatcctttaatccaatcaagttgacacttaatattaaccatcacaggagataaatccctggacttcaagagaacctattgtcaccaatcattttaggcatcatttcatatggtgagtagaactgtgctatatattatattatgtgcagaccggggttagaaagctatggcccacagactgaattaggcccactgactgtttttataagtaaagttttattgaaacacagccatgcccatttttaaaatataatgtctccagccgctttctgacaaatagtggcaaacaatgacagagttgagttgttacggtggaaacaacattctccaaagcctacaacattttctctctggccctttacagaaaaagtttgctgatttctggtataggacaatattatataatatgctttcattttaaacattgggcaccactggttaagtcttattttcttccaaacataacaactatatgaaatctaaccctacagagcccaggagcctacacaccactatttagttcttacacctcattgatataagtaatttttaatatcttgttattatttctagaagtctttttggtatggttctttccatatctagcagtttgtgatttttttactttaactgcaatatgtagcagtttgtgagggataaaataaaacccccttttccttctgtttaaatatatggaatgtcagcaaaagcctcctgttagcagtagctgaatctaagaaatgaaccttttatacattggcttacactattttgtccaaagccaaaaatggataatgaaggaggaaaatgacaaacgttctttcctaaagagaagcatccaagtgtagagaagaccacaagtgactataaaacgaggaagccccgtagctaagggattcacaggtaagcccaggacatgtggactgtggaaggccattaatgtgacatgctctgtggtattcagataccttgctgcatgctgggttcggctctagggaattaagaaaagaggaagatggatatggaaaggtcaatggcaatgggtaaagacatggaaaactatttctataaccgtaaaggagactgagttaatttatcttgaaaaataaaaaaggtaagaaatggcttgccgtaatttttctaccatttatatccattatgatacaaaaagtaaacacttgctggttgattgattaaaacatatgtaagatagagagtggcttagtaaaaggtattttagttgcaaagacagaaatacaagaactagtaagtctaacaatgtatctttatgactcttgaactccaacaaagactttaacagcaaggagttagaaaacttaggctgcacatgggtcttgggaatgattggaacaacgttcctagattctgtctggattctctttccagcaatacatgcaaactttcttctctctcctttcagtctgcccctctccttaccgctttgagcatggcagatgatagcttttgaaatttgtatcagttatccttggccacaaaaaaaaaaaaaaaaaaaaaaaaagacatatctcaaactctttttatgatcccagggaacagaaaatcctggggaaaagatgcccaacttgggtcaggcatctgctcttgggcgagtcaccttagtccagtgagtgaggccgtgtggtgatagtgataatatgctgcacctgcattaaccatacagatgaaggaaggaaaacttaatagccaagggaaaactggcagaaatttctaagtgaacactgcattatttctttttggaagaaatcttcactggaaaaaatccagaagaaatagctcagtctgcaacatgaaggatttaggttagaaaaaaatgagattattctgacattagagcttattacacactgggatatgttactgaaagaagcagtaaaatgtcttttcttagaggtttttaaaaatagaattcatttctcatcagttgagatgcaaatagttttcaaaatggattagacacacagaaattttgtttgacgtgcaaactcttgacaaggtcctgcctctttttgccagtaaattcagctcattctagccttttggtacaattcaacaaatatttattaaatgtccactaggtgcaaagcattaggctagagctaaaaggtttatattatgttatggagatttagaaaactgcaaatggggtgggcacgctggctcatgcctgtaatgccagcactttgggatgctgaggtgggcagatcacttgaggtcaggagtttgagaccagcttggccaatatggtgaaaccctgtttctactaaaaatacaaaaattagccaggcatggtggtgcatgcctgtagtcccagctactcaggaggctgaggcaggagaatctcttgaacccaggagatggaggttgcagtgagctgagattgtgccactgcactccagcctgggcaacagaacaagactccataccccacccccccaaaaaaaaattgcaaatgactgtaatatgtggatagttgaggccattgtcacaaaggagatttagatttattgctgtggaattctaaagcatgagagagagtcatgaaagagagaagaagagagagagatgctaacagagaaacaaggaaacacagaattagcaaagtgttagttgatagactgagatttgaaatgctctttggggtaaataggatttcagtaggtagagatgtgtgaaaaggcatttgggacagttacaagtttgtgaacagtgatttggatcatgttcagggaagcagagagtcattcttttaaatggaaacctatggtaccagcagggaagagataacagaaaagattaccaaaaaaaaaaaaaaaaaaaactgggaccatcctctagaaggccttaaatatgctgagtattaagttttgtttgttttgttttaggaagattagtatggtaatgtgaccacccaacaagttcttcctgccccactgcacaaataaagaccacggcattgcggtaaagaaagagtttaattgacgtgaggctggccatgccatacaggagaccaagttactactcatatcaatctcctggaagacttgtaggttaggggtttttcaaaggcagtttggggaagggggtgggtgtggctaaaatggatgcttgctgctgattggctggggcagagatgaaatcatagtgggttgaagctgtcctcttgagctgacttacttctgggtggggcaacagaagcaagagcaaggttggtgggggccaggtggagtcatgggtatcagacctgcaaaaaacctgggaaaatgtctcaaaaggccagtctacaatagtgatgttatctgtaggacagatcttgtgaccagtctatgccttagcagaattcctgcccttctcctagcctgatggcctttcattagctttacaaaggtgattgaattttggggaaagcctattatcatgtaaactataaactaaagttagcttagcctaagaccaggaatgattaagggaaaggcaagatggggggttaaatcagacttgcactgccgtaattttctcactgttataattcttgcaaagtcagttttagtacctctgtgagacatgtcatgccaaggaaagagcagaagttgggaagaagaatttgaaggtcattgcagaaacttatcctgagtcatttaactaggtggtggtagcagaaatggaaagaagaaactatatgggagggagatggtagggaaataacctacagggctgatggattaatgggttttatgtattgtgtactttcaaaacactaagcattaatcaaaaaatagaattctttaatttcctaattccttaaatactagacctttatttacatatacatttaagcctcatatcaaccaaataaataggtcagcctttatccccattttcatataagcaaacagatttagagctcttgaataattagctgaggccatattgctagcaatctgctaagtgggactctgaacccaggatgtctggctctattgctcatgttcttaactacacgcagctcttctctaattgaagtatagagggaaaaggatgagtgtgagaaaacaaggaagtttcaaccctggtggattgagaggtgttccagttatgcattggtacataatagactacccaagacctagtggcttaatacaacaaccattttgttgcagtccgtgattttgtctattagaaacttggacaggcttggctggagaagtctattatacaagacatggacaaaggacactcagtgccattcagctggcagatgggctagtctagaaggagcaagatagcttcattcccaggtctggcaccttggtggggatgactgaaagtctgggttcagctggaatgaaaaccagagccctgcatgtggcatcttcagcaactgggtctcaggcagtcagtggattatttttgcctgttttgggactttatgtaaatgaaatcatatggtgtgtattggtttctttgactcaatattatggttgtgaaagtcatccatgttgttacatgcagttgtacttcattttcattgcagtattctatcacattatgtaaatatactacattttaattattcattctactactaatggacatttgggtcattcccagtttgagctttaatgaatagggctggtatgaatactcttgtattcatactcttgtatattgggtgaaatatattcgcatttctgtggagttatattcctagcagtagaattgctgagttgcaggatatgcttctgttagctttaactattttctatactgtttttacaaatttgcactcttgccagcagtgtatgagaatttcagttgttccacatccactgttaatatcagaccttgttaattttagccattttagcttttctgacgcgactgttttgatgtagattgaccccaaatcagagtgagggcgtctctctcccactgcatcattctctgcttaactaactctctatgccttcccaagagattatgaaagacgcctgtctgattcttccatttaagtattttcttatcttatagaaatacgtgggatatttctcttaaaattctactgaagctttgaaagaaatggttcaaatggaccttacattcaaataacctctcctgatatttaatcagtgctctttccacatctttcagccaaataacattcacttgcctttgctgtatatgttcttatgtagaaataatagtctcaacatccatcacagtgcattacatgtgggaaatatacttccaggtgaaaacttgttgaattttggatattttgaggattttcagatttagttcaacctcatccaatatgtttcctttctaagtaacagacttaagagtaaatttgggctcagctgccaggaagtgaaagagaaaatgatctgtacatgcagatatggatgtagcagaagatgttttcctaaatcgcaaaatcaaaagaacgatgtctacacaggactcagaggaatgaatgctttgaagtaatttagcaatgtgggaatggtcaaacattttcttctgtaaaatctcctgctctctgccctttcattttttttccgttctcattctttttcttcccaggtctgtgataaggctagataacataaggaagtcacttggcaccgtgtccagcccatagtgcttccggtcctgcttttgatgatgacgatagaggagatagtagtatctccttctttaagatattttcaagtatgaaagtaactgagttagtgtatatgaagtatcttctagaaagtttgacatatagtgatcttcagagcagatgcagaggaagccagacaagagggataaataaagcaggcaagatgatatcgcaagagataagacaaaacttctgtgctctctgcatttgcctttccaagaagctggtagtttaactttccttgggctttctgcaaaaatgttgtgcatctgaacttgagcaattttgagtgtttctcttccttgcaaacaaatgagccttgacttgagcagtccctttagtaggcatgtcatacattatagtagtttttgtgaccctctcatctctccaactggattataaaatcctcaagggcagagatgtctctaatatgtctttgtattctgcctcgtacttagcacaggacgggagaaatgtcatgttatcctgctgattaagtccattaaggattcaggttgcataactctcctaatggggaatggagaataaattctgcaagtgagtttaatgttcacgaaaatcatcaacagcaaatgtagatgcatgccctttggccgtgcacaaaatgcaagggagagggtggtcttttcctaactctttgtgaattaccctcgctaagttctcacctcaggggcagaatgcaatttgttttttctcttatagattttttctcagccttggtgtgaagcctccaactgagttggaagatccaaactgggacagggaatttaaagaggggaccacaaaatcgattccaacagaactttaagtttaccccaggttagcttcatctgttgcacacagaggcatctgcttaacagatcattgtagatatgattgcaaattccacataaagggaatatttataggaaggtctgcctttctgaatacgtaactaaaaattagtttgttttgtaaaactgtactttaggccaaactctgattcactgtattaagagtcccaaactaaccaaatgagagggacatactagcaaagacatcttcatccacatgcgggagggaagagggatactgccaagttcttgcagaaggacagcacggtctctttcagctccttaaatatgttctgatgaggcacttcagtaaaacatgcccatctgcgtgttccactggactaatgaatatgaagtgtatgttcagctattgatctgaattaagtcctaggaccagaatttagtgtcattaatgatctctttaatgaacgcaggcagaaaccattatcaaatgatgattttttttttcatcttggaaagattattttaaatccaaacacattctttcaactctgttttaaccccccagagatatattttaaaagccattgtgagaaagtaaatgagaacattgtccaaagcctgggagtgaagcatttggtaggaactggaggtggggagaaggaatgttaaattcctctttcttgaaccattacagtactttttccttatttggtgcatgtctggagggacagggcttgggcaggggaatgccccttctactctgctgacaaaaagcaccaagagtggctggaaaaggctgtagagcactggtttccagattttgttgcaccttggaaccacttggagagctttaaaaaacactgatgtccagctcttacctgcagacattttgatttcactggtctagagggtgatctggacatggggattttgaaaacagtcagctgggcatggtggctcacgcctgtaatcccagcactttgggaggctgaggcaggtggattgcctgaagtcaggagttcgagaccagcctggccaacatagtgaaaccccgtctctactaaaaatacaaaaagttagctgggtgtagtgacgggtgcctgtaatcctagctactagggaggccgaggcaggagaatcacttgagcctgggaggtggaggttgcactgagctgagatcgtgccattgcactccagcctgggcaacaaaatgaaatttgagcttgagcgagtttgagcgaaactcttactcaaaaaaaaaataaataaataaaaataaaaataaagaataaaaataaaataaataaaaagagtcttggcttattctgaagacagtcttttaaagtggccaaatgaaaaataaatgactgtgtcaattcagtttattgtaaacatttactgagcacatactctgtataaagccatatgctatgctttagtaatgcaaacaaaatgtaaaatatatacctacccctgaggagctcacaagtttagcggcgaggggggccagttacatggacagataaatgcaatgaaattacaactcagttaaatacaaaacattgtgatatatacaaaatcaaaaattgtcccaaagtagtgcaaagtacagaaaaagagacaggaccaggaaataccttacagtgtaatttccagatataaaataacaaatgatcagtatttctgaaactttgagggccagaggaagaatgggttgtagcaaagaactctatcataagggattttctatgttgtaataacatgaggtttcataggaataaccagcatcttagaatggggtctgtcttagtaatagtctaatgtaaaacaacacgattatttatttatcttgcctgcctactttccgttctccttccttccctcctcccctgctgtcctcctttcctccctccttccctcctctccttcttccctctctcttttcctccttccttttctactctcttcctcccttccatccttctttcgttcccttctttctcccttcctccccttctttcttccttcctcccctccttccctctttccttccttctatctgttcatctccccatgttatacctacctacctacttcctacagaggcacctacaactttgcctttcattgtttaactgagttatagattgtgaagactagagtgacttaaccacccaccctcctttcaactgtgtggtttattacacatatgtatctcattgatgttttttgtggacattgcacttgtgtaatttattcttttctcatttgggtaaatatgaatgcattgaaataaagaggactagttttttttttatttcaaaattatatttaaaaggaaaaaataatgagacaacagcaagagtcactatttaactcaatttgctgtattcttaaaactggaccttacagtaagcactataagtaagaaaacagctactttccaatggagatataaataacaatgccagatgagctgttgctcttaaatcttacagtgggacttcattagtgtgacaagtgagaagtaacaaatttattcccagaaccagaaaatgccattcaggataagtgttttgattaattcatttttagagaggtagggctgttttaatcatgacaactcttatttgccataatagaagcatccgtgaattttttttttttctgaacacttcatgtgtatttaccattccactgtcatgatctggttattactaggactgggttgctattaataatcaacacattattttaaaattgaacaagctaatatcaccagcctgtaattttctgggtttacacattgaatctattaccataattaagttaatagtattttaaatgaatgtttattttttatggctttgtgtagcaaactacaattagatgtttgtctgcatacacatgttttaggagtgttcactctgtaaatggttttgtatgaatctattgtaagaaaaagttcaacctcttttgcatctccgatgagttagaattaagtgatactgctcctgtcaattcatttttttaaactcaaaagtttcactttatctgtttatgcctctttagtttgtctgtataccatgaacacatatccttcatctttccccaccttagtatccactaggttttttcctctctggttgcctatcattagtcaattgtttttcatgctaatcaaagagcagagaaaacaaacgatgagcatacaggtaaaatgacattcatgggtttcttagttctttggacactcagagaagagaataaaatagcagtttgaatcatttgtggttctgctgtatctgtaatccacccatttgacataatgtattattggagtggctaattggaagttcatagggtgtgtttccatatgcttattataaagaacagatgtaagagtcaatttcctgtttgaatggtgatttgagcactgagcaatttatttaatcagaaatgtctttattattcataaaactgttccagtctgatcccatgtgtttgtttcaattctgaatgtgactctctacccagggctgataaactctgttgttcacattaggatgttaaacagaaaaggtcacgcatctgatcccatgtggcctaattagtgtcaaacaaagaaaatgtctgtaaattgttataggctgcagtaccagaaacccacgttacttaccttatggggattaaaattgccacaaactctgtgccagaccatccccatggctgtggcaatggtactaaagccacattccattggtggtagagatggcagccaggagtaatgtgtcggatattgtcagttatcgctcagcatccattttcacctttttcaatgtgtcgtactgtgccacaggggcttgagggttaaaaatcaactttcctgactcctttgcagctagggttctagatgtaaatgatgttctgacaattagatgcacttgaatgagatttgaataaagttaaggcaaaggccatcttcttgctgctatttttgttggtgaagatggctgcagaaatgagtattttcaggtgtctgtggctgtcagacttggccttgtaagtgtctagaagcagttgtggcagcaacagcaatgccttcctgacctctgcttgcagcagctatagttttatgtccctgtactaatttgttcagagtgaggctcctgactcctgatctaccatgctgtctaggaattttgcagccagctaagctactgcattcaatcccattctacatgaaataccaggtttctgtttcctgcagtcaactttgactgatatgaaaatagtcataaccacataaatgaagagttatagtttactgagtatctattaaatgccagacaaattgaggatcagtgagataacttgtacaagttcataaagctaacgaatggcaaaaccagtgtttgagtttcggtccatctgtttgcaaagctagtacacaaagggcagaaactgtaatatgtccatttctattttcaatttttaaaaagaatgaaatcatgtcctctgcagcaacatggatgcagtcagaagccattattctaggcaaattagaacaggaatagaaagccaaatactgtatgttctctcctataagtgggagctaaacattgggtactcttggacataaagatgcaacaatagacattgaggctactagagggtgggtggagggagggaggggagcgagggttaaaaaactattgggtactgtgctcacaattgatgggaccactcataccctaagcctcagcatcctgcaatatacacatgtaacaaacctgtgcctgtgcctcctgattctaaaatagaagttgaaattattttttaaaaccccacattttagaaatccccaagggcagctgggcacggtggctcacacctgtaatcccagcgctttgggaggccgaggcaggcggatcacctgaagtcaggagtttgagaccagcctggccaacatggcaaaaccccatctcttctaaaaatacaaaaattagctgggcgtggtggtgcatgcttgtaatcccagctggtcagcaggctgaggcaggagaactgttcgagcccaaaaggcggaggttgcagtgagctgagattgtgccactgcactccatccagcctgggcgacagagcgaggctccctctcaaaagaaaaaaaaaaaaaaaagaaagaaaagaaaagaaaaaagaaaaggaaaaagaggaaaaaaaaaagaaatcccctagggctagggatatttggaaatccccaagggtttgtggttttctaaatttctattcaacattttagaaatccctaagggaaggagacttttgtatcctcaagtgcttgaggtctataacatcactgacaaaagaacacattctagaagaaccagatagaatatgtgcacccttgagactggaatagctgcatcattgaagcaagtccatatcagcttccacctccatggtaatacttgggatgcatagatgtagaatctagtctcagaagacaatgtgattctttagcccattcaatttgttcatccattattttttgtatgcatcatctcaaccctatagggggcagttaatgggttcggtttcatgtttcagatccccttgaccttgtttgtatgtatatcacagtgtttatatagtcagatctttcagggactgaagcaagccccgaaaagacaaagtgcatcattagctgggtttttcaggatttcgtggccagtgtaaaacaaaagtgggagagtgatagggcagaaagtgctctattatttctgttgtcaacaaagactcagttacctggactgagagcactgcccttcccagcctgcaggaagactcaacgccggggtcctatgatgcacaagtgagagaagggggatgttttgcctgagaaggtatgactctgggggccaagcaggaggggatgagctgtcacatgggagagatgcaggctaagaactaaaactaatgaatggaagttacagagaggtaagaaatttttttccaagaactgcctgggacaaacacagctactccaggaagccacttcactgctgaaggtgttttgtgcaaaggtgtgctggcagttaaagaggaatgctgcagataagattcagctccataaaagagtgtgaagatgtctctcatccctgaagtttataggatgctccccacaaagaactgcagatttcctttctaactcattgactggagctcagggacaccatgggttgaagctatggctctggagggaactagcctagacttacatcctggtcctgatatttacttgctgtattaattctgcacttcagtttctccgtctgtaaaacaggggaaagaacagtgtctctctcataggggtaagtgtgaaatcaaatcattcaacccatgtaaagtgaattgagcttcttattcctattggctatgtggtgattgacatcggagctcccaaacagttcaatgggagaaggttgcaaatgaattctgcactcagatgctcactcaaatgtcttgagaactaggagaacccaggggaccctgtgacaaattttcaacaccatttggtccagccaaagggttgtttcagactggctttctcagtgcttgagagagaatctaaatatttctcaaggcatgcattacaaaatgttcaagtagctgctctatttttgagaacatgcacataagacaggcccacaacattgggggatgttcgagaaaagaagggagaccgtgagcccaggtccaattagggatcagcaccttctgtgtccccgatctttacatggataatgaaggactggggagccgcggttgtgggctgataccatggcaacccctcttccatgattgtcacatacagatgagtgagtttttaatctcaacatcagtcctgaatctcattcattatttttaagccctaaaccagaaaataaatattgcttgtctttctgcctttgcctaataagtaactaaagtttacataaagacttggcttactttggttgtttctctgttgggtgtgtgatgtccaaatttaattaaaggccatgctgtcggctataaactcctttagtgagagaaaatgacaggaaggcccagaatttttttttacgaggcttgtgttgattgagttaaagcatgtgttctaactgagctcccttggaatgagccgtgcattgttccatgccacctggctgcaaaacaaacacaaggaatttggctctgacatgaagaaaccctcagtattagggaaatggagctgcattccacatggaagcatggcaacctcgggctctgttcctccccctttgccctctcaccagacccctgtgcatctctgttctttccaggagagggagaaataaaaaatatctcaatagaaatggaaaccagtgttgggtttttttgttttgttttgtttttctagcagggtacaccactcactcaaccataccaaatataagtgtgcgaggcttggaatgaagaaagaaatggttactttttaaaagctagcaatattaacaggtgaatgtcataggccatgagtctgaatgtgtcagaaaagaactgcaagtcattagacaagaccaatagtcctcctggagggaggcagtgaacctcaggactgtgggcactggcctgcctttgtcttgggtattgacttgctgagtggcctctaggaacttaattaagttcctggattcctcttttgacaaatccagattacaaacaataaccaccatggccagtgctcttgaattcatatgatagtagagcattataaaatcagaattctacttaagagctgataattatgtaggagagaagagcatgctgactggggcaaaggggccaggtggttaacttttcacggttcaagagttgataaaaagcatatgaattacaggccagtgagaaggacatttttatgattatttggaaatttttgactccatccggaacagagttgaaatattcaggtccgcagggtgtgagtagacagttggcttatgatctcagcagtcaggatgtgtcatttctgtttcctaaaaggctcccgataaatgctttctggaaggtgccagtgaaagacatttggaatttaacagagacagcaacagcaggttcggggcttatctcgggctgcattgtagatcaatcctgggcacagtggaaggaacactgttacaaaagagccatttctaagaaggcttcacttcaaaggagatcacccacagcagaggagctgatgcagagctgaataaataatgaaaaatacaataaagatcaaatctgatagggatttgaattatatgccaggaaaatatttttgatgaaaatgaaatggtagggagggttagagacagattgaagaattcataatcagaactgctcacgacctgcatcgcttagtcctgtacaattttgaggctccatgagaaggcagttagtgaaaaatatatcagtcttttctctgaaattcgaggtcatccttatcttgagactgcccgggagttcctactccctactctcctcagcccccactgtagtgcaggaaaactctggccctgatggagccatttgcaaagatgttacggaagaagctgctgtggccacccctgcagagccaggcacagatctaggacttcaaggcagatagttcctgttcatagtagaccagccagagccagcttttgggtatctctccagccctgaagtatctctccatcaccaatgatgggtatctctccatcagcagtgatccccaagaggtgatgtccttcctggccttcagccatgtttgttcagtgggacctcaagcctctttcctaccactgatgggtttgggatatagaccatgagaaaagagagtggggggaaagagaaaaggaaagaaacaaagagaagaagagaaggaggaaggggagaggaaagagagaggagagagatgtaggagaaaggagagaaaaaggacagggagagaaggagagaaagagagagaggcagaaaaggagagagaggggatgagagaaagaaggagaaagaaagagggggtgagagagaaggagagagaaaggggatgatagagagaaggagagagaaaaggggtgagagaagaagagagaaagggggcgtgagagaaggtgagagaaaaaaggagataaaaggatagagggagagagaaaaggggatagagagggagaaatgataaaagagagaaaaagagatgtgaggaagggagagagaaaaacaggaaaagagaaaaagatggtgagggagaacacatgctagaataaggcagatacagatgaaatgagaaatagtgaaagagtgagacagtgagggggaaataaaggaaaaggagagaggatagagagagaagtggatagcgagagagagagagatggtgatggagactgagacaaagacggtgagacccaggtacagacgcagagtgacaagagttgggaagaggccagagggggccaaacgtgatgcttgggtggcctctctgctcttgagaggatattggcagtgtctccagccctgtgcacatgtcccactgccatagcaaatccagaggctccgctctgctgtggttctatctgccgttacacaaactatgaggcagccctgcccatgcagagaacatagtcatgtggcctttcttgttttatcatcccttcactctttcttacaggctctcccccatcctcagcttctgtttgaaggacctgcaaattattcttgaaggacagatgtgatgctgtgctgggaactgctcttctcctcaaactctggcctgtttccttttcatgaagcctgggagcctctattctccctttttatgatggttctttttcaggaggtttctgagtcccaccagcaaacagacccgggtgggctatcctgccaggctgacagtgagacagagatggacccacaagggcccctgctgcctcgtctgccatcccacagcttacccgccagctgggcttattggaagctttcctttaaatttcactgtctcacattccagaccttcctcatttccttgggccagtgggctcaatgccctggtagctgggctgtctccctcttacatatgcacattattttacaaagaagcaatctagccagagcaggtatattgaaaatagagtttattggagttgctgattgtggatgcttgcagagggctctttcttatttttctaaaagttgcattgcttcagttgcgaatcaaggtcccttgatcaccatgcctcctcttgcctcatgctcagtttttcttattcttttcttctctttcatccaactgctttctccagacttcaactcttatatctaagcactttgggcctttggtgctgttttgaggcagactaactagagtagaattcactggcattaaaacagtagatccagcaaagtctggtggaaataaatagtgtagattagtggaaggaatatgaggaattggtaaaagattcatgcctctatggaggacatgctttgctgaatttctggagaatccgtggtcttctctagaattgtgtgtctttcatcatcacccagagagacaagcttttttgctcttcatggaatctggtatataatgcaacagagctccattattagtggagaagatgtacagacaaaaataaaaacaggggcagcgtgcattttggtagggtcttctatttcatcctaacacacaagcgtcttacacctctttgccttttcccaaaaggcatatatgttttagaggcaattccagtgagtaaattattcatctgaagacaaggaagatatagaatagttagagttttattataatttttttatactgcaagggagatttttctttgtctcctaaccaaaaatagcccagctattgccaaatgaaaatttcttccacatatccttctcttgccaaaacccttaataaaattttgtttaaaaaatcagtgtgaaccatgaaacagtaaaactcattctaatgtatgaaaacatgtatatactgcaaagtcttcttcttttccaagtggcctgaaggtggctttgctgcaaacagtgccttttgggcataagaagccctaagaatccagagacagttgagaaaacctattttctttcctgtctactcagtatttggggaagacaaaaaatgagaacataaagaaaggcaagctccccaagcttacaaaagattccatctctggtgatcctgtgagccacaaaataatagaagttttgaaatcagtgtagctcatttctagacaatggaggggattgtggcaatagttcagcatctgtcctcggttatttctgaaaggatagatagtatcgtagaaaaacaatccatacaggaacgcttgaacaaacaattacaagcatcataaagcaagcaggtctggaatcgatcccagcaaccatttcccattctcactcttctttaactttgcctgttaggtggttttcgaattcaaccttctgtgagtgtttttaatggtacactatcaattaccccaggtaaggaatgtctatgcccggttctctctcaataaagcaaaatatcacatcattaagtagttttcctctctgatttgtggttagagtaacctaaagagggagggaagtagggaactgtgtacctgtcatgaacacacacacacacacacacacacacacacacacacacacacacgtgtgcatgcaagaaaaacaaacaaaaataatacataaataaaaataatcttttctttgctagaacatttctccctggagtaactgctgaggagaatctctatcctgtcttctgtgtgtgtttgtgtgtgtgtatgtgtgtgtgtatgtgtgcacactctgctctgccttcacgttcctctctgagcacactgtacgtctcctgccacatgcatacacacgggacattctgtctggactcatgggacaagattacttgcatgccaactcactgcctcaggagacttcctgtttatattcaaccacgcatgggcccttataaagtcataattcttgccaccaattgaacatcttgttggaatatttatccactttgctttagctggaaaacaagtttttccatattgcaagaaataagtgcagtaacttgatggtgtttaattgcactaattttggatttgggggtgacctggattatacagatcctacttccatgatgtatatttatgggtacctcttccaccagctgttcaacgttctctacaacctgacctgcttacatgttaatctcaccttctaccctcaaccttgttccccatgctgtagcctggaaggcttatttggataccatactaatcatcttcccacttcagcatcctccaacttaccctcttcgtcacctggactgttcttccttcaaaatctgtatctgactcatttcttatcattctgatgtcattgaaatgtcatttccttaaagagactttctttgaccactataatgtcctctccttcattctactttcaacagcataaccccatttaattttcttctatcagatttcagtctctgtcagattgacttatgtcattgcacgtttgtcatcagtctcttttatggaatatggtttgtttgtggtctgagccttatagtcttattcacctgtgtgttctcaatgccaaggagaaggtttgaaacagagtagatatgataaatatttaatgaatgaatgaatttataaatacacaaaaccaaatcgtgtgctaaccactttatcaagctaaacttgataaatcactacaaaaatcttattggggaggtaccattattatatttgccttgttagaacttaggtttggctgcatgtgacagaaaatctcaaagtagaggcttaaaattagatggacatttatgtttcattcatataaaagcattttgggtgttccagatgtcatctgctctaccatcctcacggtcttaagatggccactaggggtccagccatcacttctgtttctagacaagaggatggaggtgggaataaaaaaggataatgcctctctccctttaagttccatgatagtcctcgcaatgtgtctcattggccattatttagacatataccatacctacttataagctggaaaacataactcagggcaggaatgtgcttacccaaaacaaaaacaagatcttgttcctaagaaggaaaggaaccagccctctacactgcatccccattgactctcacagagagaaagtgactctggcaaagtcacacagctaatatagcatacagtgctgagatagaaaccctaacatcgttacatccccaccacctccagcatctaaacctcccccacttacccagtaatatagtacacagagaatcatccctctctgcagggatctttggtagactgtggagccaaggttgaagcttctttcttcatagtccccaaatccagggagaatcctagtaattgtcagatgggcctgcatagagtctgcattcacccttcccctcctcagcctcactcagcaacctctttccttctgttttcttacataaattctcttttgtcttaacagtactaatgacaataatacttctttctatcgagaatttacttctattcactatgcactctatggttttatttttataagaattagtttatacagttctcacaagcagctaaatgaggttaagtaattatttaactcatttgaaagatgggtgatctatcagacctaaagaggttaagtaattttttatttttttgacatgaagtttcactcatgttgcctaggctggagtacaatggcacggtctcggctcagtgcaacctccgcctcccaggctcaagtgattctcttgcctcagcctcccaagtagctgggattacagttgcccaccactatgcctggctaatttttgtatttttagtagagacggagtttcaccatgttggtgaggctggtctcgaacccctgacctaggtgatccacctgcctcagcctcccaaagtgttgggattacaggcgtgagctaccacgcccagcctaagtaatttttttcaagtaaatccagaatttgactccaaagttcaccttacaagccttctccaattcaaacaccaccttgcctttaatgtcttcatcaccatgtttaaagcacattctcgtgactcaaaataaatgattgtctctgagctgaaggggaatgatgtcttattttacctgaaccacagatcagttgctgcaccggaatggtggacagttgcctcctcctagcgtgaaattacagtcaatgacccagaggcaagagggtccccatatcatcacagagccctgagactctcaatctctgtagggatgaatgtggaatttttctgttgcttctgtgtttccgtaactgtttacatactgtgtcatgttaatgcattctgccataccatttttctccaattatctgagcttttgcaggaactctgaggtagtgagacatacattgaagatgttccaaagaaatgaatggaggagttttctctgcaaatcctttttctctgaaaaactcggaaaagctcactgcctcatcttgcatgtgagcactccactctgaattctgaaaagcagcaaaagagaaaacagaatctggcagaggagagatgaatattacagaaattgtattttaaaagatattgttatcggggtaaaataggtgggaagaaacctcatgagttccctaagaaaatatctttcaaaagttaaaaagatactcttacttatagtaagtaagctggaaccaatacagcaaggctgtgtaaatatataatatgtggtattaaggacaggctgaatgcatggctaggcctttatttttaagaaatgtgtatttaatgcattgcacttgctccttcagctttgttacactctgttggattaagaggtaacttagcaggcaagctaatttgaaatcacatacacatgcgatataaatggtagacatggctttcagaagtattatttgctgttcacaaatccatattatgcaaatatcaaaagaatgactggtattctcttgtagtcaacattttttaaattgtactggttccacactgcctcaacagctcctgcttctttttctcggggtttcttttgtgattcacagtggactgtctcactgttctgagctgataggatcctattattatttacttcttcctttcaacacacccctgaggcagttcaaaggtgaattcaccattattaggtattaattcacagcaaaaacacaggcttatcatttttaaaatctgttgtcaggactcacactggttttacaatatcaccttgtcacaacaagaactaaaccttctgatgagccccaagcctgaatttctcaccatcataaatagtatggggacatatttaacatttattgatagagaatggctaaaatgtattaaggtggaaatttgtgctgaaaagtcttcgtattttagttcctttaatccttaaaacaatcttgggagctacgtgttattttatgactcctattttacaaaaagtcaactgaggcttggagaaattctctggttaaggttacatagtgatatggttaggctttgtgtctccacccaaatctcatcttgaattgtaatccccataatccatatagtccgcacgtatcgagggagagaccaggtggaggtaattggatcatgggggcagttcccccatgcttttatgatagtgagtgtgttctcatgagatctgatggttttagaaggggctcttctcccttcgattggcacttctctttcctgcagccttgtgaaaaaggtgccttgcttctccttcgccgtccaccatgattgttaagtttcatgaggcctccccagccatgctgaactgtgagtcagttaaacctctttcctttgtaaattactcagtgtcaggcagttctttacagtagcgtgaaaacggactaatacacacagcacagacatagtgcagccttatttggaacccagactgtttggctccagaatccatactgtgtgtccttcacctgaccatattgcatctcattctgtggtatcgtttacttaatcatttattcattcacccattactttttccaccataaaagttctaaatgaatgcgtactctttgccaaatgcaatacagaacagtcggtgagaatataggaaaagggaagtagcagcgatgctatggaatcttagagttctcctctcccagcctgggagtacaaatgtcatagaattatttatggaagagttgtcagctaagtagacaccaaaaggttaaggagaaattacctagatagactgggaagaagaaatgacaggtggaagaaacagcctgggcaaaagcacaggggcaggaaacaaagatggtatgtatgaagagttacaaacagcttggttctattacggcataaacatgagacaagagaggaagtcatagagttagcaaagggctgaaggatctgccatgctaaggagtcagcaatccccacattaggatgcacaaaatgatccactgagacacaagaagaaaatattaaagtttgtctttatatttctctttgatactgttttttctttccgtttttggtaaagctttaaaatatgtatagcatacaaatgcaataacagaggaaatataattcttgtgggaaaagtatgtgctaaaattattttactgatagggtctggatgaatataagtttgcaggtcactaccgtaagtaatggagagacaatagatgatttttttttttttttgagatggagtcttgctctgtcacccaggcgagagtgcagtggtgcaatcttggctcactgcaacctcagcctcccaggttcaagtgattctcctgcctcagtctcccaagtagctggaactacaggcgtgcaccaccgcatcggctaatttttgtatttttagtagagatggggtctcaccatgttggccaggctgttctcaaactcctgacctcaagtaatctgcccgccttggcctcctaacccaaagtgctgggattacaggcatgagccactgtgcccagaggacaacagacaattttaactgaaggctttcttggcgtatgcatgtgtctatagattgttctcaaaacactgtaatggatgacggcagaggtgtaacactcagggagggaagtgcactgaggagattgctgccaccagggaatttaatgttgatgaagatagaagccaaggctgtggaaataagagaaagtaatagattaaaataatttttaggtggttaacttaatagggctggtgatagattggccatgatatttaagaagcatcatctcactctacatgagctccagccacaagccttcttgctatcacttgaataagtccaatacaggactccacaggaccttgggcctcctttttctgctcctggaatgctttccttcatctttgcctggctggcctcctcatttatttctcatctctgtggcaatgtccattcttatcattgtggccttccctgaccatgttatacaattcctcaatacttcctatcaaccttagtgagctccatggcatacacatctgagaaattctgaaatcacttctttgttgtataatagtgtaacattagggactttgtcatttgtgttcattgctctttctcacgcgacagtgtttgacacataaaatgtgctcattaaataaaggagcaaatagatacatagatgaacaggtagatggatgggtggatggatggtggatggatggatggatggatggatggatgggtgaaagagtgactcttattaaacttatcccttaatgagaccattagagagatggaatgtttccactgagagatgagaaaaaggatgtcctaaacagattagaaacttgtctaaatttatcctatctgttaaaactctttacttagtctataaagaggaaaccaaataaaaatggcttatgtaatagaggaaatttattgactcaggtcactggatagtccagaagtagaacagcctcagaatagcttgttttagaagctgaagaatgtatctggaactggatctgtttctttctttctttgcttttttcttttctcctcccctccccttccctccccttccctcccctcccctccccttccctcccctcccctcccttcccttcccttcctctttctttcttttctttctttctctctttctctttctccttctttttcctttcttctttctttccttctttctttctttctttctttctttctttctttctttcttctttttcagtgttcaaacattttattaaatcggatagcattgttatttccacattgttgcacatactgacttgtattcaattataagagtatagcacatgtttacaaaggtatggctgagcagtcagttggtaagtttaaaatttcaagagcgctccaagagcaaacacagtaaagaccatgcaagttccagagtcgtgaattatgacagagctcactcattttattccttgcctgcagttgttccaaatctcatagcctcaactctcactgtccagacacagagaaaacatctgtttccaaaatcccattgaaagtcctaagctttgccttacttggggccacttctgagtgactcacagaagtcattaggttgctatgtggcaattagtttaggcctgcgatttcttaaccaatctctgtgtcaagaaagatagtaccactctgattggcttagacaaattagggtctactttttgaggaggggatctttggggaggaagccacaatgtcctttataggcttggaaaaaaatctgggtgtgtattattgcaaagccatttaagactgtgtgtttctttatcaagaatgctttccataacccaaagatgtcacatatacaaaatttgagcagaagatttgcttctaaaatagtttcatatcttttgtaattcttaattatggtatacataaatagacttacttcttccccattggatgctatgaaacatacccatgactatttaaaaataataattcactattaaatttagataacaaatgttaatattgtaagacaatagcttcccttaaattctagttctctctgcttacttgatgtgactatcagtagataaagggtcatgatttggatctggggaaggacttgctgcttctggtttgtataaaggaattaagtagggaatgtgtaggaaatctggctgggctcagcaatgccagctttaatggaatccaaacaggttttcttaaaaataaatggtcatgagaaagctgaacgtcaacctcctttcctgttgataaatgacaatgtataccagattgtatcaacagttccgtggagcaggacacccctctgcttttgagtctctgaaaaaaaattatgctgctttccagcaactgatctcctttttctccatactaccgcctttctttgtcatttctctcacacttttgttatcttctttaattgcagtatattctttcgcttggcaaacacacatacagcaaagtcaatccaaagtgcttctgatttgagcaagttccttgctctaggctcacctgaaaatgaccatctgtgttcaggtcatagaacttataaatatacatttaattttttttctgttttccactcactttttataaaataaaggaaaacaaatttcacagtgttgtctaaagactgttcagcagttctgttcatgatactgcctatctgcaccactgatgttggatagcacaatttttttttgtttttcaatgaattaaaatacaacctagtatgcaaaagatgctaaaataggagaaacaaggcatataacatgtgaaacctgagaaccccttgcgcttgccattccacaccttttcagaagactgaaaactctacattattgaccatgttggtgtcatcagcacacctgacaatgatcttcttatccttatggaactggacatcctagcctttctatctgctcttggcataatctcttctcttagagggtactgtttattactttttgaaattgaagtgaatacaaattatttttgcttggagaatatctttgagaacttcatgacaccctttgaaaatttgaaaatggttgggtttttggtttgttccagaggccatatttggtaaacaccaacttctgaggcaaacaacatttctgcacagctggccccagaggcggtccttgtgccaaatccacccatgcaatggttgatgccaaagagttcagaaacacaaatccaatttaattctggctcaaaaaagcaataagtgtttaaattggatttctgtggagtttgttcttattaagcacagcacgcaaactgctttataggcatttattatttagttatttctaacaaaggatcttatagatccagcatctataattaatcgggaatgagagtagatgctagccaacatatgctctgtgacccagaacttgcactaggaaagctatcaggtttgtaccaaacaccagggtcgttggcaaaagtttgcttcattaaattcggctttgtgggttttatgcttttaatccaggctctcagctctgtctgtcagccttacctgtatcatattaaacttaacagggtcaatatgatgcaaagaggtggcacctggaaagtggtgtatcagtgactccgctttcaatccaatcatcctcccattatgtcttgtcatctttcaactccagtggtcctgaggcttcttccaggcacctccactcgagattattcctggatatgtgctcacccccatgtggcccatgctccataatgatgggtcccatctcgatctctataaatttccttttctgttgaagcactaatgaaaagataatttcataaatggttatgggaatggcttacttggttctcggttgctttttatcttttcctaattactttgcattttagtaagagccttccagaaacagagcctaaataaaccagggttgtaatggtggagatggcagccccatgaagctaatgagatagttggagtcagacttattgcgtggccatgggaggtctggctctgcttacctacattttatacttggcccagaaccttgctcacagcatttgataagcaacccattgttctgattcctagacactgatgtcagaaacaagcactcacctgctagtgttgatcacatactccatgattatttatcaaaaaaggccttttctttatgagactgttgttcagtaggccctttatagtcacaaaggataattctcataagctttaataaattccaaatatgagtttagaaatgttagtgctagttctggcttttcttggtttctatttccaatgagagtcatgtgctttcaatgcatatattcacattacaagttaattcttttcatctttcacactaagcttttgtattttgtttagtgtattttttttatttcacaggagaacagaaaagtttactttgccacagtcagtaatatagaaaagatcgaaaagagaataaagaaagtgttctaagaagtggctgctgtgtggatgactaggttcactaactagctgggtgacttatttctatgtcagccttgcagtggacactattaacatttgggcatctgcaaaattataccttactacatcatggattttcagattaataatcaagatgtaaactcataagtgctaaaagtgtgaatgccacaagtctattttattgactttgacttttgtggtttcctagctctttttttttttacatagttgccttgagtaattcatctactccctttctgccctagttttctcattcataaaataagtataacagtacatacaaatgctgtcttccacagggttggttgttatgggaattaaatatgttaatatgagtaaaatgcatagaaaaatgcacagaagtcttactgttgtaacactaaagctacaactaatattactgctataattattgcattattgttaattggcctgataattgcattatctcattttgtataatgttgggcgaggaattcattcaagtaggaaagatctaaaagataatacattagaaaagacaaaagtaaaacaagtacaaatttctaatttctcctctaggccctacacactcttcaaatcctaaacttttggacttctatctcttacacctaaagtgaaccttctagaggtaattgccatctgcatagttagacatgtccaaaacagattagcactctctttatttgtgcacataaattgctatgtcttttattcaataaataatttttggtcacttattcatgacatcgtggatgatacaaagatgagaagcacatgatttctattatcagagagaaagaagaaaaatatatggacatgtgactaaagtcaaacgtgccatgtcaacaagtatgggcagaatcagctgtcgtgcagtagatgaatattttggctatatgcaagatcagtggagcatcaatcactcagtctgaatgtgcagcaattagattcagttaggttaatctgttactggattccaccattccaacatctggttggctcagtcataaaagtgtttattatctccgtaagtcagtctaaactcatagtaggctgccacttggagcttctgcagtgataggacaccagcattctttccctcagtggcctatgactgctgttggtcaggtgtctacagtgacttcaagatgattccacatccttgaatcatttctcaacacttaccagtgcactgggttgttgggatataaacacaggaacccacaaacaagacatcctctttctgggactgactataaatccctatcccgtattcatactggaaaactggtaagaccttgtaaccctcagcattcttttgctatctgagaattaggggctggaatttaggccagctcttttctaggctttcttgatttttccactccaatggaagaaaagcagaggaggaagcaagcaggaagacatggaaaagaggacaagatctatgtccctccgactagggcagagtttggataagcatcccattccagccctattctctggttaccttgcgcttttcatggttgacaggatgggaaccctcccaaacagcaggctgcgccggccctaacttatgtgaccggttgtaaaggagaaaaggctaaatcaatagggttataaaagcacataccatgcagaagttcagagaaagcaacaaggaagaacctgaaaagtcaagagcatcaccattatcagagaagtttcacttctaaccccatttacttagcatactgagctccacctttaccatagtgacctcctggtaagtgggtgccaggagctccccctagagtttaaaatgtgccattgtcaatacctcttaacagcctgggggaaaatgcttgtctggcaggcataaggcccagaggagatgggagttcagaagtctacgtattaggttggtgcaaaagtaattgcggcttttgccattcattttgcaccaagctaatacacaattacaagccaaagtagatatctctccctcttccctaagcacccctccacttgaagtgattttgcccacaccacatttgaacaaactcaaactgcccccttcaaaatgatgggatgggggagtggggaaatggttaagtctgtcagctaagctgtcccagagttctcagagtcagaatggagacgattgctttggtatctgtttgatggcacacaaggaagaaaaggcagctacacatctttctcttgccctttggcagcagatcacaaatgtcacagcttgggagggtgccaattagtgccccttgtatcctaaataacctgccacagaaataaaataccaagcagtccttgctttgtccttgtgagttggggcccatgctttcccccatatagagtatctaattttgaaaatgtcactgtagatatcggcacacagtgattctacagctggagagatgaaggtggaggccgcatatgatttgagtcaccatgcttctccacggactgcactaagtctcgtctataggactcaagttaggtagcagttcatagaaatggcatgaggtcagataaagtaaacgatttcaatcacacttgaaaaatacaatgtgtgtgtgtgtatgtgtgtgcgtgtgtgtgttgtgtgtatgtatgtgtgtgtgtgtaaaacacattctcaaaaagggggtgatagtataatacttagatgtgaaaaaggacaactctgataattgtagaaaattaccttggtatgtgcatatataccttttgaaaatagagatgtttaggcattttatattcattttttagagttccacttttttttttttttttttaacattctcttctctttctctgttgatttaccgatagaatatgtgtgtgtcaggacacttggcaagatagagacagctggaagtaatagagccaagctctgtttgaaaagctgaattttcacaagtggtttggggtttaggtgtggggagcagaaatcctgggcttcggaataacttttgaaaagttgctcccttgacgtaaagatttgaaagaagtaattcacagcctgccttgcactttttaaaagttgtgtaacattacgccacctaccacaaaagaaaaaatgtatataggaaaagacacgtcaacattatttcgaatgatgtatttttaatgtcataactttctattattatttaatctgtcaaggaaaacatatactggaaacatttgagaatcctccctccctgccacctttgcaacacacacatgtccacacgcacttttctttgccaaaagtaagaagctggggtctggaaggcttgctcctgaatatggtgtatatcttatgtaaataaaacagagcatgcagctcaaaaagaggaaagtagtttgtttttccatctttgatttctgctgttgtggctcctctttgttacgaattaagtctttaccatcatttagtgaaatgttatcctcgtaatggtaacctggattgttaccaagttacttttacagacaccatctccatttctccagtgatctagtaactccgtggtggatttaactcccctattgtttttggcttatacacatgagtctgtctaatgcaagctgtgtttttctgggggccgaataaaaagtcttcatgagtgatagtgctggggttgcagtattgaaacatactattgggatccgttttctgattttgactcagtagcctgtcagaggcagaatgcttctccttttgataacagggctaactagtttctgaaggaatgcataaaagagtcaggctgtatgaattccagagtcttaaattcctttagctatgccctgcaatctttaagcaggaaatataaacatgtaccagctataaaatgtgtgagaacaataataggaatggctatctttcttgcatctctcaagtgtgacatacagaggagagctgtatcttattactaaccttgtccatcaagctaatatttgtatattgcttttctagggcctaatggctgagccctatctctgaatattggataaaggagcaattagaatcgtttgtgccaaaccccagagttggaactgcaggcccttttaatatgagtccaataaggaaaggtttagtgtaaatgaaggtcagctgtcttgaggtccctgaccaaagctctgtgtgaaagctaaacagagccggagggagtttttttcacctggctataggctaaatgcaacacagccctatagcatgcagatgctcccaaataactaacttattttcacaaggaattataaagcataggaaaattaataaattaaacatagctccagtcctgcccccaagaatagattgcactactaagttttggcaaaagtaagaagagaccataaaagtattagaaaaaaaaagaaggaataatttattaaaagtttctattttttaagtaagtatatgataaaaataaagatgtttccaatttgatttctaaatctttgactcttcaattgcttggtttccatgcttggcatggaaagaagaaaggaaaggagaaagaaggaaggaaagaagaattgcaggcaagtaagaatgaaaaaaggtaaggacaggaagaaggaagaaagaaggcagaaggaataaatgaatgaatatgcctgaatggccacatggaaaatttaaaaattatccaatgctgagtaaaaatcaatgacagccagtaaacaagcacataagcacactcccctaataatccgtcaaataggatgtttttaaatcacagcaatatttgttatttcttctgatgctttctatttgttccaagccttagagcataaggctagctactaaagagcagaaagagaaatcgaattcggctacctgttgttgctggtatggggagggagatgaataaaagcagttccaagctccagtggctggttttcatgaaaatgtattttcttaaatcaataccatttcagactggttagtttttggacatcctttaccaaagatagatagataaataaataaatgagaggtcattttatatttcctttatgaaataaatatgcttaaactctaatggtaaaaatgtatgtgaagatcaaaatttatattgtgcttaatgattaaatgggctacagaaaaatatttttacctagtagacagcatcttagtctcaaactcaggctctatttaacagtcttaataattagcttcaggctgggcgtggtggctcacgcctgtaatcccagcactttgggaggccaaggcaggcagatcagctgaggtcaggagtttgagaccagcctggccaacatggtgaaaccccatgtctactaaaaatacaaaattagctgtgcgtggtggcacatgcctgtaataccccgctacttgtgaggctgaggcaggagaatcgcttgaacccaggaggcagatgttaccgtgagccgagactgagccattgcactccagcctgggcaacaagagctaaactccatttcaaaaaataataataataattagttttgtaccctcagatagtcaagagcaatcagatttttcttaacctttattttctcctttgtcaaagggagctaatagcagagcttgttgccttgagattaataattaaataataattcattaataattaaaaacagtaaaataatacttgaaaacgcttttttaaaaaatatagacaaaacaaaagcttttttcttttctctctctctctttttttttttttttaacttgaatatcaagctcgctatgcaatttgacttatggagtgctgcgggaaacctgttggatattttcatgtatgtccttaaacacatgactgctttccttgtatgtgcttgattcttgtcagtccttctcctcgttattgaaagcatagattgctggctgtgagttggaatcatccactggataacaaaggcagtatctgttttctgggcctcattgtttgcaggtctgtgtgtggtccagcctagaggtttctcttcagagatctatgattggcggtaagagagaagtgaggttggtcaggagggtcaaaacaatgaggaattgcatggatgacccatagacagaccagtggtcatcgtgtcagaatctccctgcagcagcttcctccatcaccgactgagcagggctacccaacccactagccccctacgggcttatttacatgatctgatttccaaagaaactttcttttccagatgttgtgtgctttgcaaggctcagctctgtgggagctctgcttgacaaactctaatatagtctacatgctcacaaggatggtttttgctaaagagaccccagtgatatgttggtgcaattcaggatttctcagggtagcacatcaccaaagtgcctgcaacaatactgtcaagatcttactgattcttctagccagaagagactaaaacaggtgatccaagactcactcaagcatgcttcgtttcttaagacatatagtaacatagttgcttttaatttttaaattttaaggattaaatccaaatttgatcttaggtaaatatgtaaaatctagtctaataggttttgggaggatggaatatagtgagatataatgttcattggataccaataccatatttatttcccactgtatatgatgtcagaaaccgttttaaaatgcagctggtctaagtggaatgttcaggtcttggtttgtaggtatatgataccttggttatttccatttatttttaagatcttattgtctgtgtgcatgcctgccttctgcagacacaaatcaaaagcttgcaagatagcacagctttttttttttttttttttttttttttttgtctcttgatagaattaggacaaagatctgtacatggaatagacctgaggctgggcaaggtcttcctccgcctatctcaccatctttgtctttgctctgtgccctacccaaacccaccttcttttagttcttcaaatactccatacctgcatcaaccagaagttttttgttgcttcccatgtcgtcttgaccacctagaatgcttgtcacctggttgcctcctgcttctcctgcagttattatctggtaatgtctggagatatttttgtttttcacattagggggtaagacactactcaaatcttgtgggtagaggccaggtgtcttagtccattttgtgttgctacaaagaatacctgaggctgggtaatttataaagaaaagaggtttgtatggctcacagtttggcaggctctacaagaggcagggcaccagcaaatgctcagcctcagatgagggcttttgtgctgaatcaaaatgtgatggagaaggttacaggggaaacagacatatgagggaggccttccttaactttctgatgagataaaagtcctctgttataggctcttactgcaacagttcctgtctgtcactgctgtcattagaattgcagttttactttgctcgagtaatatattgattactgtctaccacccccaccagattgaaagtttcatgaaggtagagtctgtatctagtttgggtcttcattgtatccccagaacttcatacagtcacataaaagtgatcacttggtaaatatttattaagtgaatgatggaatgagtgaataattgaagaaataaaggcataatgggaggagagaacaaaaaagaagtcaggcaagctaccaaagtgatgtgcttattgattgactaattttcaaaccagttcacatccatcacaagtttgttcatctatttacttggaaagaatagatggaaactgaagcttgaaaaaaagtaatcatcgagactgttttcatttgacatgtgttaatttcagcaacccctttttcttcaataattcctctgttgagaaagtttggtgatggtatccatgcacatcatttttttttcactgaagctcactgacacctggaaagccacgtagtttttcagatttatttagaaaatagaaagcatctttaaaagtccttcaaaagcacaacagcaggattttggtgtcagtaatcatatgccatatttcaggcttttaatttcctcggaatggtatttcttatgatctgaaagcttttttccctcccctgcatcagatcttattttaacatactgattgagcctctttatcttacacttcctgctgggaaaatagatgctaaaatgtgtgtaatgtcacatttactttaaggcatcaccagataaaattgcaggacccacaggcatgaactgtggtgtgcatgtgtgggatttcttttcctacaactccagatctccatcagcagctcaagccaaacattcagacccttcaacgttatgtttaattggatttcattctttttctttttattaaaagcctttagtttgtaaatttttttcactttgtactgaagcttttagaaaagagcaacctcttttttcaaaacaaagttttgatctaatcatttgcatctgttttgtactaattttctttgcagatgtttcggagtttgagctatgcagttaatagaatgacaccagattccaactggtctcttactatttgtgagacctcactgttttcaagggtttaaaccagtgattcttaactaggagtgattttacctttcaggggacatctagtaatgtctggagatatttttgtttgtcacattagggggtaaggcaactactcaaatcttgtgggtagaggccaggtgtcttagtccagtttgtgttgctacaaagaatacctgaagctgggtaatttataaagaaaagaggtttgtatggctcacagcttggcaggctctacaagaggcagggcaccagcaaatgctcagcctctgatgaaggcttttgtgctgaatcaaaacatgatggagaaggttacaggggaagcaggcatatgaaaagaagggaaaacctgaaggtgccctgactttccaacaacccactctcaagggaatgaattcattaccaccaaaactcatccaatctctcgagagtgaaaagtcattcactactgtagaacactgtcaagccattcacgagggaacagtcctaaaagcccaaacacatcccagtaggacccacttttctacactgcggtactgggggtaaaatttcaatatgaactttactgggaacaaacaaaccatatcaaaactatagcaccagggatgcttctaagcatcctacaatttacagggcagtacccacatcaaaaaattgtctgccctggaatggcaatagtgtcaaggatgaaaaactctggcttaaactcaaccttaggcttccactctgtaaaattaaggtgtaatcacgtgcatcatagcaatgttgtaaagatgaggtaaaataatgcatcccacattcgtagtgtagtcagtaactcatgagccattgttatgaatatggttgcattattaagccctttacgatctggtccttaatcacctttctagatttaccttttccaattttctcttatatcctcagggacctcttaaaatttaccacttgttacccattcttatctggctaacttcccactctttacccacgctgaagttggatgtctccctgaaaccaatagactaatctgaaactaacccaaagactcatctaattttctggtttaccccatttcagagcccagttcccactgcactgaaattgtctgtttattatttttcagagtgtgatcaccacaccttgtgttaaaattaccaatactaaaatgccctttcctggactttattcaagatctactgtatcagtatccccgggcacggggtctggaaatatgggcatttagctcctgaattcattggtagctatactaaagtcatcactgtagatcctgagtttcaggctgggattaggtctttttttttctttgcatccttggtgcttagcattgtgactggcacatagtaggcacttcataagtaatagcactatttgaaaggataaatgaataataaacaaaaacttttattctactcttgtctcttattttgaaaagataaagacccattggtattagcattcagaggggagaaaatgctacttcttctgctctgttcttatatattcttatatacaagcatgctaaggacaagatatgcctttgtttagcaaagtttgaaagtgagaatcattagactgatcaaagaccaaagtcatgttttgtttggcttgtacaagctcagagagggttttttttttttctgtctgttgtggttgttttttcaagcttttaattgttttaagttttgaattagtggccaatattttcatataaaaatatgaaaatattgcagttggtatgttgatgagtggggccttatggggaagaaaaaggcacattggtattagcattcagagtgggaaaatgctacttgttctcttttgttcttgtaattcttttatacaagtgacttctgtcgcttaaataagtcctcgaatgtttacatgatcaaaaataacttatttttgcctattaatgtatggtttataaatacagatgcttaaaggggttatagaaagaaaggtaaaggaatagaagtcagctggctgtaagacaaaccagccaaactggtgagctcatgttctcttatagaaaggatgctgcttctctgatcagtaaatggttgctggttgaatggggaaatggatgaatgagatctcagcaatgccagatgtttctgtttctcaagagaagtcagaatttgatttttttttttttttttttttgagacagagtcttgctctgtcacccgcgctgtactgcagtggtgtgatctcagctcactgtgacctccgactctggggtcaagcgattcttgtgcctcagcctcctgagtagctgggactacaggcatgcaccaccatgcttggctaattttttgtatttttagtagagaaagggtttcaccatgttgcctaggctggtcttgaactcctgatttaaagtgatctgcccacctcggcctcccaaagtactgggaatataggcatgagccatcgtgcctcgcctgaatttgaattttttatgtgaaaatattggccactatttcaaaacttaaaacaattaaaaacttggaaaaaaaccacaacagacagaaaaaaaaaaccgtgtctgggcttgtactagccaaacaaaatatgactgtggtcttttatcagtctaatgatgcctactttcaaaattgctaaacaaaggcatatcttatccatagcatgcttgtaaatgagaatatataggaacagaacagaacgagtagcattttctcccctctgaatgctaataccaatgggcctttttcttccccacataaggccccactcatcaacataccaactgcaaaaacagaagtcgggcaaaagcagtgcgtgttgcttctatgtgagctgaagtttaatcacagtggtgtgtataatgatagctccacaggtgtccttgtctctggaaatcttggctgtgaccctgtaagatgtaactcacagtctgcaatgagaaacggggaataaatcagttggtcagtctctctgtatgataaatcatgagtgtgatgctttggcaatttagatcagcattaaactctgggactaaattaaagaaatcaccttcagcttgagtctgcacctagattaagtagttgtaactttctaataaatgtggcaagagttctgtgaagattcagacaagtctcactttgttaagaaaataggggggatggaaagcaaaggaggaactgaaatatttgggaagaattgaaccaccaagggtttagattaaatgatcaaagacagaagagcaagtgtgatatcctgagtgagcagagtacatatattttctttaatgggatgtagtttaagcagcataaaatatttatttcttgtagtaggtaattgagatccctaaattggggcaattactttgaatttagtcagtgtatcaatcagctatttttgcgtaacacccccctaatcatcagaggcttaaagctccaatcatttattttgacttacatgtctggggctggctggggttggctgacctagtctggccttgcctcaatagctccacctcaaaacgtgtgtccatctgggtttggctcctcactgcgagttgtgctcaggtctgatcctcatatgcttggtctggaacctcaggctgaggagcaacagctggccagaagttgctcttttttcatggtgttgacagaagtacaagagacacgcacagtggcacaagtgcagacccagcctctgcttggatcatgtcagctatcatcccagtgggttcagctaacctcagggtcaaacccaaagtcagggtgtggggaggtatactccaccttcagtgggaggaaccacaaagccacaaggtaaagatacagaatacatgaaagtggtgaataattgctgggcagtaattcaacttattgcactgttatgatagggcatccgtggatgattgtatgggttctgtggagatggcattatctagttggattgcataatgataaaaggtaattaggcagtgctaggcagatgccaaaggttcacacagagactttctccttgatataatttgaagtcttgattgagaagtgaaaagggagatggctaggtttgctggcctagtgctgtctgttttgcttctaaatgattgttgaacatttgaattaatgttaatttggtcaagcttcatcaaatgtctgtatgccagttgtgagtcttcttctaaaggaattattgtgccccctactttcatttgttttaaaagcctcatcactaaacttatggtcggcagtatattgtagtcggtaccttggttgacgtgcgtggattcctatcttcaacaaataatatggtaataagaggatataactcaccccttacatgtaaactacctatatccacacaaaattgtctttcattctctgagaaaccacaggactggccatgtcaatctgaggagcatcctagggaatttgcaagaggacctggagaagcagggctgcaatgtgagggtcacaatagaaactaatcaattgagtttcactccatctgcagaggatggtcagcaaggagtcagaatttgtctgtgcttcttcaaccccatcctaaatcaagcagaacatatatttcagtctccagagaggagaaaagaggccatgggaaggaagatggtgcatcaagccatacttgaagcttgaagtgtcccattcccttatcctgctttcatgtgcatgaagcaaccttggtgttcttgtttatacatatgagacttattctctaagcatccccacttctgggtgccccaagaaactgacaatccacagtccagcctgtggtgaccctcctaaaatcatgccgcctggtgaagctctgcctgttttatgatctgacgtcccagatcttcatctttattttgtttctcttggagatatgcttgatatttcatgctgtagagaaaatagtaaaaaaaaaaagtgttagttaaattaaaagagtataaagataaatggaaaattaaatgagtagccttgtaattaacaaggtagttaaattatgttttaaatgaattcttatctgctgccatctgatttcttaagaccttcataaaattggtccatagcaataacattacttgactggaagtttcagaacacagagtggcatatatcccaaaaacgcaaataatgtgaaactgagtgttagacatctcttatttaaagaaaaacatctcccaaccctccggcaactctagagaggaggagatatctaaatgactaatcaatcaattaagttatctcttccatcttctattcaatgtgatccaatcttccccctttagctcagctttacccttcagcagcctgccctagggtcttttttttgcacacatgattattgtcaggatacttttctaaacaaagactcattttctccctgtggaggaattctgatgccaaatgttaagaaaattgtttgaccctaataaaaatttatgtattttttttctaaccctgttcattattgatttcagtttattctgaacactgaattttttaatgtatcaaaagtgtgttgttacctaggtcagcctgtgtggtcactcagtcaatacatgagttttaattcaattcaataaatattttccatgtgcaaggcactgagatcaagcactgggcatattaactgtaaattagatttagtgcttgccctcaagaagattacagtctagtggaggaccagcacccctgcacaaccacagagtgccacgagccatgtcagaagaaccccctgcattggtaaagaagcacgcccacctttacagttgagtatttctcatgggggaagggatattttccccaatttattataaaaaatttcaaacattaagaaaaattgaagaaatagtgcagtgaacagatatgttccccacctggattcaataattgaaatttgctgtatttttgttttctttttctatctatctatcaatttactgatctatcaatctatctatcatctatctgtctgatatagtttggatatttgtccccacccaaatctcatgttggattgtaatccccaaagctggaggtggggcctggtgggaggtgttttggccatcagggtggatccctcatggcctggtgctgttttaatgatagtgagttcttgtgagatctggtcatttaaaagtgtgtggcacttcttccccactttctctcttgcttgctcctgctttctccatatgatgtgcacgctcccgcttcaccttccgctgtgagtaaaatctccctgaggcctccccagaggccaagtgatgtcgctgctaggcttcctatacagcctgcagaaccacgagccaattaaaccccttctctttagaaagtacccagtctcaggtatttctttatttcaatgcaagaatgacctaatacactatctatgtatctatgtatctatgtatctatctatgtatctatctatctatctatctatctatgaaagcaaattggagaaattatgacaattcatcccaaatgcttcaacttgcatctccaaagaatatagacattctgctgcacaaccatagtatcattattatacccccaaaatggacaaaaattacatatcatctaatacccagccatatttgaattccctcaattaatcctcccacctgttacggctctttactgttgttactgttgttgaaaccaatcatagattaagcactaaatttgtttttatgtcccttcagtttctttcaatatagaacagtgtcctgctttggtaaagtactatattttgaatttttctgattattttcttaaagagctgtataacatttttctttaagtcttctatttcttgtaaactacaagttccatcttgaggtgtgattagattcaggttgaatatttttggctagaaaaattcataagtgaggcaggcacggtggctcacaccgtgagtgtgtaatctcagcagtttgggaggctgaggtgggtaggtcacctgaggtcaggagttcaagaccagcctggccaacttggtgaaatcctctctctactgaaagtacaaaaattagctgggcatggtggcaggtgtctgtaatcccagctactcgggaggctgaggcaggagaatcacttgaacccaggaggccgaggttgcagtcagccaagattgtgccattgcactccagcatgggcgacagagcgagactctgtctaaaaaaaatataaaataaaaaaatgctgggcacggtggctcatacctgtaatcaatcccagcattttgggaggccaaggcaggcagatcacctgaggtcgggggttcaagaccagcctgaccaacatggagaaactccatctctactaaaaatacaaaaattagccaggcgtgatggcacatgcctgtaatcccagctacttgggaggctgagacaggagaatggcttgaacctgggaggcggagcttgcagtgagccgaggtcatgccactgcactccagcctgggcgacagagtgagactctgtctgaaaaataaaataaaaaataaaaatcataggtgatgctgcgcatttcattcacatcaagaggttcccattgttatttgtggtgccatgtttggtcacctggttttgatgtttgtcgcaaaattatctcgattatgaagatacattttctccctcgttttcaattagtaagtgatctgtgagttgacactggcgtcattgcctagcttgcttacccaaacctgaagcttgtattatccattgatgagccttttctaaatcactccagtagggttagcaaaatggtgattctctaattctatcattccttctacatagattaactagtaggctcctgtaaataactttcattttttaatatgcttacagaaagaaggtgtatttgagtggagcatgacctagaaatagcaaatatctagctacacataaacgttaaaaacccaagaacaggaaagaaatttagagaaactagagcatttagagctagaagggacctaaaacaatatatactccaaccttttaacaagtgaaaaaagtgaagtccaactatgttgtttatttttatctcataactaactagcttgatgtaacagatctttgaataaaaggaaacacattgtacacgggtgcaatgaggtcaaagtacgaatataattaccactgatttgttgacaacattgtttgctgcattataattttataggataataggagattgcttattccagcctcagtaagcattattgcacacatgaaatgtgcagggtataagtttttatatttttccttcattatgtgattgccaaggctttatttctaatgctaagatattttcactgggtttaaactgagccgacttatgtaccctggttctttcctactcttgaaactgtcagtaatgtcacagtgtctcatagctggaaatgtagtaaccacatcactccccccaactcctgctccctgatttttcattaggatgcagtttattaatccaagtaaaaatatgaaagcctcctatgattaggtttaagcctaatatatgatcctccttcctggaagggcactttgagctggtcattagggaatggagagaacgggtatcattagggaatttgcctggcaagagcaaggccaagactggaaggaaaattggattttatttgccaaagccgaggtaatgtcctaaataaaaatttccccaaccaggaagacctaagaaaattgtcaagaggtagagtttagaaccaggggcacaaagggcaggtgggagaataggctgggggaagactggagtgctaccaacaactagctttatgttttcctttataaacacgtattgagcacctactatgtgacaggcatggtgctgtgtgttttgtgtgcattacctaatgtaatcctcacaacagcctagaagtcagtacttttattaccctcattttagagatgcaaaactgaggcaacttacctatggtcaccctgttaataagtgttggggtgtccctgacccctgcacttttaatcagtaggtaatatgtagtacctttctctggcttgtaaatgttttcttgcagagaaaatgggaagcaactatctagattggaaaggttaaaacgaaggaatcggaaagcaacagttaaatagagttaaatggctacttttccctctcagagttttggaatacctatgagctttcagccataaagccaagaaggttctggctggcacgacattgtccccgactaatgctaggatggtgttgtcaaacagaggcagaaacagagccctatcctgtttctgctcagttgcccatttcagtctccgtcctgatgcaacacgaacttctacagacagactcagggtctccagaaagcaaagcctttaggaattaaagtcatctttgcttttaaatacttgtttctcccatgttaaggacacttttctaggcaaaaacctcctgattgcctgttgctgtggcatatcttcacaaattcatttttcataaatgtcccaaatacatctgagacattttttataacttgtgtaagcttccagagacaaatgttaaagatgacagtttggaaatgaagacacataaaacatgccttgggaaatagaaatcctagggcagcgacctcaaattcagtcctctgttcctttttagtcaatatattgaatatcatattcatatatatcatatcaacatcatatgtatcgaatatcattgtatgctgcaagtctaaagaaagagagactagaagtgaagaggtcaaggtttcagccatccatggacctgtgaaggcttgactttgaaatagtcacatgatcactttggctattagttttatcacttctcttatcttggtctgaagatctgagctgtgttttatgataaagaaaaatgtataagctagtttttgctgtataacaaaacaacttaatcacttaaaacagtaacaatttaatgtagctcatgatctggtatgggctggctcagctgatctctgcctgggctctatcatgcaatggttgtcagccagtcccttagctggctgctgggtaatccaggatagcatcagctctacattatggatttggctgagcacgttgtttctcctctgtttggcctcttctctccagcagtgctcagacttattcatgtggtacctcagttcctaaaacagcaagatggcaagccccaatcctctttgcaagcttttactttcatcacgtttgctaatgagccattgactcaggaaagacatggccagatttaagagatgagggaatatatcccacctgttggtggaaagatctctgacaccacatggcaaagataagaatgtaaggggtggggggattatggccgtttttatcgtctcccatggaaaggaaattcactggctctgaacagtgctaatcaaaattgttactgaacatcataaagaacgtgaggagaggcctctactatgcattatgttcatagaatccttaatggaaaaaagtttgaaaatactgactacttggtgtctagagccccctccagctttagtatcctgtgactaagaaatatcacttgtccaccaagtgacatctagagactcttcatcaataatatgagatggaatcatgggaacatgtgtttgaacacaacaccttgtggatcaggttctctgcttcacagcggaatgcttatgcttagaatttttgagtgctaacaagtgaggttgagtctgtgagctgcttgtctcaaaactagattctgaaaatttgcagccactgctacagtcttggcttgtagttttacattgaattattggactgaattatttcattttgtcctggcgtgccttatcaactgaaaatattgtcccagagagggagcacaacaatattttgtaaagaaatcattcctgcagagatgtaaagactggttagtaacctgagtctctgacccactgtagcaaacagacacacaggatgctgagaaggatccaggactcactaagctgcttaactcaaaaggaaatagtaaggtttacactggcgacatgaagctgagtctcctttgggtctggagtagattttggtctgtgcttatgaatcgtctctgcacagatgaaataatagacattttaatgactgttcatatttataattatattagctttggatccaggttagaaattcttcattcctcctgtcaagaacttgcataaccctgaatggtgattagtaatgctagttaagcatgctagttcattttcaaaatctgttctattttacacacacacacacacacacacacacacacacacacacgtagagtcattcattcactcattcattcatttgataggaagttaagtggcatgtagtagacatctgttgtttgtttttgtcaccccaaatctgtttgcttttctcctgacaacaccattctgactttcttttggggaacatacccttgctcccattctcactccaggttcttcagatggggtgagttcatgggtgggcatgtgactcagcctcggccaattcacacgacatattctcctggccatggtggtgcatcagaggtggcaaactctcaagccaaagccagtgacatgcgaaagaactttcactgagactgttgagacagaggccgtctgccctttcctgctgattataacttggaagaagaaagccctggagatcttggccactgatatggtttagctgtgtccccacccaaatctcatcttgaattgtagctcccacaattctcacatgtcgtgggaggggcccggtggtaggtaattgaatgatgggtctttgccatgctgttcttgtgacagtgaataggtctcatgagatctgatgattttataaaggtgagttccctgcacaagttctctttttgcctgtcaccatgtaagacatgccttttaccttctgccatgattgtgaggcctccccagccacgtggaaccatgagtccattaaacctctttcttttatgaattacccagtcttgtgtatgtctttattaacagtgtgtaaacagactaatagagccaccatctctctaccacatggagctccagaatgaacctgatgtataggaaattaagaaagaggggaagatatgggatccttctgacatttgattctaacccccaccctgaccttttcagatacaggagtctatatattgtcttttattttcttaagacagcttaagttttctggaacttgcttctgaacattctgttacgtcatttttaaatacttgccaattatttttattagttactcatcagggagggaaatcaaaccagctcctgtaaaaagaatggaatttcaactatccagagtctcaaatctaaaaataggtggctaactcatgtcagaagtatgaaccctcagttccactaaatcccaatcttcataagtggaagcccaagaatctctattaaaaaattttaaaagcttgctagtttatgatgtatcctgcttagcacctgttcatggtctatgtcccagagatattttgaatatcacatgtaaaggggaaaggaaataggatatatttttcactttctgtaggccagatattttttgaagtacttcagcatattttcatgtaagatatttaagaaaaacttttgcatgcatttcctcagtgttctaggtataatactttagattactggttgctcagtagggaggaaaaaaaaaaaaaacagccctgatctcaaggagcttatagtctatcgcatccaatagaaatttctgcccttaaatgttccacgtctgccctgtccagtacattaaccatggctattgggtatgagaaatgtggctagtgagaaatggatttttaaattgtattaatttgagtagccatatgtggcttgtggctaccgtattgaaatgtaaaggagtgtacatctaggttatttcttcttaaacttgcatgtgcgtatgaatcatctatagatcctgtgaacctatagatctgatttagtaggatttggtgttggggtggtggttctgcgtttctaacaatctcagaagtggctgatccatggaccacaccgagtagcaaaaataatcatcaaagtaaaaaagttaattacaaaatatggtaagaccatagtggggacaagatgctataagggagaacggaaggggaagaggggaagggtttgcgactcaatttaaactaggaggggaattatagaaggcctcactggagagggggccctggagttgcagcctgcaggatgcagatgagctagttaggatacagaggtgaggggaggcagtgcgacagggagcagcagtgggtgcgaaggcatctcaaccacttttatgaaagaatctgtgaaataggcgagtcatcaataatagaattatcattacatttagaagccccttactaagccattcttctccttgacctccctgacaggttcaggtaggtgcccttctcagtccccataactcaaggcatattttcccataatcattaacaccttgagttgaaatgtgccctctatcagtctctgctgcccactgaactgtgaacccttaatgtcattttattctctgcatcctcgcatggtaggcattttacacatatttgtcaaactgtagccaaaaagtgtgtttgtgtgtgtgtgtctatgtgtgtgtgtgttgtgtgtgtgtgtgtgtgtgtgtgtttatgaggtatcagggataaaagaagtagatatactgcatatatagatgtatgcattatttttctcctaaagagatgagaaatatttttggagttgagccaagccattcatggcctctccattacttttagttttatggcagaggattgctctggttttgacaagcactaattaattccatctctggggaataatgggaaatgcaggcttatgctgtttgcaccaaggttatcagttatattggttttaatgttctgccctgctctagatataaaacatgcagcaaaatgcacagccacctcctcattagctgtaaacagtgtatttcagatttgtcaagcatacatatttatttttacatccaagcatttttatttatcttccttgcaagtccatgaagtttttgccaataaattaggaatgcagtaactagttctgaaaactatggcacacaggaaattttattgatctcataatttactggatcttttggttaattacaagttctgtctagcttagtacactttttgagccagctgcgcatcataaatatgtaacctcagtactcaccctccctacattgctgacagcctcccatgaggtcaaaggtgtaatagctacaatacccagagcctctaacatgtttaattaaactattaatctacttttatctgtgacactagaaagccagctacattgaattttcagagttcttcaatgcatttgcttacggtaaatttttccaagccatatctttaacagtttagcgctggcaacccttttaaaggcattttgaaaaattgtgaatgttggaggaattaccatatcagctaataagaaaatgtatcatttataatgattcatgaatttgagtctaaatgcagtatatgactaaggcactttattaaaaaaagagaagacaggtttgctaaaggtttgaaaattgtagtagatcaatcagcagcagcctcagaagtaccattattttaaaattgtgtggatgatcattagaagagaagtcatctttgttacataaccttcaggaacttgctgaggacaagtgtaacctcttgtggcagtgatgacattttcagtgatcaggccagcttttgtgttcattaacacaacagagcctcaaaactttagttttgagaaacctgtgtatccatgaagctttaattaggttaacaaggtacccattagtctatctcctttcttgtgtatcaaatggcagtaatctactacagatgttatacaatgaaggaagcaatttgctgcttttcattttatttcctgtactcactcatgagcttgtggatatagaattatgtgaaaaattcaagattctatttttattcatgttaagctcatcttacctgtttgtacaattttttgctctttctttattaaaggaatctgcatcttatgtgcctccataaaagctgtaaaaatatgacaccacgaccttctaactaaagtacctggctttaattttaacaatgattaacagtgatttgagtcatgcatttgaacattccacttaaaagtcaatttagacaggcaatgcccatgcaaatattgattataaacccactgtgtttctagcaagctagattaatatcatgggctaaaattcaaaaatctatttttcttttctacttcattaaagagtataaccaaaaaccacatctatttgcagattggtcatatattttgcaaatgcctgtgggactgaaatttaatttactcaacatatcttccctcccaccctacctccagtcaaaatcatcaaaaccagaactcttgttacatttatggggcagttgaaactgtatatttcactttgttttattgcactttaactttttgcactgtattagctgtgagtattccatggatcttgttaaatgtgagcagcttccttgaaaacaagtcatttcaatggacatgttttggcttatgttcagtattttacagccaatgtatcagagccataagtttataattttaaatgccgcagatcttacttattcatcatgattagatgtttctatctgctattctattgaatggcaagctctaatactgataaataaagagagccagttcctgatttggcaacaacaacaacacgtactgaagaaaataaatgcgttgggttcatctccttgatggggatgcaatctaagtcaaatttttgaatgaccactaactatttgcataatataacatataaattgatgactttgggatatttatatcatcctggtgcctcaaggttaaaattagtagtgtgaaaagataattactagctatgttaaataaaatgagtttctagaatgcatttttatgcaatttgtgagtacagagctattaaaggctgtagttttgttttggagaataagttgtctctttggactattgtagtaatctctttgtaaatgtttaatttttatcctagataagcaagatcttttgggctctctttcctactgttctgggatgaaagcatctaggaaatttagagggcaactccaatgagactgtctggctcacagaaatgaatcaacgatagaaactcgggcatgcggtggtggggggaagtggggtggaggtttgtgttaggggagtggcctatcagctttgacatgtgtggccatcacttatgcagtctccccatgaaggcaggtccaggtagctctgcagcagagctggggcaccgtgcctgctctcccaggcagagcctttggtgactactgctactaccaggaatagctgtggatagagaagagaacactggccactgtgtgggtgaccagaatcccagcccatacctcagtttcattgtcttctatggcacttcaaacccaaccctcaggaaaaccaaccaaccaaccaaccaaccaaccaaccaaccaaccaaccaaatacatccttaggagaaggatcagaactaacaatactgaaactttgagattttcgtttttaccttataaaaatgtattttggccaggcgcggtggctcacacctgtaatcccagcacttggggaggccgaggcaggtggatcatgaggtcaagagattgaggccatcctggccaacatggtaaaccccatctctactaaaaatacaaaattagccaagcatggtggtgggcacctgtaatcccagctactcgggaggctgaagcaggagaatgacttgaacccaggaggtggaggttgcagtgagccaagatcacgccactgcactccagcctggcaacagaaccagactccatctgaaaaaaaaaatgtatttcaagttactgcatactcatagctatatatttcacctgagatttacctggttaaataacttgcctgagaacacacaagtagtaaattatagacttaagatttgaaattgaattagtgtgtaaaccaaagtccatatctaagctgggtgcagtggctcacatttgtaatcccaacaactcaggaggctgaagcaggaggatcctttgagcctaggagtttgaggctacagtgagcaatgatggtgccactgcactccagcctggacaacagagcaaggccccatcttttttttttttttgagacggagtctcgctctgtagcccaggctggagtgcagtggcatgatctcggctcactgcaagctctgcctcccgggttcacgccattctcctgcctcagcctcccgagtagctgggactacaggcgcccgccaccatgcctggctaattttttgtatttttagtagagacgaggtttcgttatgttagccaggatggtctcaatctcctgacctcgtgatccgcctggcaaggccctatctttaaaaaaataaataaataaaatgtaaaaagcctatgcctagttcactatataatgatcctatccatggtaaggaaacacctttcatgattatcagggcatcctttatgagcctaactgagagagagaaaggaaggtatggcaggatgggagtgtagtgggcacagtggtgtgttgggaaactgataatctaaaataagcaataaagcaaacagcataatgagctctgatttggagtgttttcctattttctatgacaggaatattcccatcatggccaatttcaagcttccaaagtgaggtcattgaatgtggagttgaaaagagattgcacaggctgggtgcggtggctcacgcctgtaatcccagcactttgggaggctgaggcaggcagatcacctgaggtcaggaattcgagaccagcctagtcagcatggtgaaaccccatctctactaaaaatacaaaaattagctgggtgtagtggcacatgtctatagtcctggctgcttgggaggctaaggcaggagaatcgctggaacctgggaggtggaggttgcagtgagctgagatcatgtcactgcactccagcctgggtgacagagtaagactccatctcaaaaaaaaaaaaaaaaagagatgcacagaatcagctcagacgaactggcttccacatgccactgagcagggagcacacatgtggccaagggaaagaagggtgaggggtggtcagggaaggagtgcattgctcatagcaggtgcaccaggcaaaggacactcaaggaccccaactcccttgcctttactgtggcagctagctgccttggtggcccccatgaactgcaccccccaaggttcatgccctatgcagttttatccccttgggctgagcctgtgacttgcttaaaccaacagaatgtggcagaagtgatgctgtgcaggttctggagctcagccttaaggtggtgtagcagcttctgatttagcactctcagagctttgagctgccctgtgagaagcctatctaccctgctgcaacagaccatgtggaaagaccacacagagggaccatgcaaagaagcagaggccctgacatcacatagaggagagtcaaggagtccatccattggaggaaaattggggctccagacagatgaccctcggagagccatcccagcagaggcaccacacttgggagcaaagagcccaccttgaggattcctgctgtgcatcatctgaattccagacctgcagaaatgtgagaaaataaaatgttgttttaagccactgcattttgggacaatttattaagcagatattgacaactgaaattattcttttttaaccaatgcaggaatcttatttttacttaacctatgatgttttatggtcagagtggaaagggaagccctgcccctgaagtcatggatgcaccatggaacccgtggggacagtcaaggtcaagtcctccaagtaactggcatgctattccctgcttcctgtgccttcctcctggtctcataaaaaaagtgcatgagaatatcatgggtgatggctttagcattggatatcaccatttccctttgcagtgacggtgtttccaattgaccaaaagggaaaaattaggtagagagcaaagagttctctacatgattgttcaagaaacagaaataaagtatcaagtctgtaagcccagggttctttggagtagtatcattcttaccttggtgacagtttggtgaggattttactgctgcttccttctcctctcatcaactaaacaagaaactatgaagtccctttcctcaaggaaagggactgtcctgatagaatacccgacctatatcatgacttgttggaatattgtgaaagcacaaaattgagagaaaaataaagttatccaatgtttagatgctgaattacactgttgtgtaaccttgattggccactacctgtgaggtgagacactggagttagccattgtgaattcaggagtcagtaaacatccagaggtgtgaagcctgctgcaggcctccagttcccccagaaaacagtatctggttttaatgattttatcagagttgttttcaaggtcagtaagtttgttgatattttggtcatgagattagtgcgaaccaaccacatattggcatttaaatgactagggagataagatgagtgatgatatcataacaatagaacatattgatgatttcagagcagtaaaaaggctgaaaatggggcaatgatacttatattaaagacaaaataggaggaaactttcagcctttgaaaaattttcatttgaataaaactcatcacatgatactccccagtgtaccacaaaggagcatgtacattctgctgtccatttttaggagaaagaaaagtcataaactcaggctgccacctcagttcaatacagttgcaatgtaatgtttgaagacgctctcaagtctttgggaatgaagtgaaaacgtccactccaatcttcttaccaaggtacaggcaagtgtacacttgggtcttgtactctacgtttaaagctcaaatttacttgggtcttgtactcttggtttaaagtttgacttcaagatggctcatgtaaactcttctagccaagtcttcatatgtaatttgtggataattttatctctcttactacctacctgagggcattgttttaatgctcagaaacatacagaagggattgacaaagtataaattgctattcaaaaacaggggggcctagtgacaggtgagaaaacagtgctcctcagaaaagatcacccccatcctgctgaagtctttgaataggcaacccagacaatttaggcctgacattgtagctctttggtgaagaccaaataaaatgggattggaggagaagataacatattttcaattcattttagatcatttgcatcatctgcattaggtgtggcctaatttgtttggggcttcaggtgtatgaaccagtgctcattttcatattggacatagagctggggagatagaatggccagtagtttgcaggtgttatatcattttcctgtgatgataaggacattgcctttcttatggccattcaattacattttttgttctcatttaaagtaatcagagtttcatcgtgacgacttctatgtaaatttgaatgttacatgaggtgtgtaatggaataaaaatggagttacaaggactcctgttcaattgccaacatgcttcttttctattactagagatcgtagagtggctttggggactaagaagcttagacattattttgtaccttatcattggccatttttgtgattcccaaggtgatagattggtggccattcttctgaatagcccttccaaaagtcttggtatttttggctcagagtctttgcagaattgcatcatcatgaatttttacttttaagatagcacctgttttgtcaatcctgtgagaatatgtatttcataacatgtagccacctatgggattaagtaagtactgaggtccttgagccatttccaaatgaaaagagggtatgatttatcagggcagatccagtagttcaggggcagagctaagttctgaggtacaataaagagaaacgtaaaagtaggaacccacatttcaaccatttcttcttgtttttgaggatttaataggaaagatttttagactttagttgaacaaaacagtaagataacataaaatcagactccacttaaatgcttagtttggttttgtggaactggagcagctcatggggaaatgctaattggtcaaaatagataaataggaattccacagagtctgtgagaatgattagattttaatataaggcattactcaatagtagagtaaggattagtggagtggtacaagaattatagccattgtctaaatgcaaagatttttcttcatttttacaagaagaaacttgtgagctgactaaagttcaagtttagtatttcaaaccagtgagaggaccatgtttcattccacatgaagcttggttggccatgcaggtggaattttatcaaacaacacatttaaaattttactttcttatcatatttgactattgaaaacatgacccctccctgcaactctgtttgtgttaaagcatctgcggttaatggctttctgcttcttgtattgcaaagaactttaaaaagagatcattctctgaaaataagtaccttgctggtaaaatgagtttaacttggcaagctctgtcattttttgttgttattgccatcttatgttctggaagtaattcacattagtcatcttttagaaactctaagtcatgtcttccctgtcagatatcatgctctggtagcaatttattaaatatttcctgctaaaaatgaccccaggagatagtagttaacctactcttgagtgtaataatagaatcagagattgatgaacaattttcgccaaatattttaagtaatggcataaaactaaaaggccatgcattgcttgtcttagaaaaacagtacggaacatgttagaatattacgaataaatgaacactttcatttatgagctgtatatagaaatcattgagtttctctgccagagttgcagcctgtatggtagttaatcttctcgtggcacttactgtataatgcaatgcctctttgggcaatcttttgtgttaaaatacagcatttaagctccttctctccacaaagcattgcaagaatgaattgttcaatctctcttttttttgacatcatcctagaaattatttcagaaataaccaagatggtaattcccatttaatatctttctttattgctcattggaaaatagaaaatactttcaaagcatataaaattattggaaaattaacataaccctgtattgggagcaaaattattcctatctcagcattgccacccatctgagggacccagagcaagtcatttaccatccctcaggttgtttttttgtttgtttgttttttgagacaaagtctcactctgtcgctgaggctggagtgtagtggcacaatctctgctcactgcaacctccacctcctgggttcaaatgattctcctgccttagcctcctgagtagctgggactacaggcatgtaccaccacgcccagctaatttttgtatttttagtagaaatgggggtttcaccatgtcggccatgctggtctcgaactcctgacctcaagtgatccacccgcctcggcctcccaaggtgctgagattataggtgtgagccatcgcgcctggctgcttagcttgctgttatcattattattttaatcattaaaatgaaaatattaattttgtttcaaaatgaatggtgcatgaatgaaggaggtagtccatcttcttcctaccacccaaatgacagatgatttcttttcaaaatgaaggaaatattaatttgatgacctcaggattacttccattttaaactatccttctgtgtgtttaaatcgctttcctcatttttattttcttctatcccattccttcctattatattctaatgacctcttattttaaactccaaggaatgatggtccaccccagattggcttgtgatttcttcctatacagaggctttgtcatcctcattgtggccatatgccattcctcagtatgtaaagaaggttgaatggcagggatcagccgggtctagagaaaatctcagaccccatgacagtcaatagataggaaagacataggttgaatcagatagtgcaaaatgccatacctaaaagaaaatccccagaggctctttcaaattgtgagggagatatcttttgattagaggcaaatagcactgtcagcttgaagtgagcagactaggacggctaccacaatcatctgtgaaaattgtttaatacaagtgctaccttctcataaatcacaagggtaagctcatttaaaatggacatttattctgatttttgatccatattggcttaataaaagaccaactcataaggtttaacagttcaattaaggatttttcaagataaaggattatagataggaaatttccttgtgagctgggttagaatccatgggttgttaagtttcttttccgtgtggtaagtgggaaaacatatgctgtaggaggagatatagtatgcacttgaaagtaaagtgtaactattttttaaattaagatatgaccatttttaaaatttcttggcttaggaaaaaaattgaacatgcatgtttatatagaaatgttagaccatacatagcgttattattttgatgcgaaaggatgaaaattatctgcttttggtcaaaagagaggaaatcactcaaatcctttgggacactcatttataagctctatgaaatctttggtaaaatgaactccagaatttatgcgacttcctcaagaaaaagtagcttatttttaaaataaatcataataagtaacattattattattctcactggtggtataaggatcattaataaaatagagtctctgtgatatgtgcattctaatataaaatatacatatattataaatgttctgcatcgagtgaaatacccatatttatgaaaggggttgcatgggatccatcagcaccttgtaccatgaaagttaagaaactctaaatctataccacgagcatttgaattttctggcatttaagggagaagggaaggaaggtatcgtgatggagatggggtgggaaggaattgtaatgatctgctttttatttcttttatttgtgtgcaactagcacttcgaaagaacataagatagctgtaaccttctctgctaaaccaggaggtgaacacagatgtctgaaggaggctttataaggaagtgcataaagctttagaaggttcagaggagaattgagaggtcattgagagctgagatggagagggcttcatggagaagtctttacttgaatgattcccaagaacctagattgaatctagacaagggggaagactcatctctcatcacaccatactgacccactcctgcagctgtactgaatcttgtttcttctagtaaaccatgaccttctaacctccaggctttcacctggaactctttcccttccactactgcctgggtaatgactttgccatcacagttctgtcaagttaggactttcttcagaaagtttcctgtgaccttttccagccctctgacaatttcagtttgttgctcttttttgaggggctgagaaatctgcatgcaccgacctcatcactttgatggggtcagtttgctactcgatattgaaatggactgtttaggccttgatttcctcctatagactgttggctcttccatggcagagtatgtgtgttatttaccactttatccattgcacagtgcctggcacttattagttatcaataaatgtctgtatatttatgaaggaaggaagtaatgaaggatgaaatgaatagggcatgacctacaagggaaaagtcacacaggtggaaatgatgagttggcccaaagacaatgagatgattgatggacttaaactttaactctgatgtcattttctcctaaatgtgcaatatgccataatttttttcagtaaactaggggttgagacatttttgctacttaaatagagacagaaaaataggataaattgaaaatattttccagtggtaatttattagatgcctgtaaaagaaggaacatgaggttttcagggttcaagtggatgtctcattcttcaacacaaaaacacttggagagttgtataaaagatttgaaaatcactttagaaaacaggggctacttggggaagggagttgccaggaaaatgccattattgcaaaaagttcatttaaataggcttaatatatctacctatctagtgcccactatatatataaagcagtagaagggccagctgaaactagaataggtagtagaaaggggctttcaaccaaaagccacaattattagtcaaataaaatacaatttgttggccgggcatggtggctcatgcctgtaatcccagcactttgggaggccaaggtgggcagatcacatgagaccaggagttcgagaccagcctggccaacatggtaaaaccccgtctctactaaaaatacaaaaattagccaggcgtggtggcgcacgcctatagtcccagctacttgggagactgaagcaggagaaccacttgagcccaggaggcagagattgcagtgagccaagatcacgccactgcgctccagcctgtgtgacagagtgagactccatctcaaaaaaaaaaaaaaaaaaaaatacagtttgttgtatatatcataattgacaggacaagaccctgtctcaaaaaaaaaaaatcaccaaggaactttctttcttttatatttctaaagctagtttcttttttttttcttttttttttgcatttttttccattctgtgatggcaaaagaaaatctaaccaaccccaggattttcttagtcacttcaagtttgaatgcagccccttcagaattgctcctcttagtcttctctctgggactccagcccagggagcagctctatcacttaataatagtgtgtcttgagcaacttgttttatatatttgtgcctccatatctcattgatgaaatagatttaataatacctttctcaaaagatcactgtgagtattgaattacatgaaattgtatatatatatattttatatatatatatatcgcatagtgctgacaacataataagcacgtgataaatgatagcagctgctgctgcttctcttcctcttcctgttactatcacggtgatcaacaacatcatcatcataagttccaaaatggaagggcacagtgccttggagcatctggacaccggtcattgactttctattctgacattggttgtcctttggtcattgtcctacattcccatttgcatctgctgaggtttctgtcatgccatactctgaatcttcctcaaacagaacagatgaagcctcctcaggttggccagtgctccctgggaccacaggaagcttggggtgcaggaaggctgacttagactttgtattcttgacatactctggttttcaagtttcaggctacaaatttctgttcctctgcaattgccctggactcactgggaatttctaatgctcccgccacatgcaacatttgctaggtggtggcagcaggaggtgcaagtgtggggagcagggtggaaaaggactatactaaactcctgagctctcttcttcagctttcctctttttttggttaagtttaggaaagctggttgctcatctgttggttatacactcaggtttttgaaactcaaatgtcctttctctcaacttactgtctctctgtggaatttcaaaagtgaatgtagaaatttcagcaagaatttcccatcatttgctttctgtcctgctataattgtcatgcccattgcctgaggccatggtctctgccatgagtttagttttaacaagcaaaaagtaatgaattatcaggcaggaaaataatttaggttaatagtaaaatatttccttgctacatgacaaggtgaacagctgattgccataagagatctaagaaacactaaaaagtacaaaaaaataggacattagttgtcctttggacattgtcatatattcccatttgcattttctgaggtttctgtcgtaccatactctgaatcttcctcaaacagaacagatgaagtctcctcaggtcagccagttctccctgggatagaggaaccagggaagaatcaatgcatagaagcgtcagtattggaaatgggtcttgaaggagcaatctgatattgacagcagatgtatcagggagggaacacataagcaaactcatagataagtgaacatgctttgagatgtttaggaaaaagtgaagaatgtggtgtgttcagaatgtagattcccagggctgcttgattggcttcaatatgtgaagaatattgaatgccatagatttgtgattccatattcttctaaatataagttttaaaaataccttgatatacggaagaaaatgaaaatggcctctacacttattttgatgcatacaatgtgcgtgaactttctgaaagtgaatttgacatatatattctcaaataaattgccttttctttttcagtgggtcctatgccatatgaatgtgaagaggcaagggcaaggaattcacacaaaaaagatagagggggtgtttatggtcattaaaatatgaaaaacgtaaggtgaaatcttaacaacggttagtaatgctttttaataagcagctaatgccaatcactgacatttatcatatgatgtgttgtcgtggataacaagtatttattgctcacttaacatgtgccagtcatttcgctggatactaggaggacattgttcaaaaaggtagattgggccgggcgtgatggctcacgcctgtaatcccagcactttcggaggccaaggcaggcagatcaccggaggtcaggagttcgagaccagcctggccaacatggcgaaaacttgtctctactaaaaatacaaaaattagctgggcatggtggtgggcacctgtagtcccagctactcaggaggctgaggcaagagaattgcttgaacctggggggtggaggttgcagtgagccgagatattgccactacagtctagcctgggtgacaagattgagattccgtctcaaaaaaaaaaaaagatagattgggccctgctccttggaccttagcttttagagtgtggagtcacacaataaatctggacaaacataaattaaaaagataacagattttcataagatctgtggggggaaaaacagcattgtgattgtaatagagaacaactggggagcttcatgtagacaaggtgatcagcaaagatctgaaggagaaggttatatttgaattacaatctaaagaagaaggatttagccctatgaaaaatcagagggaagcattcaggcaaagaaaacatctagtaaaatttctaagattggaataagcttatacattcaaagactacatgggaggcagcaggcgagtgagccctgggggaggagtggtctggaaggacattggagaggcaggcagggtacagaccccaagggtctcaggtggaagtatatctgggagcaggggacaccttgcctcctctaaacactttctccaaaaggagaactctctaatggttggtgacgattatgaaaagatatggtggagaaagccctgtgagattcacagtgttgacatcagaagtcagtccatggggccagcaaaaggtgttgtcctctgtgataatcagttctatcccaaccaaaggcacagcccctccattcaccattgctgatcacaatcaggctgtgagaatcagctcgagcttagcctgcaagtcatggtcaggaactctagttgtgagtgcaatgaaaaaccatctaatggttttaggtagaggagcgcatgaccagacttacatttatgaaacatctgtgtctgctgtgcgcagaatgcttttggagacagggagaatggatataatcagggcagccaggaaggagacaattgcagcaacaccacaggtgaaggcagatgaatggtgctctaggatattgacaattagtatgacatgtggcagatagttttgtaggtagcatagacagtttttgcaggataatctgggatggcaagggacaaaaggaagggaaaaatcaaggatgattcttaggaatttgatttaggaaaatgatgcactgtggtggtgtgatttactgagatagagataagaaacaagttaaagttccattttagtcatgccaagtatgggatatctctaatctgactagagtagagaccaagttggcatttggatatagggtgagggcagcaccataaggatctgaatgtcgagggaccagactgggctggaaaaatacatttggaagacataggcacatggatgatatttaaagccatgggctgaataaaagcacatagagaatcctttctttttaataataactgtgagtatgaatttttgaacaccatgaacccacccctttccctagtataatgtctccctgaataagtggaatgttctgtatacactaaattaaacaactgtggtcttgcctctaaaaactcaaaatctaaaatagaccatgatgacatgaccaaccaagactccatctctcctcttttccctgagcctttgtagtaataactcatcctagtattacagtctgcagggacctttatatttattatgtcatttttcttttttgtccttgcagccatccttgaagtgggaaggttgtgtataatctcttatttgatggactgagcaagtctctaagcaggtatttttattcctactttaggtatatgagaatgcaggccccaaaagattaagcaacttctctggtcaaggttacaaaagtagtgagtgggattgacagagggaaagttgctctgacttcagagttctaaggggtctagttttagatgaaaacctcctggatatgtcaatcttcccaaagaaatagagcagcaattaagagcaactagactcaataagaattgagtcatttccctgctcttcatttgttagttggctgaccttggatgtaacacaagcatcatagccttgatttttcaatctgctgaacaggatgctattatctacctctcaggttatttgtaaattaatacatccatctatttactcaactatccacccactaatttattttttcatgtatcaaacgtattatatactaaactcctactatgtgccaggtaccattttaggcattgggctacatctatgtagaaaataaagcgctgcccttctgggacctgtatcctttggaggaagccatcaatgactagtcaacaaattaatacaaactagaacattagatggtgacaagagaaaatatagcagtcctgtggctcatgagaaattggggaaagcttctctaagtagggacatagacaaggattaaatgagataatgcatggaatgtgcttagcatggtgcctggcgctcactagggagccacacagtcctggaaagagaagagttgaaaagcaaacatggatgttgcccagtacttcttgcttgctgcccagcctagagagagcctctgcttttggggttctttcctcccactggctaagttatgagataatttctgaccgctttatcctatgtcattgagcatgtaatgactccaactgctgtttttctgaatctgttctcaccaaacaccttctaatcatgatttaatttctcatgtcaacctgctcacctgcagagaatattctgatcatatagttttcaagtaccggacctcggttcttagatacttttcattatatgatcatatagagacactctaattataattgggtttcctgtgtagtttggccacatggagagaatatgctgatcggatggactttgattattctagttcctgtgacagcttttgctcattgtacgttaagcagctgccatcctgattgaacacactcacctcctgaacttaggtaatgtcagggcctgccatgcggtaggcactcagtgaatgtctactgattgatggattgagacttctctcaggcccatggcaaaatcaaacttccaagggtaaattcaccagggggatgatgaacataaccctcctaggcctcccaagagccagcatgcctgtctttcccaggcatccacccactgtcacttcatagactgagcacaggggccattttttctatatcagcaatagctttgaactcttgcttcaacctattccagggttgagggggaaaattagaaagtcaagcagggtgacagcagaactgtgaagaactgtgcttctcactccaagtaagcccagctgccaggcaaattcaagagcagaggtcccaaatgcagttatatttctgggagcaatgcttccctttatcttcagagccctggaagcgcagagaaaagaaggtgagggcaggggtagggtggtgggacccacttggctcctgttgatggtaaagaagtacaggacctcaagtcctaatgacaaaagtaatagtaatatgattcacttatgactcagcagacattacacttcatacttgatcctatcatttcccttaattttacccacccaaaggccattgcatatattagctggtgatagggtttggctttgtgtctccactcaaatctcattttgaattgcaaccacatgggtagggaggagcctggtgggaggtcattggattatgagagcagtttcccccatgctgttctcatgatggtgaatgagttctcatgagatttgatggtttaaaagtgtggcacttcccactcttctctctctctcctgctccaccatgctaaagacgtgtttgcttcccctttgccctccgccatgattgtaagtttcctgaggccttccaatcatgcttcctgttaagcctgcagaaatgtgagtccattaaaactcttttcttcatagattacccagtctgaggtagttctttatagcagtgtgaaaatggactaatagagcttgaaaccctcttctctttgattcaaactgacaattttcagaaatacataatgacaatttctggctttggggctaaacaaacactacgcatgaactcattggtttctctgtgaaacagagcccagtcactttatctctctgcgcttcacaccaagagatagtgtcttgtatcctattaggtatgtagtagtattttgctgtttgctacctgtggattcattcctcctgtggttcactttctataactattcttgagggcaggacttgatgattggcaactgatagagatttccattcctctactttcccagctcactctcttctcacatttactgctggctacttgccctgtgaagccgagcagaatctggaaacttcatcttcactaagccatcaataaatggagaaaactgagtaaatataactgagacccagttgttaaaaacaagagaccatcactgatcatcactgatttctttcctacaggtcatgttgtcactcgtttcttttatttcttttttaaaaattattattattattttcataagttattggggtacagtggtatttggttacatgaataacttctgtagtggtgatttttgagattttggtgcacatatcgcctgagcagtacacactctaccatatttgtagtcttttaatcccttgcccccctctctctcttccccccgagtccccaaagtccactgcatcattcttatgcctttgcatccttgtaacttagctcccacctatcagtgagaacatacaatgtttggttttccattgctgagttacttcacttagaataatagtctccaatctcatctaagtcactgcaaatgctgttaattcattcctttttatggctgcatagtattccatcatatatatatctcacagtttctttagccacttgttgattgatgggcattttggttggttgcacggttttgctgttgtgaattgtgctgctataaacatgcatgtgcaagtatctttttcaaataatgacttattttcctctgggtagatacccagcagtggaatttctggatcaaatggtagttctacttttagttctttaaggaatctccacactgttttccatagtggctgtgctagtttacattctcaccagcaatgtagaagtgttccctgttcaccgcatctacaccaacatctactggtttttgatttttttattatggccattcttgcaggagtaaggtggtatcacattgtggttttgatttgcatttctctgatcattagtgatgttgagcattttttcatatatttgttggccatttgtatatcttcttttgagaattgtctattcatattcttagcccacttttggatgtgatgtttgtttttttttcttattgatctgtttgagttcattgtagattctggatattagtcctttgccagatgtatagactgtgaagtttttctcccactctgtggattgtctgtttactctgctgactgttccttttgccatgcaaaagctctttagtataattaggtcccagctatttatctttgtttttattgcatttgcttttgggttcttggtcatgaaatccttgcctaagctaatgtctagaagagtttttccaatgttaccttctagaatttttatagtttcaggtcttaggtttaagttcttaatccatcttgagttgatttttgtataaggtgagagatgaggatccagtttcattcttttacaagtggctagccaattatcccagcacaatttgttgaaaagggtgtcctttccccactttatgtttttgtttgctttgttgaagttcagttgtctgtaactacttaggtttatttatgggttctctattccgttccattggtctatgtgcccatttttataccaataccatgctgttttggtgactatggccttatagtgtagtttgaaatcaggtagtgtgatgtctccagatttgttcttttttcttagtcttactttggctatgcaggctcatttttggttccatatgaattttagaattttttttctaattctgtgaagaataacagtggtattctgatggggattgcattgaatttgtacattgcttttggcagtatggtcatttttacaatattaattctacccatccacgagcatgggatgtttttccatttgtttgtgtagtctttgatttctttctttttttcttcttcttctttttttttttttggagacagagtcttgctctgtcacccaggctggagtgcagtggagcaatctcaggctcactgcaactcctccatctcctgggttcaagcaattctcttgcctcagcctcctgagtagctgggactacaggcatgtgctaccacactcggctaatttttgtatttttagtagagttggggtttcaccatgttggtcaggctggtcttaaactcctgacctcgtgatccacccgcctcggcctctcaaagtgctgggattacaggcatgagccaccaagcccaaaagtctttgatttctttcagcagtgttttgtagttttccttgtagaggtcttttgactcctttgttaggcatattcctgcgtatttttttttcagctattataataggggttgagttcttgatttgattctccacttgatcactgtttgtgtgtagaagagctactgatttgtgtacattaatcttgtatctggaaactttgctgaattcttttatcagttctaggagctttctggaggagtccttagggttttcaaggtaaacaatcttatcatcagcaaacagtgacagtttgacttcctctttaccgatttggatgccccttatttctttctcttgtctgattgctccctctaggacttccagtactatgttgaagagaagtggtgagagtgggcatccttgtcttgttccagttctcagagggaatgctttcaacttttccccattcagtattacattggttgtgggtttgtcatagatggcttttattacatgaaggtatgtcccttgtatgccaattttgctgagagttttaatcataaagagatgctggattttgtggaatgcttgttctgcatctattgagatgatcatgtgattttttgtttttaattctgtttatgtggtgtatctcatttattgacttgcatatcttaaaccttccctgcattcctggtatgaaacccatttgatcaaggtggattatccctttcagatgctgttggattcagttagcttgtattttgttaaggattttagcgtctatgttcatcaaggatattggtctgtagttttcttttttggttatgccctttccttgttttggtattagggtgatgctggcttcatagaatgaattagggaggattccttctttctctatcttgtggaattgtgtcaaaaggattggtaccaattcttttttgaatgtctggtagaattctgctgtgaatctgtctagtcctggagtttttttttttttttttttggtaattttttagttaccatttcaatcttgctgcttgttattggtctattcagggtatctaattcttcatgatttaagctaggagggttgtatttttccaagaatttatccatctcttctaggttttctagtttatgtgcataaaggtgtccatagtagcctcgaataatctttttttatttcagtggtgtaggttgtaatatctcttgtttcatttgttggtaaggttatttggattttctctcttcttttcttggttaatcttgctaatggtctatcaattttatttatcttctcaaagaaccagcttttgttttatttatcttttgtattgtcttttttgttccaatttcatttagttctgctctgatcttgggtatttcctttcgtctgcgggtttgggtttggtttgttctagtttctctagttccttgaggtgtgaccttagattgtctgtttgtgctctttcaaactttttgatgaaggcatttagggctatgaactttcctcttagcactccctttgctgtatcccagagattttgataggtggtgtcattattgtcattcagttcgaagaattttttaatttccatattgatttcatttttgacccaatgctcatttaggagcaggttatttaatttccatgtatttgcatggttttgaaggttccttttagagttgagttccaaatttattccactgtggtctgagagagtgcttgctataatttcaattttcttaaatttattgaggccccttttatgtcctatctaatggtctatcttggagaaagttccatgcactgttgaatacaatgtgtattctgtgcttgttggatgaaatgttctgtatatatctgctaagtccatttgttctaaggtatagtttaaatccattgcttctttgtggactttctgtcttgatgatctgtctagtgctgtcagtggagtacagaagtcccccactattattgtgttgctgtccatctcatttcttaggtctattagtaatcgttttataaatttgggagctccagtgtcaggtgcatatatgtttaggatagtgatattttcctgttagacaaggccttttgccattatataaagtccctctttgtctcttttaaccactgttgctttaaagtttcttttgtctgatataagaatagctacccctgcttgcttttggtgtccatttgcatgaaatgcctgtttccacccctttactttaagtttatgtgagtccttatgtgttaggtgagtctcctaaaggcagcagatggtttgttgatgagttcttattcattctgcagttctctgtctttcaagtggagcatttaggacatttacattcaatgttagtattgaaatgtgaggtaccattgcattcatcatgctctttgttgccagtgtactttggttttgttttttgtttttgcttgtaacttgtatttttgttttataggtcctgtgtgatttatgctttaaagagttctgttttgatatggttccaggatttgtttcaagatctagaactccttttagcagttcttgtagtggtggcttgataatggcgaattctctcagcatttgtttgtctgaaaacgactgtacctttccttcatatatgatggttagtttccctggatacaaaattcttgactgataattgttttgtttaaagaggctgaagatatggccccaatcccttctagcttgtagggtttcttctgagaaatctgctgttaatctgataggttttccttcatgggttactggtgctgctgtctcacagctcttaaaattctttccttcgtcttaactttggataacctgatgacaatgtgcctaggtgaagatctttttgtgatgaatttcccaggtgttctttgtgcttcttgtatttggctgtctaggtctctagcaaggccagagaagttttcttcaattattcccccaaatacgttttccaagctttgagaattgtcttcttcctcaggaacactgattattcttaggtttggtcatttaacataatcccagacttcttgcaggctttgtttatattttcttactccttttactttgtctttgttgtggattgggttaattcaaagaccttgtctttgagctctggatttctttcttctacttgttcaattctattgctgagactttccagagcattttgcatttctaaaagtgcatccaaagcttcctgaattttttattgctttttctttaagctatctatttcattgaatatttctccctttacttcttgtattatgttttggatttctttgcattgggctacgcctttctctggtccctccctgattagcttactaattaacctccaggattctttttcaggtaagtcaaggatttcttctcggtttggattcattgctggtgaactagtgtgatttactggggggcgttgaagagccttgttttgtcatattaccagggttggttttctggttccttctctgggtaggctctgtcagagggaaggtctagggctgaaggctgttgttcatattttttcgtcccatggggtgttcccttgatgtagtactctccctctcttcctgtggatgtggcttcctgagagctgaactgcagtaattgtctctcttctgggtctagccacccaaggagtctacctggctccgggctggtactgggtgttgtctgcacagagtcctgtgatgtgaactgtctatgggtctctcagccacggataccagcacctgttctgctggaggtggtggagggtgcaatggaatccgtgagggtccttagctttggtggtttaatgctctgtttttgtgctggttggcctcctgccaggagggggcgctttccagaaagcatcagagccgccgctgtgtcccctgccacagccccgagtttgtttccaggcggagggtgagacgggcctgaaaacttgcccaaggccatccacctcccagctgcgaaagaaagggctttagttcttccctcctccacctgtgacgtctgcactccggatttgtgccctcccctgagttcttgccaggaggcttctcagctcattcaaattgttacaaagttcgactagagaattccttctccctgtggagttttaccccctgctcctctggccatccttccaatggatccttgtggtgccaggcaggaatgggctgcttggggacctaggaagcccccagggcctttctgctgcttcttctaccctcccccacacctttactcgactcactaacttgactcagctccaggtaaagtcagaaatttctgcaaacagaccttcagcttctccagtgggggtgtgtgtttgggagaggagggtctccctttctcagttccgcagttggggcactcaatatttgggggtctctcgggtcctgcaggagcagtctgcttcctacagagggtctgtgagtcctttcgggattgctggtttgttcttgcagttctgaagctaaaattcacaatgcaagcctctgcatgctgctctgtctagagctgcaatctggtcttgcctcccgtctgacatgatcccaggagctctctgagagagcaacccaaaggagctgagagagatccggagtccccgatgtgagggagcatcaggctgcaaggacgcggcactggcgatggtttcgcaggggcatctgttcccttggggcgtggaatccctgctctgccgctgccccaactcggctccgaagtgcctttgctgcaagatttcctgagcttagcagtctgcccgtttcttttctttctttctcttatttttccccctgaatgtttggtttctctggcaagcccaaacacgtaagattatatgtgaggcatatttatttacataaagatgcgtgttttttcttaactcagcatttacatgtagcttggccaagttaattaactgtagaagacctcaattttgttgtcttttaaaacaaggcagctgtattagattagtggttttcaaagtccgttagatggtaaagtgcctgcaagccatggcctgctttgtgggataccatgaaatattaatacccagagctagacttaataagcacacgtataattttgtgatcccaaatactatcttatatatgattgtaatagagacaaaagttagcatgtatggagatataaatcattaattcattcatctatcacataagtgttattgagtgcctacacaaatgtttctcaaaccagcattcaccacctggagaacctattaaaatacagatcactgagccccattcagctgtttaaccgacgatgctcatgttggttcagctgatctgggaaccaaattttgagaactgctgacctccactagtccagcccacgaattggcaaactacagcccctgagccaaatctggccctttcttctttttgtaagtttcactggagcacctcacatttatttatgtattgtccatagcagcttttgtgccacaatggcagagtttagtagttgtgacagagactatggcctggaaacctgcaatattatccgtgattttccacacaaaaatctgcattctgggttttgtatgcaataagtcatgtacaaaagtatggagctgatgtcctgatggagcttacattctaacagggcactaaaaatttagtgagatttaaagaaaagttataagagaacatcttaattgaggtattctactttcaattattcgtaaccttattattatatatttacttcttttaaggataacatcttcattcatatttctataactctagcgcatgttccaatggcttcaagtttgcatgattaaaatatctctaaactattcttttcctctcagtactttctcctttcagtgtattctaggtaacatttccagagaaaatatccttaatatagttatgaattgatgattgcctccagaataaggttttttaaaagtaattttgactttattttagattcagggcgtacatatgcaggtttgttatgggagcatattgggtgatgctgaggtttggggtgcagatggtctcatcacccaggtagtaaatagtacccaataggtagtttgtcaggctatgcccccttctctttctccccaaccagtagtccctagtgtctattattcacatctttatatccacgagtactcactgtttagctcccacttataactgagaacatgtggtatttggtttcctgttcctacattaatttgcttatgataatggcctctagctgcatccatggtgctgcaaaagacatggttttattcttttttatggctatgtagtattccagagtgtatatgtaccacatttcctttatccagtctaccattgatgggcatctaggttgattccatgtcttcgctattgtgaacaatggtgtgatgaacatacaagtgcatgcatctttttggtagagtgatttattttcctttaggtatctaccccgtaatgggattgctgggtcaaatggtatttctattttaagttctttgagaaatctccaacttgctttccacagtggctgaactaatttacattcccacaagctgtgtataagtattcccttttctctgcaaccatgccagcacttgttatttttttaagtttttgttaatggtcattctgacttgtgtgagatgatatttcattgtggttttgatcagcatttctctgacgtttagtgatgatgagtattttttcatgtgtttcttggccacttgtatgtcttcttttgagaagagtctgttcatatcctttgcccatttttaagggatttgttgttgttgttgctgttgttgaattgtttaagttcttatagattctggatattagacctttgttgaatgcataatttgtgaatattttctcccattctgtaggttatctgtttactctgttgatagtttcttttactgtcaagaggctttttagtttaattagatcccacttgtcagtttttactgttgctatcacttttggggacttagccataaattctttgccaaggaaaatcaacgttatttttcacagaattagaaaaaactattctaaagttcatatggaactgaaaaacaaaaaaagagccaaaatagacaaagcaatcctaagccaaagaacaaagccagaggctttacgttatccaacttcgaactatactataaggccacagtaacctaaacatcatagtattggtacaaaacagacacatagactaatggaacagaatagagaacccagaaataaagccacacacctgcaattaattatctgatctttgacaaagttgacaaaaattagcaatggggaaaggacaccctattcaataaacggtgctgggatagctggctagctacatgcagagcatgaaactggacctctgcctttcaccaaatacaaaaattaatccaagattgattaaagatttaaatgtaagacctcaagctattagaattctgcaagaaaacctaggagatacccttcttgacagaataaagatctgttctaattattccacattgtgacaccaaaccatgaccactactatatcttccacctgacatttcccacagtctcagctctgcatggacctgcccagaatggagatagcaatgggcttaccatgttgacacagcctctgtcacttcctattttctctctgactcaggaaggagtcacttcactcttgtaattcttctgccagaaccctggaggtatcttaacttacaacccccagtctataaactctccactaaagccacactgattgactcaccatcttccaaataaactttattgattatttgctactaatatgagttactgatgactaataacagattatctcaaaattgtgttcttaacacaataatagattttcctttttaaatcttgtagtttccgtggggcagagtctggggagtggcttattttggtagttcttgctttagggtgtttcatgaagttgcacttacaatgctgatctggattattcatctgaaggctcagctgggtctacaggatcctcatacagtgaatgcaccgttgagctggcaaattggtgctggtattgctttggacctcacctcatgccacggaggctactcctcacagagcaagtgaggcaagaaaagaaaacataagccacgatgtcttattttgtaaatttttaaaatttactttacagtgtcttttaagatatagccccagaaatcacactctattatttcagcaatattatatttttgacacagatcagtcttaattaaagtggtaatgacacaggagcatgaataccagggggtgagaatgactgacaccatcttggagccacaccatcctaacccctcctactctagtcagggcttttgcctttgctattgttttcctatttgaaatgtttgtttgtttatttatttatttatttatttatttaatttcctaaatctaaccaccttttaatgctcatttctgttccatcttccccgtgacaccttctctgaatcctttagcctgaagaaattgcatcttccattgttctcctgtggtctcattatcaatatcacacattttagcagttactcacagataggaaataattcctgttcacaaataaaacattctgaggaactcagttcttcctattcgaggaaatcctccactactactacaaaaacctgcataaggcattgaaaaaaaaccctccgttagagattgagctgtattgtagtacataatatagtatgagtaatattaatatggtgtatttgatagatgttagagatcagtgtctaccagagcagtactactcaaacttaaatatttatatgaatcatgtagggacctagttaaatgcagattgagattctgtgggtataaggtggggttgagatgctgccattctaacaagctcccaggtgatgctgaggctcctggtccatggaacaacttttgagtagcaaggtgctagaagatggacataaaatggacataaaatagaataggagttgaaagtagatggaaaataaaagtagtgaagagaatcatggctgtgttcaatcagtagtactggcaaggcataaatatttgaagtcacgaatcactcaagtatttctttattgctctttggtactgcccattatctttatacatgcatgtatgttttacctcttccagccttgattataggcccctttaggattgaaggtgttccagtcacccatagaggtgaaatatagttccctttctggagtagttgctcaataaatgtgtactgcttgattactctgctgctaattctcacggtcatttattaatttctattattacttccccaagttttctcctttcaaaatattataggaaattcaaaatacctttctattataaattgatgtgttttatttacagttccttatgatatataatacaattcctcataaaaaaataaaattttagttggtctaaataccaggtaaattaacatgatcaaattaatagaaaaagtatcatgcccaggtaacatgtcagaccaattaaatcagtctttgagagaggattcaggtattggtattttttaaagccccatgggtgattccagagtgaagcaaaagttgaggatcaccagtttaattatcatcctactatattttaagatagaataattatactttattttttattgtgccccaaagcattttttttttaaatggagtctcactctgtcgcccaggctggagggcaatggtgcgatctcagctcactggaacctcggcctcctgggttcaagcagttctcctgcctcggcctccccagtagctgggattatagtcaccctccaccacgtctggttaatttttgtatttttagtagagatgggtttcaccatgttggccaggctggtcttgaactcctagcctcaaatctcagcctcccaaagtgctgagattacaggcacgagccatggcacccagatccaaagcatcttttacaacatgtaatttggaaatatcaatgaagaccaattcagagaaaaatgtttaccttcctttttttttcttacaggatgtagctgcttcaatttataaataagtatagatatgctatagtaatttttgaaattctatagcaaactaacttttccataaatgaatatggtttcttaattatcccaagcttgttaatgtaggttgtactttttttcttttagcaaacacatcagatcattttgccaaattatccaagtcattttaaaaacataaagatattttgcaaatattttatatctgccagtcaaagtcagtcttggtcctaaataggatgttgttacatgcctgccttataaatgttagcatcacggaaagcatttttgtttaatttagaaatgtttgagctcagaggaaataaggatacttatctcgtttactcagctttagtaactgcaaaaggcagaataaaggtagcttgctggagttgctagaacccacatacagtcagaatatatgacctctcctttaagctctgcctcttactagctgggtgacctttggcaagtctcttaacttctgttagtctccattgcttcatttgtaaagtgaaagggttgaagtagacggcacataagattcttatacctggaaagtgatggggtgagggactactaaggtcctttgagtgcttcttggttacgcactgtgagaagtgatggaaaataattcacactctcaaaaattccatgactctataggagaattttcaagtgaacaggcacaaagtctctagattgttaaattaagcctatgaaaaatgaaggaacataaaataaaaagagagtaattgcattggttctgattctctcatagaaaaggaattttacacgtcgttaattccaatgctttgtattacagatgaggaaaccgaatcccaaaaagttcaaataactttctattactaacacataaaatagcacactaataggggatgaaaatttatccagtttaacaatccagtccttcatgtcaatcaaaagcttctttatcaccatcataattcaacatttcattctgtattgagaaggaggtggatctaagatttatatttatgatattcatgataattcagagtttctgaaactgacatcacaggaagattttcacaagtgggccaggatgtgattcatgggccctgatgttacaagtccagattggcaaaccaagggctgctatcaaagggactaagttggatggctttctggataaatatttctttgtagctggatttacaaaggttatcaaccctccagataaaaagtcatggttcttctattgccctaagagtcatagatagtaagttacacagtaacatattcattttatgtatatacatacatacatatagtcatgtatagtaaattacatgaaaacatcagtggtgccatacactcacctgatcctgggtgacggaaacgagtatgaggaatttaagtagtccttctcaaagtcttccccagagatcaattagctcatcaccattttaccatgagggtatgctcaggggagatatgtaactaaagtcctgataacttgtaccaggtgactgtaaatcattcagtattcagttagtcaacaaaatcaacaaataattatcatgcctctatagtataccaggcacttgctgggcactgggaatatggtgattaataaataagactgtccatgcccccagcttcatattctagtggaaagggaaagatatcaaaacatgtttgcaaggctgggcaaggtggctcaggcctgtaattctaccactttgggaggccaagtcgggcggattacttgagttcaggaatttgagaccagcctggccaacatggggaaaccccgtctctacaaaaatacaaaaattagctgagcgtggtggcgggtgcctgtagtccgagctgtttgggaggctgaggcaggagaatcacttgaacctgggaggcacagagtttgcagtgaccagagattacgccactgcactccagcctgggcaacagagtgagactctgtctcaacaataacaaaaacaacaaatacttacaaaacgtaaaaaaaaaaatccctttagatatttattagtgtgataagaaagatgagaaagcaaatgccatagagaatagagggtgaagagcaaaggctgcatggtgtgagtggtcaccgagttcttctcttaaaggcagtgatgcttaaactcagttgtggagagggacgcagtgtcaccaagttctgagggaaaagtgtttcaagcagaagaagcagaaaatgcagtggtcctgagatgagaatgaggagctctgcacttctgccagaagaggcattgtaatagtattggagatttgaaatcgttattttactcaggcatttattaattaatatattatttattcatcaaaatacatgttgagactactgtatatcatggcctattcaagacccagttcccctgcccttgtgcagcttagttcctggtgggagacacagacaataaataatacccatagtaaaaagcaaattatataatttgtaggaaaataaggactatggaaggaagaaaaatttgggtaaggaggaccaggagcctggggatagggaggtcagggagggcttggctgagaaggtgacatgtgatgcaactgagggatgtgagggaattagccatgcaggtaggggaaagagcatcctgggaagtggggacagagcacagacatgctggagaaacagcaaggaagtcagggaggcggaaacagagcaagtgaggagaagatagtgggaggtctcaccagagagggagccagaccctgttcaataatgcctcgacttgagcccagcatgctggctcacacctgtgatttcagcactttgggagcgaggcagtaggattgcttaaggccaggagttcaagaccagtctgggcacaatatcaaaaccccatctctacaaataaaaaataaataaattagctgggcatggtagactggacttggtggctcacacctgtgatcccagcactttgggagctgaggcaggaggattgtttaaggccaggagttcaagaccagcctgggcaaaatagcaagacctcatctctacaaataaataaataaattagctgggcatggtagcacatacttgtagtctaagcaactcaggaggctaagatgggaggatcttttgagcctgggagtttgaagctgcagtgagctatgactgcactccaacccgggcaacagagtgacaccctatctctaaaaataataataataataaattcattgaataatgccaggagtttttctctgagaggagtggataggtattacagggttctttgatggcaaagaaccgaggaatcttattatccccacctataggaaaagcacctagggaggctggctttccatgcagaggaggaaccaccagggggcggtgcaccgcaaagtcgggctgtggtggccctgcagatggcggtgaacgggaggagcaggctggcttttccaggctcccgctatctaataagtgaatagcattgcttttctgggaaaatctttttaaatgttttttaatatagaagacttttaaaaacattgaaataataactgtacctataggccaggtgtggtggctcatgtctgtaatcccagcactttgggaggctgaggtaggaggattgcttgagactaggagtttgagaccagcctgggcaacatactgagaccctgcctctacaaaaaataaaaataaataaattagctgggcatgatggcacaagcctgtagttccagctactcgggaagctgaggtgggaagattgcttgagcccagaagttggaggctgcagtgagctataattgcaccactgcactcccgcctaggtgacagagggagacctcatttccaaaagaaaaaacaaaatatattataatatttatgaggtatgtacagagttttaatacatacaatgtattaaagatcaaatgtggataattagcatatttatcacctcaaatatttgtttgtgtagagaacataaatcctctcttctagctatttgaaaatatataattgtttactgtagccaccctataatactatagaacactagaacttatttgtcctatcaggctctaattttgtattctttagcaagtctctcactaaccctccaaccctactacctaattctcagcctctagtaaccactgttctactctctacttctataaggtcaacttttttagcttctacagactctgatttaaaaacgggctaatgatccgtacgacacttctcaaaagaagacatacagaaatggtcaagaaatatattaaaaatgttcaacattgttaatcaccaaggaaatgcaactcaaaaccacaatgaggtatcatttcaccacagttagaatggctattatcaaaaagacaaaaaaaaaaaaaaaaaaacaattgcgggtaaggatgcaaaaaaagtgaacccttatacactgttgggattgtgaactagtacagccattataaagaataatattgaggttcctcaaaaaactacaagtctagatggctctttgacttcctaaaatgacaacagcaagctatacacagaattaaaatataaacatactcccaaagccatatataaagtacctgaggcagtccataaaattttaaatttcaatagagtactaatttaatcagggaaactttatctacggcattttttgctgtctccattaagcatgttatatgggctctcagaaccctgaagatcttcatccaaaagggaagttatactctcattttatctctaacagatgtgggcatcaagtgtttatgggcgtgaaaaaggctttccattaaaggaaaccctgtcaagtagcaggattttcttttattatgttgttttacacacaaaacattttttttgaaatcaccaagtctgcataaacctgaaaaaagcaaagtagtattttcataacacatatttgtctgtcactgctgtttttggcggaaattgtcccaacgagatctttgagttaccggtttctaagtagcctccagtcttgaccttccagaggcctcaaggacaatgatgtattggcccccagagactacttttggggctccagcattttgcaaacacatgagcaaagttttcttttcctgaagtcattttatttatcttcgctgtttccttccgcagccctttatagaaacagaattaaattgtattgggaataacaaggaggaaaaataattcacttatattttattgctttaatattttgtattagcattaccagtgatttatgtttcctgctccggtgtccccgttttgaattctccaagtctgtgaagggtgttgaagacaggtaatcggtaaataggctttcaagggagaatgtgtataggtgtgggtgaggtgaattaaggcttattttctcattgatctttcgctttgctttccaaagcagcggacactgggttgcacatctctgttcagttacagggaggggagggaatgcccagtaatttcttatctcgtggtatgttaattgctaaaatataaacaaaggtaagaaaggtgctttgtgcaggtgtaagtctctgggcatttgtccgtgactcacttctcagtatatcaagaatgatttctttcctccacagactaaccaagccttaactgtcaggttagccattctcatttctccctgcttggcctcgatcagctgctggccttccccgggagaaagagcctccatttgctatgagctccttgccggatggagtgattgccagcacatcccagtaagactgcagcaggtgctgcagcttggggaaatggcgtgtgttttccttaccagtacatgtggcttttgagctttgatttcacagaaatgtaaaaaacaggtcgatgctagtatgtactacattcctaccagcatacactttcaatccactttctgacaactggcttgtatcactccctgctttagagtaatagcacctttgcttgaagtttcttaggtgaaaatcatgaaggttcccattttgctgaatctctgtgttactgattaagagagagtaactgcgacaggggtgggcacctgacaacattttctaaataacattagcatgttttttcctcttcagccccctgggtttcaagcatttgatttgaatttttttccctactccctttcttaaaatgcatgactaagaaactgtttctttcttcactgatccttggttattcgctttgaaaaaagacgacagaacaagagtatttccaagaatacaccagtcctattctttggtgatgccactttctaatttaatgtgatccagcagccaaaatgttgttctaactaacatatctccttgctaaaaggtataaaacaggcatcttcaaactatttcttaagaaggctagagtcaatattttaagctttgtgggttgtactgcgtctttctcaactgctcaactctgtgttgtgcataaaaaagcagagctgtgttccaataaaactttattcacaaaaacagatggtgaactggagttggcccacaggccgaatgaccctgggtttggaagatgcttcttggaacttctggcccagctggtttccatctgcctttagctgattaagaagatgtggccaagggttccactgccacctcccccaccactactaatttttactgatcagattacacatcttatttttcactctatttgttctagacctatcactaacagggcaggcaagagccagggaagttgctcttaaaaaaaaataaaagacctggaaacccaaactctctatactgtggctttattttgtcatccaagcttggaagggcagctctcattttggcttccagtgcctgtctccattgccatttctccctctttcagtcctggcaggctgagagctttatggtctcctaaccttgcctttgcagcatcactagccctggtaataagaacaccatccatatactagccctttgacaatgaagaaagctgtccacatgtcttacctgatgtggtcctggtccaatcatttaagtaatttttaaaaattattttctgttttgacaataagaaaacagccctggagaggctgaatgacttgcttaagattctgcatctcatatgcagtgcaactaggcttcacctccactattctcactctaaatcctggtatctggcctctacctggtactgtttctcagtcctgagtcattaagggtctggcttcaggcactcctctgtcacattttttcttggatagattattaataccctgagatgccagataccattctgcagagagaagaagaaagccacagaaagccgttcaggctgagaatgtttaaaaatatatggtgctgaccaccaataccaatggcagcagaggaggatctttagtaaaggattttcaaagatatagagtctgtatctcagagtttaaaaaagaccattgctatacaagatgctccgatcagctctggttctcagtacttataaagcagcggaatctcctgctttatgaactttagttctgggcttcagctctgtattagtctgttctcacactgatgtaaagaagtagctgagactgggtaatttataagaaaaagaagtttaatttgctcatggttctgaaggctatacaggcttctgcttctgagaaagcctcaggaaacttacaatcatggcagaatgcaaaagggaagcaggcatgtcttcacctcgatggcaggagagagagagagagagagaaagaggaggtgctacacactttcaaacaaccagatctcgtgagaactctatcatgagatggcacaaggaggatagtgctaaaccactagaaaccacctccttgatccaatcacctcccaccaggctccacttccaacattgggaattaaaattcagcatgagatttgggtggggacacagagccacaacatatcagggtctggtctggtcaggggtaggttgcaggagactagggaccaaaatgatcttaccaaagggtgaaaaggtaaacacagaagttaaacagcaacactgaaaactcatagtccatgaaatccaaggggccaggagggaaggctgaaggttattaagattaagaagatcaaagcggaagacaaagttgggatatggagccagcagtagatgtgttctagtaaacacacacacatatgcacacacacacacacacacacacacacacacacacacacacacacggtataaatgatggaaaaagaggcagtggtttataaccatgccccaccagaaattctacctggccctaaattagtgtgtttaactatgcacattaaaaataaccaaccaaacaagcaaacaaaaaccagtcaacccaggcctgctgatatatctgcttatctccttggcaagggccaaccacagaactaagatgatttaagtagatctgtaaggtttctcttcccctgttttctgagtagagaaattcactggaaatgggattctttgctccactaagaagtccctggctcctgccactatccctttcctgcataattgtcttaaatcctctggtaaaggacattttagccaccttcttccagaagctacttttaaaaatatttgaagtagagatttgaagaaaagtggaataagtagccagaagccaaagatacttaagaaaccaagcagaggctctttcctgctaagaagaaaagttgggggatggtaagacaaacagagaagctgggtagttgcttaacgagatatagagcttttaggcttgattagggtcttaacaccttcctcatagggaagcactcactctgaatctaatgacattgtattcctatgacacatcaataaaatgcctacaggagaagcatctttgtacaaacttgtgccatatactttttaaaaatttttactaataaatatgtgtcatatattttactaatatgtgccacatactttactaatatgtgccatatacttttttattcctactaataaatatgcatatataaacatgatatagatatatgtgatctatatatgtataaatatatactgtgtgtgtacaagtatacaaattgtgtatgtgtatcttgtttaaagttccccagttttttcaattaaatactcacgaattttaaagagatcaagaagtcttctggcacttagaattgcattctactcaatgatatattgtaggtggaactacatacacattgttacattgttacaggaaaatgccagttaagatgttgtttaggaagcaataccaagggttcacaggtttatattagaaattagtgtctttagctcctttctgttgggatttaattttatgtataaaatgccattatgtccaaatattttataatgatgagaaaaccagttcactttggattatcttcattttttagtgtgattaaaaaaaaatctggctgcaattcttgtgcattagttaagaatgtgatggtgtgcagtcttttaagtcatgtcagcaaacgtgtatttccaaggtcagctctaccaaagagaatagtatttcttttgcaaccctgatcttacttggggatgaaaacaattattgcctaagttagaaatgtaaacacattaatgcaaaagaaaaatcaacaaaaacttatagtattaaaatgcacatcattttatgtgtgtatgtaaatgtatacaaattttactgatgtttttgcataaaaagataatcaaggctccatcactaccaaatttttagacatttagaaaggaactagacagtattttgtggttttcctgtctatgagataagttttgccagtaaatcaaacaatagtgcaatagacatgttgcatatattttgttagtttaatacctctttatcagcacttcatttagggacactctgctaattttacatactgtatgtcttaattaaataatgctgataattggaacgagtacaatgtattgagaacttatttgcctgccaagccctaatcgaagtgtttgatgtttttgttattggtcatttcatcttcgccatctttggaggtagatcattttatcaccctcattttacagataaaaagattcaagacttgctctgcctcctccaagcttgccatgcatatagtgataaacaatttaaggttatatcaacttctttaaaagtactaccccttcacagtaggttggcatttttactccaaattatgcaaggtgttatggcattttacattataatagcacagaaggtaaataaaactattaaattatttatcttcattcattacagatactgcaagagaaggtcaactgctaattctctttcaaccagcctgaagtagtgactaccattaaaaataaaaactatttaaaaatttgtcccaaatatccgcttaaaaaatgctttctgatcagttgatttaaataacgttatttggcaattgaaaggcttgttttgcaaactgttagaggaagaatctctcctacgaatggttttattctgtagtaaatgtctcctccagatacatggatttttaagccagtgtaaggtgtttaagacatggtcgattctagatatgtgttcgcattttgattacaagcaaatgttccagacccatttctatatttctcggacttacttggaaaggcaccaactaaagcagctgggagctgctggagaccattttaaatggttagttttcaggagattagcagggagcactgccttttgtactcaacactgagtttgaggtttttaaaagtgcacaagctttatactttacccccaattctattttacagtgttttaaaaaactttttttgttgagtcaccttattctttttctcgctcatcacaagacaaccctacttttaacaagaaacaacaaaaagaacagaaaagaataaaaactcacagtgaaagccatcaacgggttttctttttctgagcaccacttttggaggcattatcctttataacaggccctaagtgaaaaggaggaaaaagaaactttacatgattaggaaaggctgggaatgaaagatactgaaaggtgtaatgggaaatgaaaatatagtgatagaaaaggaaaagtaattctctgttggcgacaatgttatgttccatgacctgctcacactattttcttgtggacagcttcctcaaatcccattctgttgataaaagcatattaatatgatcaaccatgaaccagcaccaactgagaataccacttctctaggttggttgtaactgtttctttctgacttaaatactaaatatatcctctgaaataattacagttgtttgttacatccctttagttttagagaaaaattaaaactctcatttcttccttaaggaggctagggctaataactggagttgtatttctttttcattgtaagcccaatcaatttgatttctttttctcctaaatgaaaacataggctaaggccagcaaaaagccataattgggtgactaattaaatagtcaggcatctacagcctggtagagttcagggcttcctagttgaaggaaataaaaccataaactgctatctgtgacagtgtatatgaaagaggtgaaggatagagctgttgtgttcactggtggatggaactatgtattcatataactgcaagatttatggagataacatgattgggaaaatataaaacattaaatagattatgccagaagtcttgcctccaaatgtctaaatccttcaaatgtgtcattgccactacctgtggatcaaagaacaaaacagggatgtgagcgtgcagccctaatctagacacctgagacatgaggagtgcctgccaggaagaatttagaaggagcaggccaggagctaggaggagaaagaagaaagggtgacgtggattgtcaaatggggcctgagaattgacccttgcattgggtgaatggaggaccttgggaacagctactttggtggaattgtagggagggagcctgattcgagtgtgttcaagagtgactggaagcaacaaggacaggcaactctttcaaggagatctgctgtaaaggtagagagtgaacagaagcaatagctggcatggaaaatgggatcagcaagagtggttggacacagaaaggctgacaactagtagtggaaggtttttgatattgtggtcctgaaatgtcctcatagcatgttaatgtccatgttttttattgtgttttctctctttttttttttttttgttttgagacggagtttcactctgtcgcccaggctggagtgcagtggtacgaatttccggcccccaggttcaagtgattctcctgcctcagcctcccgagcagctgggattacaggcgctaatttttgtgtttttagtggagatggggtttcactatgttggccaggctggtcttgaactcttggactcaggtgatccaccagcctcagcctcccaaagtgctgggattacaggcatgaaccaccgtggatggccttttattgtgttttctaagcaaacaggcaagttattctttaatctcatttccttgccataaaaatatagcttaatttctaccaaaaacattggctcccaactgtatattaattatgattatgagttttaagtgacaattgcatttttacatagaggtaatgccgaggacatgaagttattttggatttcaggaataggtagtatttgttccaagccctgtggccatgaaaagccatctttgttcagtcctcaccaaggcaatgtagggtggataagcagtgtagggtggatcaccaaggctaggtgtggatcagcaagccttcctccttaaaaccgactctcagtcttgaacgcccagagggaagaggtaggaagtactgtttttcagctgtgatttcagaagtccacggatatttcaaaatcagcagtctccatcttagatccatgacttacgggggaagttataccccctaacgatattgcagaatagtagtaaatctaatgagagaatatatgagaagaactaaagtctgtccttcgattttccttgtgaccttggataagattgttggttatcatctgtcagctcagtggcccttctttggatgttaagatggtggtattaaccaccagaaatgttttcaaaaggcactctgcacattaaaggttctaattatccttcttcaagctagtgtcagtgctgattattaaacagttttctaatcctaactggcctgattttttttcaatgcagtccttcaaattatccttttgcaatgataaatctttcctaaagcatttaattctgcacacagagaaataccactgcttactcacgaatgctactgaacaaaagctatatttatttcttgttcaggttgtaaatattagaaatttatggatgatgatttcttaagaaataagcactataggctctgcaatgactggcagttctgttaaaagggattttgaacaagctttgaggcagagactcctgcagaagaatttatgcactttgccgactctaagaaggtactgcagcaaactaacagaaatttacttgttttcagcatgctgtcatagttgtgagtgaactccagagttttctttactgtctaagcagtctttgaagtcatctatttggtgattagctgtgatatgccttcctaattagggaaaagctattcaatcatctcctcacagattcctccaaaagcttgttttgaatctcagaaatgaccaattttaactaagcttcaatgaaatgacccacttaataaatttaaatacaatcaccaaaaataaatgttggtttgcttggcatcatgtctttccatctttttactttcttttatttttaaatttatttatattttttattgacacataataattgtacatatttacggggtacagtgtgatgttttgatacaggtatgcattgtgtaatgatcaaatcagggtaattagcatatccatcacctcaaacatttatcatttctttgtgataggaacattcaaaattctctcttctagctattttcacatatgcaatatctttttaattactacagtcactctactgtacaatgggacatcactacttactctttttttctaattgtaactttgtacccattgaccatcctctctttatctcccaatgtcccctaccctccccagtctttggtaatcactattctagtcactactttgataagatcagttttttagctcctacatatgaatgagaaaatgttgtatctgctttctgtgtctgcttatttcacttaatgtaatatcctcaagcctcatccacattgtcaaaaatgacagaattttattattttttatagccaaatagtattctattgcatatatttaccacattttctttattcattcatctgttgttggacacttaggttaattccatatcttgactattgtgaatagtgctgcaataaacatgagcaggcagacatcgctttgacacactgatttcattccctttgtatgtatacccagtgatgggattgctggatcttacagtagttctacttttaattttttgaggaacctccatactatttcccataatggctatatactcaaatttcatttttaaaaattttacatatcacctagttatttctctatccttctgccttctctgcactaatcacaaattgccctaacccagggtttcaattgatagaaccaaccgctgcatctttacacgcaacacattggctgattaaaaatcaatgcctcgttagagatgcaatttgtgttttgattagtgtttcggttatgggtttcctgtcctagaatgtctgccttaatcaactatttttgctttgaatcaccctggactattggcagtgagaggtacatctgcatgagtctccactgagaggcttttcttcctatttatgatacctctttgttcaccaaagggacaaaaattctggcaggtcttaattaatgcctgatgtaaagggatgattaagacatataaagccatggcttctgttttagcttttctaaaatgaaaatatagttgagagaagtgcttttttcagtagggtgtagcaatcaaaatcagcctggttcattgcatagttgtttgatttcctggacccattatgttggggttctgtgttttctttgttagtgctgtctctccactgaactttggtcagatattggggggttaattaatgcatttccaaaatccagaaaatatttttaaaacctcaaatccatcttcatgaaaacttttggctaatctatgttaagtaagtctcataacctacacatgggtgggcagattactctgtagaaagtaccttcatggcatgccatgagcatatcactatccttaaaagcacattcatggtgctggcttgtagacgtgcttccagggacattgcattgcaatggtctacatatctgaagtcttgtaacccatgagcatatgcaagaaagtttttcctcagaagcaattggcttgttactcacagacttcacagaatcgtcttgcaaatgttgtaggtttgccaaaatcttctgttaagtgatcattttgctaaaagattaacttcccaaatttctgtgcacttttaaagctatagtttcatccttgaccctttcttgatctctgttgtttttgaagaagtgtattttttagtacaaaaaatatatatcattgtagacaactcataaaatactaaaaacaataccaacgtgtccacaatataaagataactactgttaacattttgattgatttattttagaattttttcctaagttaatgtaaataatcatttttaatttatttttatcacaaatgagaatgattttataacacatattttagggaaattttcttttatctgatttataccctcacagtgtgtgtatgatttgtgtattttgggtggatcacacaaaccctatacataaaagagtgcatagaatgtatctgaatagtttacagaataattatcaaataaatattcctgataaccatcatccttgccaacaataattagcaaaacaggagcccctgattgcgtcacatttttcttctctaaaaataactactgtcctgacttttatattctactaggtgtccctaaaaatacagcatgtttttattgtttttgaatcttatataaatgaaatcatattatatgtattctttaccaaatttctcctgttgcttaaaactacatttgtgaaatgtattcaggttgttgcatgcaactttaattaatttgtctttaatactctatggtattccattgaatgaatttgccataatttatatattcaactttctcttaatagtcattaaggataatttcagtttagggctcttaactggtaatggggctatgaatggtttgggacatgtctgttagagaatatgtgcaaagttttactaatgtagatgcttatgagtagaattcccagggcatagacatcttcagttttgctagacaacgcccagctgtttcccaaggaggttgtaccaaattgacacttagaaatagcagtttcacatcctcaccgacattttgctattatcagatttttaaaaatattttgagaatctaaggtatgtataattttattagaaaatagattaacttggcattctcaaattactactgagtttgagcatatttctagatagcactatattaatcacttggatttcctttttgtgaagtatctcttcaggtctttgatccattttcccccttgttgactgtatttttcatatttatttgtagtagctatttatttattctgaatactagtactttgccaggtatatgtgttataaatatattttccatttcagtggcttatcttttttttattttactctttgcatgatatctttgataaagtgaattttataattttaataaaattgacataatccatctttctcttattctgtactcttaatattctatttcaagagaatttcataactctgaagtcatgaggctatcattttgtattatttctctaaaagctttgcagttttgcctttcacttttacatctttaatcgacctactattgtcaaggatgaactagagatatgattttatttcttttctatattaatatccagttgtcccattgatacttactaataagttcattctttcctttgttatgtgtcaaatgtctatttacctgcaaacgctctgtttcagtccttacatcaacatctcttgcccctgagttttacatgttaatacatagatgttcttttaaatgcagtttaccatcatcttaaaaaagaaaaaactttatttttagagcatttttaggctcacagcaaaggtgagaggaaggcacagagatttcttgtgtacccaccacccccacacaaacatagcctcgcccatttgcaacatctttcgtaacactgatacatttgttacaatccatgaacctacatttacacatcattattacccaaaatacatagcttacattagggatttctcttggtgctgtacagtctatgggtttggacaaatgtctaatgatatgtaccaccactatagtatcttacagagtattttcaccgtggtaacaattctctgtgctctgcctattcacctctcccgctcccaacccactgacgatcgctgatctttatactgtccccatagttttgcctttctaagaatgtcatatagttggaatcatacagtaagtagcctttttcagattgacttctttcacttagtaatatgcatttaaggttcctctgtgtcttctcgtggcttggtagctcatttccttttatagctggataatatttctttgtttgcatgtaccacagtttatttatctattcccctactaaaggacatcttggttgcttccaagttttggcagttatgaataaaactgctataaacctctttgtggtggtttttggaggacataggttttcagccctttgggataaatactagggagagtaactgctggattacacagtaagagtatatttagttttgtaagaaactgcccaactgtctttcaaggtactgtaccagtttgcattctcaccagcaatgaatgagactttctgttgctccacatccttaccagcatttggcagttgttttggattttggccttcctaataggtgtgtaatggtatttcaggattttatttcatatttacctgatgccacatgatgtagtacatttttctcatatgtctatttgccattctttgttggtgaggtatcaagatttttggtccattttttaattgaatggctaattttattattattgagtttcaagagttctgtgtatattttggatgatagtcctttatcagatgtgtcttttgcaaatatattctcccagtctgcatcttatcttttcattttcttgacattatcttttcaaagcagaagttttgagttttatgaagtttagcttatcaattacttatttcatggattatgcctttggtgttgtatctgatgagtcattgtcatacccaaggtcatctatgttttcttgtatgctattctctaagagtcttatagtttcacattttacatttatgtctttgatccatttggagtaaatttttggggaaggtgtaaggtctttgtctaaattcattttttttgtttttttgttttgcatgtgaatgtccagttgctccagaaccatttgcttaaaagactatctttgttctattgtatttcctttgctcctttgtcaaagatcagttgattatatttatgtgcatctatttctggcctgtctattctcttccattgatctatttgtatattttttcaccaataacatactgtcttgattactgtagatttacaataggtcttgaagttgagtagtgtctgtcttccagctttgttcttgtcctttaatattgtgttagctgttctgggtcttctgcatctccatataaactatagaattggccaggcacggtggctcacacctgtaatcccagcactttgggaggctgaggcaggcggatcacgaggtcaggagattgagaccatcctggctaacacggtgaaaccccatctctactataaatacaaaaaattagccgggtatggtggcaggcgcctgtagtcccagctacttgggaggctgaggcagaagaatgacgtgaatccgggaggcggagcttgcagtgagccgagatcacgccactccactccagcctgggcgacagagtgagactccatctcaaaaaacaaacaaacaacaacaaaaaaaaatctatagaattagcttgttgatatccacagaatagcttgctgagattttgaatctatagatcaagttgggaagaactgacatcttgacaatattgagtttttctgtcaaataatatgaaatatctctttagttctttttaaatttttttcatcagagttttgtagttttcctcatgtaactcctgtacatattttgttagatttatatctaagtatttcattttggggatgttagtatgaacggtaatgtgtttttaatgtaaaattccatctgtttattgctggcatacaggaaagcaattgacttgcatgttaaccttgtctcctacaaatttgctataatcacttgttagttctaggggtttttttgttgagcttttagattttctacgtagataatcatgtcatctgcaaaaaagatattcttatttctcttttcccaacctgtatacattttatttacttttcttgttttatttcattagtcagtgcttccaagagaatattgaaaagcagtggtaagagggaatattcttgtctcattcctaattctaggtaaagcttctagtttttcaccattgtcatgtaaattgtagattttttgtacatatacttttttttcaacatttattttagtttagaatccagatatctatatgtaggtcctgtaaaattctcattgaataatatgcaaagtctataatatgaatactgaaattttatttatttatttatattttatattaacttttattttaagttgcaggaacatctgcgggtttgttatataggtaaattgtgtaaatttacctatctaaaaatatataggtaaacctttatataggtaaatctacataattttatataggtaaatctgtacattatgggggtttgatggacagattatttcattgcccaggtaaaaagcatactacccaataggtggttttttgaatcgctctcttctctcactctccaccctcaagtaggccccagtgtctgttgtttctttctttgtgaccatgtgtgttaaatgtttagtttccacttataaatgaggacatgtggcatttggttttctggttctacgttagttctcttaggataattgcccccagcttgatccatgttgctgcaaaggatatgatcttgttcctttctatggctgcatagtattccatgatatgtatgtaccatattttctttatccagtccaccattgacagacatttaggttaaggtttcatgtctttcttattgtgaatagtgctgcaatgaacacacatgtacatgtgtctttatggtagaacaatttctgttactttgggtaacagaataatggaattgctgggttgaatggtaattctgttttgagttctttcagaaattgccacactactgtgcacggtggctcaactaatttgcattcctatcagcagtgtataagcattctcttttttctgcagctttgccagcatctgttattttttgatttcttaatgatagccattctgactggtgtgagatggtatctcattgtggttttgatttgtggttctctaatgatcagagatgttgagcattttttcatatgtttgttggccagtgggtgtcttcttttaaaagcatctattcatgtcctttgcctactttttaatagagttatttgttttttgcttgttaatttgtttaaattccttatacattctggatgttagacccttgtcagatgcatagtttacaaatattttttctgtttctgtaggttgtctgcttactctgttgatagtttcttttgccatgcaaaagctctttattttaattaggtcccatttgtcaacttttgtttttgttgcaattgcttttggcatctttgtcatgaaacctttgtcagggcctatgtccaaatggtatttcctaggttatcttctgggatttttatagttttaggatttaagtcttaatccataatccatatttaagtctttaatcttgagctgatttttgtatatgctataaggaaggagttcagtttcaatcttctgcatgtggctagccagttatcccagcataatttgttgaataaggagtcctttccccattgcttgtttttaacttaacaaaaacagatggctgtagataggcagctttatttctaggttttctattctgttccattggtctatgtttctattttggttccagtaccatgctgttttggttactgtatctttgtagtatacttttacatcaagtaatgtgatggctccagctttgttctttttgcttaagattgcctctatttgggccccttttttggtttcatataaattataaaatagtttttttctgattctgtgaagaatatcattggtagtttgataggaatagcattgagttggtagcttgctttgggaagtgtggttgttttaacaacgttgcttcttcctatccatgagcatggaatgtttttccatttgtttgtgttgtctctgatttctttgaggagtattttgtaattctcactgtagagacctttcatctctctggttagctgtattcctaggtattttattctttttgtggctcttatgaatgggattgcattttttatttgaatctttgcttgcatgttgttggtatatagaaatgctactgatttttgtactttaaaactttgctgaagttgattatcagatctaggaggttttgggcagagactatggggttttctaggtatagagtcatatattttgcaaacaggaacagcttgatttcttctcttcctatttggatgcacttttgtttctttctcttgcctgattgctctgactaggagtttcagtactatgttgaataggggaggtattcctccaggggaatgcttccagcttttgcctatttgatatgatgttggctatgggtttgtcttagatggttctgattattttgaggtatgttccttcaatgcccagtttgttgaggattcttaagatgaaggaatgttgaatttatcaaaagccttttttagcatctattgagataaccatgtggtttttgtttttagttttgcttatgtaatgaatcatatatattgatttgtggatgatgaaccaaccttgcatcctaagggcaaagcctacttgatcatggtgaattagctttttgatatgctactggattcagtttgctagtattttattgagaatttttgtacctatgttcatcaaggacattgatctgatgttttctttttcagttgtgtctctgctaggttttggtatcaggataatgctggcctaatagaatgagttagtgaggagtctttcctccaacttttcggagtaatttcaatatgaatggtacaagctcttctttatacacttggtagaattgtctgtgaatttgtctgatcctgggctttttctggttggtaggctttatattactgattcaatttcagaagacatcattggtccattcagggattcagtttcttcttggttccatcttgggaggttgtatgtttttaaaaatttatccatttcttctaggttttctactttgtgtgcatagaggtgtttgtagtcatctctgagagttttttctatttctgtgtggtaggtggtaatgtcccctttgtcatttctggttttgtttgtttgaatcttctttttttattagactagctagtgtcctataaatcttatttattctgtcaaagaaccaactcctggattcttttctatgtttttttgtatcttggtttccttcagttcaattctgattttggttatttcttgtcatctactagctttggagtttgtttgttctttctctagctcctctgagtgtgatattaagttgttaatttgagatctttctaactttttgatgtgggcatttaacactataacatttcttcttaacattacttcagctatgtcccagagattctggtatattgtatctttgttcccattagtttcaaagagtttcttaatttctgcctcaattttattttattgtttacccagaagtcattcaggagcacattgtttaatttccatgttgttgtgtgattttgagcaattttattagtattgatttctatttttattgtgttgtggtccaagagtgtgtttggtatgattttaattttctgaatttgctgagcattgttttatggttaattttgtgattgattttagaatatgtgccatgtgaagattagaagaatgcatattctgttcttttggggtggagagttctgtagatgtctcttaggtccattggtcaagtgtcaagttcaggtcctgaatatctttgttagttttttgcgtcagtgatctgtctaataatgtcagtggggtgtggaagtctcctgctattattgtgtggttatctacgtctctccataagtctttaagaacttgctttatgaatctggatgaccctgtgttgagtgcatatatatttaggatattaggtattctagttgaactgatgttcgttgtttattttaatgtagtgcccttctttgtcttttttgattgttcttggtttaaagtctgttttttctaaaattcaaataacaacccctccttttttctgttttccatttgcttagtaaatttttctccatccctttactttgagcctatgggtgtcattgcatgtgagatgggtgtcttgaacacagcatgcagttgggtcatgctttttttttttttttggatggagtttcactcttgtcgcccaggctggagtgcaatggtgcaatctcagctcactgcaaactccacctcccaggttcaagtgattctcttgactcagcctcctgagtagctggattacaggcacctgccaccacgccccactaactattgtattttcagtagagatggggtttcaccatgttggccaggctggtcttgaactcctgacctcaggtgatccacctgcctcagcctcccaaagtgttgggattacaggcatgagccaccatgtccagccactgggtcatgtttctttatttgacttgccactctgtgccttttaattgggacatttagcctatttacattcagggttaatactgatatgtacagatttcatcctgacatcatgttgttagctggttattatgcagacttgattgtatggttgctttatagtgtcaatggtctatgtacttaaatgtgttttgggtggttgctattggtctgtcttttccatatttagcactcccttcaggacctcttgtaaggtgggtctagtggtaacaaattcccttagcattttcttgtctgaaaagaatcttacttcttcacttataaagcttagtttggctggatatggaatttggaatttattttccttaagaatgctgactatagccctcaatctcttctggcttgtggggtttctgatgaaaggtccactgttagcctgatgggattctctttgtatgtgacctgccccttctctctagctgcctttaactgtttttcttttattccaacctcagagaatctaatgattggtgttttggggatagttctctcgtaccgtatcttgcaaggattctctccatttcctgaatttgaatgttggtgtttctaatgaggttggggagattttcatggaggatatctttaaatatgtttttcaagttgcttgctgtctcttcctctctttcaggtctgacaatgagtcatacattgggtcactttacataatcccatatttcttggaagttttgtttatttttctttatttttgtctgactaaattagttcagagaactggtcttcgagctctgagattctttcctcagcttggttgattctgttgttaatatttgtggttgtattctgaaactcttgaggtgagtttttcagctctatcagatcagtttggttgtttcttaaaatgtctattacatcttttatctcatatatcatttcattgtattgcttagattccttggattgggttttgactttctcctggatatcaattgttttcatttctatccatagtctgaattttatttctgtaatctcagccatttcagcctggttaagaacctttgcttagaaactagtatagtcacttggaggtaagaagatagagtaagaaggctttttgagttgccagagttcttgcactggttctttctcatgtgtgtgagcttattttccttaaatctttgaaatttctgtcttttggatgaggtttttttattttatattctctgatgcccttgggggtttgattgtggtataaggtgagttcagtcaactgggttgatttctggaagattttaaggggccaaggctcagctcagcattcctggtctgagtgctttaactctggggggctggtaccaggtccccacacttgttctctggcaccttgaggttagaaaccagctgcactagaaaggccaacgtgtttccagtccactggctacaacattcctgtgggaggtactgaccaaagcacttcactggggcagtggcagtgggatccatgctcacttacacatgctaggagccatggcattgcagagaggtgcacatgcgtcgcctggggcaggatactggcagaaacgagtttgcagcattcttttttttctttttatttttttttttttgagacggagtttcactcttgttgcccaggctggagtgcaatagcgcgatcttggctcactgcaaacttcacttcctgggttcaagacattctcctgcctcagcttcctgagtagctggaattacaggcatccaccacaatgcctggctattttttgtatttttagtagagacggggtttcaccatgttggccaggctggtcttgaactcctgacctcaggtgatccacccacctcggcctcccagagtgctgggattacaggtgtaagccacaatgcctggccaagtttgcagcattcttgcatgcccttgcaccacttgtggaacacaggtggggatggggttgctattgtctgtgtttgcactcacaccaatggcaatggcagcggagggttgagcaggattgctggtgtccatgtgtgcattcccactggcagaaatgactaggatatctctttactttaaagccactgtggaaacccaaatatgcatcctgtcctacaagtcagaacactgttgtttcaagcatcatataaacatttcctggcatcttcccagtacctgcaggtcacagagccacaatgactgctgcagagtcacctagggtttcctaggaaatggagcaatggacatggcatcccagctccttgcacaagaatcaatattctttatcaaggtccgatgttcccttctattcctagtttaatgaagcctttttaaaaatatcatgaatgcctgttgaattttgtcaaatgctttttctgtctctactaattaaccgtgtgacttttatttaatgaattagaataatttacttttgaatgttgaatcatttgtgaatattttgaatgttgaatcatttgtgaatatttgggataaattctactcagttgtgtataattttgtaatacatcattggactctatttgctaatatttgtttaggatttttacatctatgtttataagaaatagtggtgtgtagttttcctcttttttttttctgggtttgatattaggataattcctgcctcatggaataagttaggaggtattccctctgcttctgtcttctgaaagagattgtagacaactggtataatttcttccttaagtgttttgtagaattcactagcaaacccatgtggacctggtgctttctgttttggaaggttattaattattgattcataacctttcttaatagataaattaacaatttcttaatagatacaggcctattcacattatctatttcttcttgtgtgaattttggcagagtatgtttttcaagtccatttcatctaagttgtccattacatctaagttgattttcaatccctttcatctaagttgtcaaatttgtgggcatagagtttttcatagtattcttttgttatcctttaaagtctgtgagatctgtagtaatgttcctctttcatgtatgatattagtaatttgttcttttttttctcttggttagcctggcaaaaggcttatcacttttgttgagctcttcaaagaaccagtttttggtttcactgattttctctattaactttctatttttaatttcattgatttctactctaatttttagtgtctcttttttccaggttatttcagatttaatttactctttattctctagttttctaaagtagaagcttaggtagctgattttagatctttctttttttctaaaatatgcattaaaggctagaaagttccctaaaagcagttttgtcactgcttttatggcatcataaaaaaattgatgttttagtttaatttttatttactttaaaatacttttaaatatttattgagatttattcattgacgtagacttaacactgagttaggctggtgctagagtctgtgctcttaactgctattctatggcatttttaggcaagtcaggtccagtccacctgtaaccctacacatttcacatacatacaaacacactaataaatatgagaagtagaatctgaactgcagaaacgttgtgtattttatttttattatctgtatttttgccttatttcctcacttgaattcaacttctttcaccttgacacactggagagccagagatagaaagacccctcacatatgccagccattgagatcattaggatgatgaacaggacacaatttttatggagagttgtgtggtcaggaggagagttgcaagaaccaagaattatgtgctaggaaatgtgtgttaaagtagagatgtatacagagtgctgtagaaacatggagaaagattacttaactctgatctgggcaagggagagggggcaggaatatcagacaaattttacagagggtgttttgaaggaggaataggagtttgacatgtgagaaagtaggatacggatgtcagtaccctatgcaaaggcactaagacctgggcgaggttagcattctgagtcagtgaagagggtgcatttgaagcatgacgccagagagaagaacagggtggaaggtccagatttcatgcagagtcagcaaataggagtaccttaggtcttgacgtcataaacccaaggatcagacaattttccagtgtcaacaaaagccaccataactgatggaagttaacaagacagggtgcagagaggtatgtaaaggaactgagaagacaagacattggtacaagccagtctccagtttcctctattttcccttggcccaaagcactgtcactagaagatttcatgtgataataataaattttctgtgaaatagtagaagcattatggaggagagcagattctgtgcgaggtatccacctaagacatgcatagccacagcactttgttccctgaaactagagtgaataaataggatgcctccagaaaacaaaaatcatcttcaacaagatgccttttacctatttcttgtcccttttatataatttctggcatatgtgtctatatatagaaatttcctttaattaactaattgcacaaacacacatttgccaatgttttctttaataaacctatccttttctgtgattcaatgaaatacattcaattctgctaatttttcataatgctttccattatgatagcaaaataactcagttctgggaaaatataccaataactatcttgaattgtaacaacagtaaaaatgagaacattttacctgaacaacttgagttttgtgtttgtttgtttgtttgtttgttttcaggtagagtctctctgttgcccaagctggagtgcagtggtgcgatctcggttcactgcaacctccacctcccaggttcaggtgatgctcctgcctcagcctcccaagtagctgcgattacaggtgcatgccaccacaactggctagtttttgtatatttagtagagacagggtttcaccatattggccaagctgtccttgaactcttgacctcaagcaatctgcttgcctcggcctcccaaagtgctgagattacaggtgagagccactgcacctgaccaggagttttttaattgaaatatttgtgcacaaaagcccatgatgtcaccactagtggttaatttatttgtttgtctgactcataatgaatatgagagaattgttttagtaaagataaattgcttttaataaggactaaaatccctttagtttaacacaagccactttattagcagtgtttctgggaaataaaagcaagagttggttcttccagaagtttaatgccagatttcaccaccttcatgagaaatcagaagggtattgttaacatgctgtttcatttgaaacagttttaacttttggtggtcagctcaataaatggaattgattgcttttaacccgggacaatgacatactgtaccaggatatgccgctgtgtaactttcaattctactttttgtattggcaggacttggcaaagaattgcagtgcatgtttccatttcctatctttgactatatatttgttttgtcacttaatagagctacagagataacttgaggaacaaactgactacccaggtctccaggtcaattttctgttattttgcatgaaatgagaaagtcattttgaccctcagaagacaaatcagtgcagattatagatcttctcttgatccccaaaggaataccccaaattcacacatttaatgtaacatatctttattgaacacctaccatgtgctgtacactatactaaactccttagggatatatatacatatatctgagatacggcatcatggtagagagaaaggggcttgggccctagcatatctagccctcacagcttcttactaaataaaacttagcttatctgagcctcagatttctgttcaatggaaattataatacctacatgtacagctattgtggacactaaataacatgaatagcattgccacattgcagatgctcagtacctgttggtttctcattctctctacatcacaagtttagagtcacattggaatgacccacatccacactccaacaagaattcaaaggactctagagcaagtgccacacatatggcataattaactgtggtggttttaggaatcgttggcttgtgggtcactagtatgaagatagttgctgtttcttggagttgaggttgccaggcaaggcttcatgaagttggcaacacttgaattgggccttaagtgtttctggattccagatgtgtacagagaacatgagatgaaaatcctggttggataaaaagtgtgagcagcatcttgggagtaggactacacatgtcactttacaagagctgagagtagactaatttgagtagaggagataatttaggtgggtaaatgggagcagatataattttaagacacatgaagttgagtggacattaaaaatatgtttagtttgtggacattaaaatataatatagttggccctgttgtgtctgcaggttctgcatgtgtggattcaactaactgcagatggaaaatacagtatttgagggatatgggctctgcacatactgagggctgactttaagtagccattggctccacaagacctactgtgggacttcagcctctgtggattttggtatctgcaggaggtcctggaaccactctcccattgatattgagggacaattgtattgtaataaaagtcacaaaagatttttgagttgaggctagtatttttaagaaatctagtccagttttacaatgcagagtgaataaaaaaagtaaataaccagagttttaataatccagaccagcatgaattaggttgatggcaggagcaatgggagaaagaggtgtaggacttaaataaagaattgattggctttggttattgattgtatatggaagtgagaaagaaagaagaaactagtatgaatccaactattcaaggcttgttaactgggaaaatgaggaaggttgaaataatttttgaagataaagtgtgtgcttttagatgtgttcaatttaaagtaattacagggcatccaagtggaaagctctaaacactagttggcatgtgaggggagaaacttaagacacgtcaggaaatcaagatgtgagttatacatcctcatggtgttactaagcacctaaaagaagatgagttttctaaggcagtatttctcaactgtatcttgtattattaaacacccttattcaacaataagtacttactgagacactgatgcgtgtgccacatgccaagctcccatctgtgtaccagggatatggtgggaaacaccaacaaagtccctcccatcatggagcagtcagcacatgatagttgatgtgcatgaaaatgttcaggtccatttgttagctcttacaccgtgtctctcaagagagcctgtctacatggatgtgaagaacagtggcattgctatgaatatagttctaaatgtattctaattcattaagaaagtaaatcattcacaaatattgagaacattgtaaataatttgcctcgacaaccattgtatgtcaacaccttagatgagaagctctgctttaaggagaggttaggaagagagcaaaggggctcaaaactgaaccttggggaatagacatatgtaatggactggaaaagtagccagtaaataaatcaatggatggatggatggatggatggatggatgatgaatggatgatggatggatgggtggatgaatggcggatggatggatgaacaaacaaaacacaggtagacagacaggtaaatatatagattaaaagagagctaaaaattaaaacaaactcatggagatagacagtagaacgatggttaccagaggctggaaaggggaatagagggatgggagagaagttagaatgggtacaaaatatagaaagagtgaataaaatctagtagtatttgatagcacagcagggtgactatagtcaataataactgtacattttaaagtaactgaaacagtataattggactgcttgtaacacaaataataaatgtttgaggtgatagatacctcatttattctgatatgattattacgcattgcatgcctgtatcaaaatattacatataccccgtaaataaatacacctactatgtaaaaaagaaagtgagacagaagtaaagattagagaatttagaggactagaaagagtcaattgaggcagtgtcacagaagctgaggaaaggaaaaattaaggaagaggacacgtttcacagaatttaatgatatagataggtctacagagtgagagttgataagtaagaaggaagcacactgataaaactttgaaagagcagttcagcaaaatagagaagagtgaaggtaatattgatggggttatggaaaataacactcatagggaaaagaaagcacaaaatgattcaaagtctttattggcttatttataagcaaatgacaggttgaatatcagaaacagaaatgaagacattgatgaagatggataaggtgtagttgggagcatacagaatcccagaagttgaggcacatccagcagaaccacctcataataggtttgtcacaggaagtggatcttggggtcaagcagagtaggtcagttcctagtactgaagtttgaaacagatgttctgtcggggaggagagctatcaaccccagtattacatgggagagacttgagaagtttaaaaatccaaccaaagttgtttatggagttgttttttacaatcattttaatagctgggtgaagggtaaattgtatgtagctaaaattttaggcagagacactggtaagatgcaaatctaatgcaaatctaggccaaaatgataatttcgagctaggataatagctatatggatggagaggaatgataagattcttgggcttgatggggccttgtgacagtgaggaatgagagattaggtgaagggaagtctctgtcaataaatatttattgggtacttaagctacagattagtcacacagaaggagtggatttgtctgtgttgattggaagcaagatgaattacgttttgatgatgttgagtcagaagtgctttcaaaacaaacactaagttaaagatgccctttcacaattgtaaataatttggagctcacatgagagataggggttcaaatctggatttggaagtcattggtttataaattcagtttctacccagagagaacacattctgtgagaagagagccagactcaggccacatttaaagggtaaggaggcatagaagagacacatgaagatgcaaaaaatgagccagcagaaaatagtcgtctcttagaggccaagagacaggaagtgtagagcaaaagatacagaagtattagataagttaggagcacacattacccttgaagttaatcttagtaaggacattttcatcccagtagtgagaatggaagctaggctacaaagagatgaagaacaaatggaagtgaatattaaaaatgtttgtatagactcctttatgaaagaaaatcagaagtctgctaagcaacaaatatagaatgaaaacagtagaaagattacatgacagagatgatagaagggtaaggaatgacataagggaaatgcaaaaacattttggaggaagttaaatacaggcttggaaatgctaagtcatccactgttctaacctgctgccttcaaggactgatgtaaagttggcataataatggcattacatttcaagaacttaggatattgtctgacacatgggaaacattcagtttctctattagtcaagatatgcaaaccactgtaaacaaattcctaattttagtagctgatcatgacaaggtttatgtctacttcaggtcacattccaatgtagattgacatgggagctctgctgcacacaatcctttggggtctcaggcgctatgaccagctgtcagacaaggaaagaaagaaaatgtggaagaatatgtgggagggttctttgagacttggaatgctatctgtgatttctgtctttgtttcattggccaaaagtcagtcacatgcctccttctaacagcagggcaggctagaaaatgcagtctaactgtgagccctggaggaaaagaaacaagttttggtaaaaacaatggcagtctttgtaacagcctagtacgatttactgttattactatctatagcagggtcttagtcaaattaattccctgcagaatgaagatgagagagaagacagatacaccttgatggacgctggggatgggaaagttagactcataaacaaatggaagcctaggaagtgaggaagaaacactgccatcctgagaagaaccacaagcactgggaagagatagggcaacattaaaatcctaaagctatacttcttgtccagacttgccctgcatttctgacctgtacagtcaactgccactctatttgccatttggggttctatagataggtcaagcttagcatacctaaaacaactcatttcactccccaacaaaatttactttacatggagcctttttttttttaatgcaatgcatggtgacacctttcttccaggtagtcaaatcacaactcttactgtcactcttgagtcctctctgaccctcatatccagtaaccagttaatcagggaatcccgttagctcaaccttcaaattgtattcataatgtgatcactcggcaccatctccactgctcgcgtgctatcctctacaacacctgtgccatctctttcctcccagtctcctttcaacccagtagtgagagtggtccttcaaaacacaatggaaatgatgtctcatctctgctcagagctctccaatggatcacacctcactcaaaataaatgtggaagaactccttgcaatggtctacaaaactctcagttatcatatcttttttttttttttttttgaggtggagtctcgctctgtcaccaggctggagtgcagtggcgcaatctcggctcactgcagcctccacctctcaggttcaagtgatttccttgcctcagcctcccaagtagctgggactacaggcacacaccaccacacccggctaatttttttttttttttgtattttagtagaaacggggtttcaccatgttgaccaggatggtgtcaatcttctgacctcgtgatctgcccacctcagcctcccaaagtgctgggattacaggcatgagccactgcgcctggcccagttatcatatattacactgcttccgactgatattgcctcacctcacacgctggcctccttgtcattcctcacacatgtcagccatattcctgctctggggcctttgttctggctgtttttacagtatggaaccctctgtcctctgatatgcacgtggctactccctcacctccttcacatctttgttcagatgacacattttaagtggaatctttggatactttcccctgggcaccatatataagaaagcaacatctcccactccaatagctccttaatcccttagtctgctttacttcttcatttctcatagcatgttgcaccctcacacacaagatatcattttcctaattattatgtctaatgtttagtctgactcactcctccccactaaaatgttaaactccagaagatcaggggtctttgcatctagtagaggttcagtaaatactttgaacatagtagaggttcaataaatactagttaaatgaatgaatgagttaataataaacaaatacgttgattgattgattgactggttgattgattttgccttgagccctcatacttcttacattgcttggcaagtagcaatgttctacattttgtgaatgattgttatagtaatggtctgggccccacaatacagacggcagctgaataatttgacactttggtaaggaataaatttctcctttcattaatgactgatttattctattttctttatagtataaatattatctgtgtttcaaattgtgtctgaaaacttacaggccagcaaatggttgggagtggggagcatgcatcacttacagctacagtgattttctgtctctgactcatcttaaaaagccttaattgagtatttattcttatgctgtgagatccaagaaatcttaactgccattaagctgtctacagaagcaaaacaaaatggagaattaaggcaattatcagcatgatatgaaccatagaaaacatgtttccctcaatctggatgtttcgagagaacttatttttgatctaaattatctgagtaatttccccttcagttttcattttattttgcactgatagacaataatttagtatagaaagggacagcccataacatagggaatcagcgtgcgaagaaattcattatccagcatgtgtatgtctgtatcttctatttttactaaactttgttgccagaggagacatttaaaaaaactgctttctaaggaattgttgaaaattaactgatttactgaagttgtgctttgatacctgcctgccttttgacctcaactaaaataactcttcagtttgaatttcttttagctccccttttgggctgtaactttagatccagctttcaaaagccaacaggtaaataaacaggatattaatcatcatacattcatttcaatgagaatgcagccacaatcagcataagcgtgggctatttctgaattacatgaaagccagctccctagggtatgtccaatataactgtgataatgaggaatttgcaggtggacctgctgttcttgtgtaccttattaagtgccttgtcaggtcaattgtatttgtctgatatcttcaatctctttcccctgagatattttccagtaagactatttattaactttaacatttcatattcaaagtagccctcaccccggcctcaaccaccaccaagttctatcacatgaagtaatgacaaagaagaacctgggtaagttgctgcaaggctgggctggctgagttattaggcctctgtagctaaccaggcctgcatcttcctgatatatgaacatttcagcgggcaaagaatagaatccccacgaggatctcagataacatcagccttacccatgtgtaccccaattactcacctcaaatgctatccctcatctatcacttggctatagattcatcagaagaattgaaaatcaaacagaaatattgtacaactttttcaggaagtgatacaagtagacatggaggttacagctagtttgacgcagcctaggaaaaaagggtactggaatgcaaaaatattccccatgtctatgtctctagcagtcaagacctcaatttttcatttttgcttttaaaatcccacttgacttcatcctaacctacctaccatcctaacccatattctctgtcactcctctccattgtgacctttctgcccaaattgactaatctgttttttgatccctgaaaaatctctgggctttcctccctccaggcctctacacatatcttttcctttgcctggagtgcccctcgctgcacttgtgtttgagccaatctaatccacacttcacagtctagctcagaaaccttctcaataaagttctctcgtttagcacagagtaattgcttccatctctgaatccactcagcacaactcactcttctttctctttctcattctttctagatttttaattcttttgattatagaatatcaacttatacaaaaaaataggcataagcttaaatttatagtttgctaggtggttcaaaaaggaatgcctgtgtaactaccccaggagaaaaactagactgttgccagcacacaagaagcaccccagcgtcctggccaattgacaacccccttcttttccaccagagctaacctctgcccttcatagttcatagttttcctatatgtgtgcatccctgaacaatacagtttagttgtatctctttttttcttttaaaaacaattatgtttattcaaaaaaggctagatgaaattaaatcaggctattttaattgattcataatgcaattttaaagattaaaaccaaatattgaaagactaaaatagccaagaaatgctgaattgattagtaaataatatgattagttcaaaatgctcttatattaataacataaaatcattttttctgctgacattgattatagctaagttgacattgtgagagttaaatgcagtttattgaaacctgaaatagttaagttgcctagtctagtaatggagttaaggtcactttatttgaaggtactaagcttactgcataagtaaagctggcagagttatacttgctgtacttgcagttaccaaatttaaatgccttccctggtgaaagagtgttggttaaatgagccctgtcaaatttttgattctggctgcctccattgaagttgaccaagcttgtgggtggtgatgccccaggcttccttgtagctgaagaaaactgaagaaatgaggatactacattataagtagaagagaatacagttgcaaagagacagaaaccaagtatacacacacacacacacacacacacacacacacacacacacacactacacacaaggtgtttttaggtgccgtttcagaagcattgtgtctgtgtatgtgtgaatccttggtttgtgtctctttgcaactttttttaaaattttttatttatttttattatactttaagttctagggtacatgtgcacagcgtgcaggtttcttacatatgtataaatgtgagttgtatctctttttgaagtgtacatttttttatgttctacaaaaaaagataaaaactaaatactaaccactctaaagcacatcaatacattatgtatttggggactttccccagtcaatattacttataacgtttaagtttatggtggtagctacagtccatttatttttattgttgtataattttccactgtgtacatatactacagtttattcattgtatggttgggagatagttagattgctttaatgtttagcaaatataaatattcttgctgtgaatattctttgacatacatttctttccacatcatcacacatttatatcggacacatacacagaactggaattgttaggtcataggtaagcattacctacttttatcagacttctacattttggcaacctggtggtcctgtatcttactgcatttatctaattactctgaagccaagcatttttctggatgactttaggcatctggatttcattcgactgaagtgctttttcaagcacttttctttaggatggtcaaccttcttttctcattgtgagaaaaattgtgaggcaagaattctctctatagcctggatactatttcagtcaatttcgtgtttgtaaaagtcttcagtgattcctatggcttgtcttttccatttcttctggatgtttttgaagaaaagctcttcgttttgaatttattaatcttttttatgtttaacacttaaaagtattttcctatataaggaaatggcaatattcccctatattgtcgtctaattattttaggtatttaatccacttagtatccacatcatagtacagtacaggtagtggtatattttattttgtacatagctattccgttttttccagcataatatattgaaaagactgacctttccccatcagcttctgtgctctttctgctgtatattaaagacctatatatgtgttagtttctgtccacttgtatgtttgtctacatctgtgtaatttctggtgtgctgattatttaaaatatatcttaatatttggcagagcaagtcttaccttttagtttttgtttttttgaaagccttttgactattcttggcctatgttattgccacataagtcttagaattagtttgtctgcttcacaaacaatcttgcctgggttttgattaggattgccttaactgtatataaatttgatgagaattttataaaaatattgggctttataattcacgaacaatgtatataattcatttaagttatttttagtgtctctcaatagagctttataattttttttgtaaaaaccttgcatatcttttgtgagaattatttccaggtgatagattatttttgatactactgtaaataatgtattttaatctaattttctaaatatctgttatttttatgtattgattttgtacaagttttgtatgcatagccttggtaaactttcttatcaatttgataagtttttctgtacattattttggaagttatatgaatataatcatactatctttgaaaaatgacaatttgattctccagttccaattctattaccatttagttttacttgccttattgcacttatttccagtgaaacagtaaagactgagtttggcatggttgtttggtttccagtaaaaaaaaaaaaaaaaaaaagaaacggtgaaactttcatcattttataattttcaaaattagggatgatatttgctctgtaagcttagtagaaaacatttatttcaggctaggttccttctcttcatagtctgctgagggtttctgacatcgtttgctgaattgtattaaatacattttctggatctattgaggttgtgtttttttctcctaatgtgctaatgaacttgtgaagagctgagccagactgagagctgagctgccaggggttcgagtggccatgaagaaaataagccaaaatgaaagtaacagtcaagattttcgtcaatagtgcaatactataagcaagatgctcaactggggaaagcactgacttccctagtgttccattgttcatttggaatggcaccatccatggtcagatagatcagcatagacatgatgaatctccttattgctaagaaagttctaaacaaaaagctccttctgttttatggaccataaacaggagaatgggaaggttagtaatggaaggtattgagtactgagtcagagtgaaaaaagagtatcctcaaagttcctccctctaccataataaggaggtctcagcacctgagaaaaatgtcttctgaagacccccaaataggaggcctctgaatgtaggtaccaggactaagaatgcagacatgagtaagaacatggccagctgatggcacctgagtccctgactgcaatactcttcaaagactgcagtgcattggctgtgcaccaaagtaggtgtggggaaggtggttttccctgctgaggcctctcaggtaaacgtttggtaatcacctatggtcaggcttgaaggatcacacataggttttcaggcagtatcgagagtccttagtgatgaatgaagatgactgtgtttaatgccaaactaaatttgaattcctggatgaacccagtagtaacatgatacaattgatgtttttaaatagtattgttatgtttattttaatgtgtcagtaatattttgtttagggctcttgtattattgcttgttgatggaaaatcaatggacttttgtatattaaatttgtatcccgcatctttgctacaattgcttattatttccagaatttttttttgtcaattctcagattttccacggagatgatcatagcatgtatgagcaaagacagctttatttcttcctttccaatttgtatacccttatttccttttcttgtcttattacattaactagtacttctagtacagtgttgaaaaagagtggtgagaggggccatctttgccttcttgacattagcagaaaagctttgagtagataatacaattttgtttcttttttctagttttctttttaaattctgctatcctgttttatagggttttgtcctctgcagatatttttaagtttttcatttattcttataaacagggtaagcatagctcttttaaaatgtgttctacaaatcccagtgtctgaagtgtgtgcagatctctttctgctgtctgccatgctagttctggccatgttatttcctttcttaatgcatctgcttatatatgactgcttcttggccattgcccttaaaaataacttgggaagattccttgaggtctaaaatatacctcctacaaagaatggggcactgtcagtctgggactacttcagtcaaatttggtgacttaaattccatcaccagtccaggctctgagttcaaatacatgaaagagccaatcaatgtccacaatcgctcaagaaattttcctctttccttccttccttccttcctcccttccttctttcctttctttctttctttctctttatttttttttctgtcctgcccactcatcaccacagaaaacttctctattatcccctcggatttggggcttgtggtggaatataggttataattagttcagccttctttcaaaatgtagcgttctgaagcttcaaaaggaagtgtttcttataagactcccaccttgggtaggccatggacattgacttctgttcctctcaccacctatagctctgaattgaaacccatgtgtgcagtattgaccagtgacttcaggacataagtatctttgttaccttaatattccacttgtgtctagttacaggcttccactcaagtgtattccaacattgttcatattttattaagaagtctgatctgaataaatttgcccaccattattctaaatcaagacccaggagaaattttctctaatgatattttgacaaacacgtatatactgtgtggggaggtggagggctatagtaagaagagcaggctttaatcttcgttccaccatttgccagccatgtaactttggacaagtcagtgaagacattcaaaccttggtttactcatctataatataaggaatatagaattagtgacaataaatacaaagcatagctttgtatacaaattatgtatacaaatacatagctcttaccattattattttcatgtctccatgacatttttatatgttcttgacttgaactttaattaacttttggattaataatttgtctgttttaacatcttgctttcttaaggacaatggaatatcttaaattgttttttataatcctctgtattagctagcatagagtaagtacttattaattttttcagtttgttcaatacatccagacacttgctggtctgttatgaaagagtatgaaactttttgagtgattatgtgcaaggattctcaatcacttgccatcacaatagccattttcactttctttatagcacttgtcactatttgaaattatatttctctattatatatttacttgtttgttccaaatagaatattaattttcctccctaaaatttcggatctatcacaaagtgggtgtttaatggatatgtattgaattaaaaaaagaataaattttacaggaatcaaggagtgggagctttttgtgacattgacttttcattggtatttgtcatctttctcagctcctatacttctggaaaatatttattcttaatttggctaattgttttatttattgagaatataaactttccctgaaggctaaagtttggcccaaagagtgaggaaaatcagctgttacctgtgacatgggttaaaaatcttcttacaaaatgagaagtgattacacatgtagggctttttcattacattaaaacaataacagtcctgggaatactgactatcgaaaggcagaagaaggagactagacacctatctctcgctacatacaaaaatcagctcaaatgattaaaggcttaaataagaggctcaaaactatgaaactaccagaagaagacacacaggaaatgctttaagacattggcctgggcaaggacttttaaaataagacctcaaaagcacaggcaacagaaacaaaagtagacaaataagactacattaaactaaaaacctttttcacagcaaaggaaaaacagagtaaagagacaacctacagaatgggaaataagatttgtaaactatacatctgacaaggagctgataccaagaatatgtaaggaacttaaacaattcaagagcaaaacaacaaatagtccaattaaaagtgggcaaaagacgttaatagacattccttaaaagaaggcattcaaatagccaataggtacatgaaaaagtgctcagcatctctaatcatcaggaaaacacaaatctaaaccaccatcagataccacctcactccagtgagaatggctataattaaaaatactttttaaaacccacaagtgttggctaaaatgtagagaaaagggaacacttacacactgttggtgggcttgtcctcgagaaaacgtagttttcataattttaatttgacaaaatttttaaaatcctggaaatagtaaatatgttacccttcaataaacaacaactgattaatagcttgggtaagagttcagtacatacttctagctacacaggaggttcctcaaaaaaaaaaatatagaaatacaatataatccagcaatcccattacttgtatactgtatattcaaaggaaatgaaatcagtatgttgaagaaatatctacattcccatgtttattgcagccctgttcacaacagccaagatatagaatcaacccaaatatctaaaaatggatgaatggataaagaaaatgtggtatatctattaatcaacaatgaaaaactatttggctattagaaaaaatgaaatcctgtcatttgggacaacatggatggatctggaggacagaacaaatacctcatctgtggaatctaaaaaaaacaaaaaacgacaacaacagaaaatattttaagaggtgtttttttgtttgtttgttttttgtttgtttgttttatcacagaagcagagagtagaacagtggttaccagagatgggaggagttggggagaagagaatgggagagattggtcaatgcatacaaaattgcaattaaaatagatgaataagatctgggattctattgcacagataaacaataagatatgatatattacaaaatagcaagaagataagcttttgaatgtcctcaacaaaaagcaatgatgaatacgtgaggtgatggtcacactgaatgtctggatttgatcatttataccacatgtatatgtatcaaagtgttaaaatttaccccaaagttatgtataattatgatgtatcaatttgaaaacaaaataaaaaattaaaacaataacatgattcaggtactaatgtttacccacagtaaaagtaacattttattactttatcataacatgtatattgatatttgaaagagaagaaaataataacactatgtagctagaagtatgcactgaactaactctttcccaagctattaatcagttgttcattgaagggtaacatatttactatttccagggttttgaaatttttgttaaattaaatctatgaaagctatgttttcttgtggacaaagacaagagatgcttcccttttatcctcttctaagaatgccctaatattgtctctaggatttaccactttggcacgttagttatattgtttgagcataaattgctaagatgtaacagaaaactgtagctttgaaggtcctacataaggcccacaatatactatggaagcctcttcttggttcagaaattctctcctgaccagaagatccaggaatgatataatgagaaagtgtcataaaagtgggggaagagtgacacaaaaaccagctgcaacccatcctatctaggttgcagctggtttttgtgttagatgcgtatgtcagaggttttttttttcagtcagtgtacatcaaatgtgctgtgaataaaagaatgaggtacatggcttccatttctattactctccactctgtaatagaaaagctgaaattatatcaaggttccataaattcccacagttctagaactcggactgacatctttaacttggagtataattatttagttcaggctttgtcacctagttgattataaatacttaatgcgtacagagatgtttaatatttgcattagagtctttagtttgcaaagatcttcacaaatatctaatcttcagagcagctcttccctagttaatctgaactcaaagctgcttaggttataggtattttagtattttcaacccagggaaaatataccagtttccttttaggaaccctttaaactacctaactgcaacctttattattattattattattattttgcaggggagaaatagttgggaagaaaaggttagtctatagtgttattcccataatcaattagagataaatcaaaacccctgctcctgtcaagacaaatatgtttctctttagttgtgatttctcttgtgtcagtggcaggaaaagaatcatacaaaccacatacacatgaatttctgttccagtatgagcagtccaattacagaacctgcccactctttgtaccagtttctctatcaaaggtcctgactttgaaggttggtgattcgctcactatgcaagattatctttttcattgcatggtttcttctttagtgaaaaatctctgtttctgagcaaatgtcatttcttgtattaaactttatagctacccctctgtgatgtgatattccatttcgctggaatcacttgtatatttttttattatgtcctctcccaggaagctcatctaaatcacagtacctcaccaagatttgtttctctcataattgttcctacttaattactgtgtgcacattggacccttccaatgtgctgagccggtcttagagatgagaggatgaactatgaaaataagatttagcatatgaagagaataaggctgaattagaatgggagagggaatgtgtttgtatatgtgtgtatatttatatatgtatgtatatgtatagattatacacatacatatatactttgtaaatgagaaatttatactcttttgcaaagcaaatgcagttgaccatgtgtagatcttaaggcaattttttctgggacgacagcatatatggtattatattaattttttaaatatattttcaacttcttattttagattcaggaggtacacgtgcagatttgttaaatgggcacattgcatgatgctgacgtctgggatacaattgatcctgtcatccaaatagtgagcatcacacctaacaggaagctccgcttccttccccacccccagtagtccccagtgtctactgttgtcatctttatgtccatgagtacccaatatttagctctcacatgtaagtgagaacatggagtattaggttttctattcctgtgttaattcacttagtataatggcctccagctgcatccatgttgctgcaaagtacaagatttcattctttttatggctgggtaatattccatggtgtatatgtaccacattttctttatccaatccactgttgatgggcatctatgttgattccatgactttgctattgtgaatagtgctgcaatgaacatacaagtacttatgtctttgtggtagaatgatttactttcttttggatacataccaagtaataggattgctggattaaatggtaattctgtttcaagttctttgagaaatctccaacctgctttccacaatggctgaactaatttaccgttccacaagcactgtataaacatccccttttctctgcagcctcaccagcatctgttgttttttgactttttagtagcagttgttctgactggtgtgagatggtagctcatcgtgcttttgatttgcatggctcacatttttaaaggaatttgtaataaataaacacttgcaagtacctaacaacttgaatttaaaatatatgaagtaaaaatggtcagaattgtagggaaaagttgacaaatctataatcatcacaagatattttagcacatctctccgaaaatctgatagatcaagcttataaaaaaatgtaaaaagagagaagatatgaatgactcatgtaatagttacttaacatacataatgaatggtataaatcaaattactgcatctatcttagtgctacaggcataacttgtaatagatatttaaatgtaaagtattacttattgaaaagtgaaatagcaaagatgttttctctacatgactcccaactaaagtttgtttctttgtgtttttatctttccttttacatgtagccaaaaatcacggtttctttaggaaaaaaataaatcagcaaaattggttcattaacattcataaagagcttagtctaggccaagcgcggtggctcacgcccgtaatctcagcactttaggaggccaaggtgggcagatcacctgaggtcaggagttcaagaccagcctggccaacatggtgaaaccccacctctactaaaaatacaaaaattagctgggtgtggtgacccatgctactcgggaggctgaggtaggagaatcatctgagcctgggaggcagaggttgcagtgatctgagatttctgtcgcccaggtttgagccactgcactcaagcctgggcaatagagcaagactctgtctctaaaaaagaaaaaaaaaaagagcctagtctaacttggttagaaagaatctattcaatcttttttttttttttttttaagtgccatctaaacagaacccatctcagtggcatgttgttgccctggccattatgtataccctaaagaattatatttcaaatgttaatctatgttagaatcacctggagggattcttcaaacaagattgttgggcccaagatggggcccaggagtttgctgggtttttttttttgcaatggaatctagctctgcctcccaggctggagtccagtggtgtaatcttggctcactgcaacctctgcctcccaggtttaagcgattctcctaccttagcctcctgggtagttgggattacaggtgtgtaccaccacagccagctaatttttgtatttttcatagagatgaggtttcgccatgttggccgggctggtcttgaactcctaacctcaggtgatccacctgcatcggcctcccaaagtgctgaaattacaggcatgagccaccgcacacagccaggaatttgcatttctaagaagttaccaggagacagtgatgtttctgggttgggagccatgctttgggaattgttctagagcacatgagcataaggctgctaagtcatcagaattccccatggtgcatttcagatgtgggttgccatgagtcctgagtgtgtagaacaaagcagtgctttaaactagaacaacctcaaatgtaagaagaagtttaaatatgtaatccaacattggagagaacagtcataatgtgaactgtaaagagaagcttgttgggtagcttccaaaaatgagtagattttacatttcagattatgttacatttccttcatcactaaagcccatatgcacgtgcactggaatatactctaccctctgattcctctacaaagggctcaaaaacctcccaggcaaagctagttctttctccatgcttgtctcattcatgaataacatcaaacaatattgtacaatgacttttgccatatgtttctctattaaactggaagacccttgaagggagagagatttgattttgattatcatgtacccaacattgtgcctgaaaacatgtgcactcaataaatgctgtggcatgaaagcccttcaagagcaaaggtattaaattgtccatcatcagtcaacatgtcttcctggcactgggtggagtgcctcatactgaattaatatttattggattaaactgaaaggaaacagcaggaaacaaactctaacctcttcctgtattaggtaccaggaaaaaataaatccccaaagcaggtatgatcttgtttcctgttgagccactccaaatgggcagataaaaccatctgctcttggtccaatgtagaatagatggtacctcaggttgcagggagccatcctggttatgccacctctgtccccttgccacattgtccacacaccatccctgctcttggtccatgcattttgtgttgctgttccttggtaacctctgccactgcctatgacagcccgccactggtactatgttatgcaaattgccagcctcaatacaaaccctgtctatgaagaggcacttggttggcagagtgaaaacacagagtaacgagatgccatctgcatttcctactacatagctcaattagttgattgatttgtaacactttaaaaaacattttctaggcaaagcacattaggagagtgttttataatgtattcagtttaattaaaactgcactaagtggagtactttgcttcttggtttgagaaaaaaaaaaatttacaaggaggtcacatatcatattgatttttaaccccctaagcaggagtaaaataacattgttaaaggttgcagcatctagagccacacaagtgtacctctttaaaaggtttgctgtaattagaatagagaagattggttagtaagagaaaacatgaggatgccgtcataaaatgggggtgggtaggtaaaggagggaagctggtaacatgctctgaatttgaataaccaacaacacctgctcctttttgcacacaaaaatgcttttatcatctgaagggggaaggaaaaacctgcaaccattccagatgaattcaaggcttaaaaacaagttagaaatgtttaatgtctatgcaagtctttactattaaggtgagtgcattaaaaaccttttggtaggacagttttccaagtttggataattttagatgttaatctggctcctccctttcacatctcagatcgttgttaccaggctgctttctcctcattcccactgcctgtcacattaccaaatgcaagcaggcttccgaattgttagtcagctgattaaaccctcaaattattggagacatttgcatgggtaattatgatttatttaaaagcactttgtttgcattgctcttgtctcagtttcttcaaagccaattactgaaaaattgattggattggtttgatttttgaaatcatttggaacttcagaacacatccctttgcataatttttttgaaagtaaaaccaaaacaaaacaaaatggaaggagttctctttgaaaatctgtatgcttcatgtctttggaacttctgtagtatgcaaataagtggttaaaattagtagtagaaacagtaatagttatttttcaatagaaggagagatcagagtaaatcagttaaattcactgtttcagctccatctcattttgcaaagttacctgtacttagtagggcaatttttttttttctaattctgttggacttctaagaactagaaggattattagccaggatgctggcaataatactgccctatatcaaaggagattatttttctgatgaatatgttgatacttcattatttaaatcctcttttggaagaatccaaaactgaccaatctaatactgaattctaccatctactgtagaaaatacctccatgagtgtcttagtttaagctactataataaaatacaatagactgggtgatctaaacaacagacatttatttctcatacttctagaggctgggaagtccaagagcagattcggttcctggtgaggaccctctttctcattttcttctcactgtgtcttcaaatagataagagatagagaagagagagagagaaagaactcttacctctcttcctcttcttataaggacacaaatcccatcatgggggccccatgctcaagacttcatctaactttaactaccttgcaaatatcccacatccaaataccatcacattggagttagaacttcaacataagaattttgggaggacacaatcatttagcctatgataatgaggttctgactttgtatctactccttcccaaaccatgcccacaaaaagtctcaaaatattgcctttggcttatccattcactttttataagcgattccaaaacagaagatacaattaccattggtttcttaggatagacagttgctttaaaaatattgtaagcaaataattgttgggtatttattacttaaaagttaataatttatgtataaattaccaacagctcatttctatatgataagggtgtctcagaaagacattttggaataatacattcctgtaattctttttttttttttttttttgaggtggagtcttgctttgttgcccaggctggagtgtagtggcgggatcttggctcactgcaacctccgccttctgggttccagccattctcctgcctcagcctcctgagtagttgggattacaggtgcccaccaccacacccagctaatttttgttttttttagtagacacggggtttcaccatgttggccaagctggacttgacctcctgaccccaagtgatccgactgcctcagcctcccaaagtgctgggattacaggcgtgagtcactgcacccagtcttttttttttttttttaagaaactgggtcttgctctgtgcctcaggctgaagtgcagtggcacaatcatagctcactgcagcctcaaactccttggctcaagcgatccttcttcctcagcctcctgagtagctgggactataggcatgctccaccacacccagctagttttttagtatttttttgtagggatggtgtctcaccatcttgcccaggatggtcttgaatgcctggccttaagtgatcctcctgtctcggcctcccaaagtgctgggattagaggcatgaggcactgttcctggcctaattcggtttattaaaggaccccaggccgggcacggtggctcatgcctataatccctgcactttgggaggccaaggcaggtgcctcacaaggtcaggagttcaagaccagcctggccaaggtggtaaaacctcgtctctactaaaaatacaaaaattagccgggcttgctggcaggggcctataatcccagctactcaggagactgaggcaaagaattgcttgaacctggaggtggaagttgtagtgagccaagattgcgccactgtactccagcctgggtgacagagcaagactccatctcaaaaaaaaaaaaaaaaaaaaacagaaatggaccccatagtcattctatccttccaaagacaaagatgttcaaagatgcctctgtgggaacccgttaattccataaggagcgttttcactaagaatataatgaatccatgccaaaaaagaaaaaagacaatatagtacttatgattttatatattactaatggaactggaagtaaaaataattactatttaattacagaaatgtgtactccaatgcacaaatgcctgatagaggataatgacgttggacaccaaaaacgttctgtggctgctggggacatttggcaataatttacatgtttaattgagttgctgtgaaaggctcattgtgcaattacatgttcacttaggtgctcagatagatactggaaatgcctaggtttcacttgtacctatttcccaaattgcgcctgcaacaaatgtgtccatttgcttatgtgggactctacatgtgattgcactctaccgggagtttaaagtgccttctgcccttaggtttgatggctcagtcttgctttgagcactattgcgacgtagactatttatgggacaatattgccctctggcagtgaggcagccagtggttttaataactgttttatgtcattttgacagtttttaaactagtcacacccagcagtttaggccagaagggaaacatcagtgaatgcctacaggagttttctattacagaactcgtacatgcatttgtaccaggaaaatgctacaattcttgctttaaagcaaagctgcctttcccaagaggagaactgaatttttgccgcgtaaagcttcagaaaagtgcaaataataatgacaatattgtgctcacaggacaaacagagaatagaaccattctccctttgagaaattcatgactggagtgccacaaagatcaaccccacgtgagccaatcacaaaacatcttcctgtaatgcatgttcagacactcgtgggatcaaaaaaggacctcagggtcatatctgatcctttggattgaatcatcgtgaggagtgtctcggcttcacgaaaatgacccagagctgctcgctgaagctggagaaaccaaaggcttgacagcagctgccaattcctggaggggtatctcagctgcttctcagccacttacgcaaagggaatgcctcaagagagccaggtgggctttaccagatggggctgaaattacagggagtagaggctctgctatgttgagaagtgcagcttcggcagacagctgagaaagacacagctcagtaggcacctgcctttccagcccagtggctgctgcaggaaacatttctgggatcacagaaggcaactctggatctcatcttggtcattgggacaggaaaaccaggcactgcacggcaaccccacgcattccttccttgcttcccactgcggaataggtcatgcatctctgggggcagagtgcagggagagagggcaggaggactccccaggagagggaggagaagataaaagtagcaatttatgcttttacttcaagcatgcacacaccgacatctagcaaaatgcctggaagtaccctgcacactgtttttcagctcatatttcctgagtgaccttatgtgaatggacacagacactgtggttcaaaagggaccaaattcgcaattctatttcaataaaacaaaaattagggattttgaagttaagatgagatatgaagaaagccaaaaaggaatattaccacagaaggagaaaaaacaaaaaggctagattcagaaaactgagtttaaatgaaacctagaaaggaatttcagactctgcatatattgaaactatcaagagtccataacatgaatgaaatatactgcgtacagtcatttagataaaagtgttttttgtttcgttttattttgttttgagacggagtctcactctactgtccaggctggagtgcagtggtgtgatcttggctcactgcaacctctgcctccctggttcaagtgatgctcctgcctcagcctcccaagtagctgggatcacaggcacgcaccaccaggtccagctaatttttatatttttagtagagatggggttttaccatgttggccaggctggtctcaaactcctgacctcaggtcatctgcctgccttggcctcccaaagtgctgggattataggcctgaacctctgtgcccggccaaaagttttgaatttttaaaacttatcctgtttaaaaataagctaaattattatcactcaaatacaacctcagtgcaaaagggaagaatttagcttagtaaataattaaggcaattgttttaattgtgcaagagataacaaaaatcgcttcaatgatctgatcaattgagggggagaaaaaggctattaaagcctattttaaccatcaagagtatgtgttacacgtatatccacattttgttataggcaaaattcaagaacattaagcatgtcactgaacatgaaactaagacatgaggagacagggttggggctatggtgtggtgactcagattttacagaagatccaatccagaaaagctagagcgcttttccccaaaatatgtaccagtctcggccaaccgctcaatcactaagccttgcaaataacctattttccaaatgatttcaaaagaaaataatgcctgccaaagcaaagcaactcattttccccagtaatgactgcaggaagacctttgatttccttctcagcttctaaagctttctttaaatttccctatttacacacagtgtttcacctcacagattctcctttcaacagctgtgtgggacaggaatgatgcccaaggacatgcagcccataggttttattttgttttctttgggtaattttttgggcagaggtgatatgatttctatctgaagcatttaaggaagaaattgagtatgccaattttgacagatgatagaataaaagccccagctatttctaggtttgaataataataataatggaaataatggcaataacaataacaatgataacaagtgccataacttcttaggagaatactacagactactgttcatacattttttcagtaatcacagaaatcctgtgaggcgaatgttactgttttcatcttactcacgtggaaagtaaggacaaggcaggtgacattgattactccagggccagagctagtaagcatttgaactcaggtctgtctgccctcaattccatgtttttagaccttgtgctactgttatttcttcagattaaaagatgcataggtgggctctggtagacaaattactaaccattctacctaaacctccctgttcctacaccctttgccatgtgaccttggagctcctcccactaaaggagcaggtctgtttccccaaccactttgagcatgagtttgaccatgtgacttgctttgaccaatagaaagaagcagagttaacagcctccttgtggctcttagtccaggctttcattggccttggtgcagctgctcatcctcttgcaccctgttatggctatgagaagaatattcctggccagtctgctagtcccaggagaggggtgagggacatgtaagataaaactgttctggtgacttgctaataaccaaagaccatccagatattcatgagcactactaaacgatcattgctatctgagttttgtcattgcttgttacaattactgtaccatctataaggtctatttgaaagaatatgtgcccaatgagtgagtgtacgggcacatgcacaacatatacacataccaaatggagtggaagtcttggtgtcttacatccagataaccatttggtgagaataaattcattaacaacaacggtaagggaatttcagtattttggttttcctttagaaagctgtaaccattctatttgctgctcagttctcttgttaaaagccaagaggatgttttcagacagtgtagctgcttagctctggttttggtctttgatgaattttacctgataactgatacttaaagggaccctctgcgcaccgccactgacatatctcagtaagagggagacatcttgacccctgaagggcagtgacagttcagtgctcctctgtcgagcccatcctgattgcgctcagtggcagaaccacccgagatggttttgactttgaacaacatcagcagtgagttgaattgggaagtaactttacaacatcaaagcctgccatcaagtggtatcatatcattttatgatgtaagacaccagacaaaggttgaatgaaggaaaaagaagtgtggtgtgcaagtatatattcaccacacacacacatacacacaaacatcacaggcatttgaaggtgttctcagattgtgactaggtgaaagtgttctttataactttggcttttgatatatttacctatctggcactagcaatgaatatttgatacagtcatagctacatgcttagactatgactaagtataatagaagaagtggagaactggcctaatatggacagaaatcagatccaaataatcttgccttaaaaaaaaaacacagatttttgtctcaatgttctatttaacatgctttctgctaactcaactgagaaaattgaatttgggtcaattgttacaaatacagaccaatgcattcaaaggctgtgtagtttcatggctaattgattctgtttaggtaatatttgcaagaaaattacttttataatgcatgaataaaaagatacatgttatgatagttggaaatctgtgaaacataccctaattttctaatatcaaagtaagacataaatatactttgatttgagctagatttttagcaagatttgcataatttcaataacatattaaagagttacatttgtaagtgggagggttgcagggtttagaaccaaactggaagaaaggctggaagtggccagccagttgaaacaaagccctgccattccatagaagagaagtgtatgatgaagagaaagctggctgtgctgtgcaccattatctgccacttttgccttgttaaacttgccactcaatttgatatgacctagtgtttatgttctattttgaagttcttctatgtcttctattttatattatttttttctgttatattgatctgattaagatgaacactgtcacatatcattagcaagttctgattacttgaccattagaaagaatatttatttgttctgttcatccatttaataccaccttgaaattcatagttttctacagggatgtctaataggcatcttaaaattaactgtctaaaaggaactcttgactccttcccttccaccaaacctgttttgcccagcctttcccgccatcataaatggcctcaccattcacccatttactcagacccaagcctagggattgttcttgatttctctccttcccttgcactccacctccaatccatgtgccagccacctaccagttttattattaaaatacgtcttcttccgatgccaccaccatagttcaaaacatcattgcctttcatctaagctgctataaaagcttcctgatgggttttcctgatttgactctttccccttatattggattctcaggcagcatccagggtgagtttttaaacacaaaatcagatcacagcaatttcttgctcagaactctccagtggtttccaagcaccctctgaataaagtctaaatttctcatctcagcctacgatgacctttatgatttagtccctgctaatctcttggttttctccttctgctctctgctcactctacccatgctggccttcctgctattctccaaatgtcccatgcttgtgtccacctcgagccttttcacttgctgttccctctgcttggaaaaccacacacaacccccggtctttgctgccttgctctctcacttcttctagtgacatttcttctcaaatggcacttcctcaaagaggtcttgtctagctaccctatcagacatagccctccatgctctataggctcttaccccttggccttcattgcagtgcaacctgctatccattgacagctgggttttcctctcgaagaaaggaattctggatgcaattgctagcttttccttattattatttttaatgcaaacaaaacggcctctgctgccagttcaaatactgagctcagagctctgttctttcctgctgaaatttataattctactcccattcttctggttctccttgccttataaacaacaaacatgtgaaccaatgtgacttctatattatactgatgattcccctatttaccaataaagtgtgatctaattttcataacagaaacattcattattgaacggtgtattgttcaggtttgtaaatgtgtagaaaatggcacaagcaaactgaaatgatacatgcaaatctattacggtgggaaagaatatttttatttttcaatctataaatactatgattatccttcatatactgtttgcatatatttatgtgttttttgtgttaaagagggaaaacataaaaagttaatgagatcctgaagtgaaataaagtgaacatatttacaacagcaacaagaaaggaatatgtcaagatagacatatcacagagatatatacacatgtgtgtagataagattggtgagatagacagataatagagcttgtacttggcctgccttcacccaatgttgcaatgacaatctatacaatgtaagtatttgtactttttatactttcaagaaaagcagatataaaattaatgcatatactttttgtttttggcatcctttcatggaagcaataaaatattctggagagagagagaaagagagagataaactaactcagggatgtgagaagaagaaaataaatatcactcttactcctccatctgaagatgatgatggaaataattgtcatatttctcttatgttttttatttgttttttctcccagccaagtatgctttttagtgtgggtctctgtgtgttccctttggtaatgtctaataacatttctaacctggagatttatttcttagaagcaaagttctgctcatcacaagccatctccatcagagccatttctccttatggtttccttctcatcatttaatgcttagtacttcttcacaatagaagcaagctgcctttctaagggatgaactgatattctagctagaggacttaatattccttttcagaaattgagaggttctctttgcttttctaggccttaattaagtgattggttatttcataaacagtcagattacatttaccactcacaattgtcaaatttttaaaactcaagtaaactttttttccttcttcaaacaagtctcttattctctcctgaagttaatggcgggcattactaccagtttcttggccagctgctaaggagattcctttcccttaaaaagttaaagtatttaagaatcaccctcaaaccccaggaagggtggtcaacaaaaaaagatgtcttcatggtcaaactttatggacacaacaagaatcccaaagaagggagatgactcaagccatcttttattacttagacgatcgatggcgatgatgtggaatttgcaacaattcttttcttgagacccagtaatagttaccttttgctacataacaaaccgcctcatagtataatggcttaaaaacagacatctattatatctcaggactcttagcttggagttctctccatgcggggtctctatcctcaactggctggcccaggcttgttttcatggtggcagaagggatccacctagccagagggcgagcccccttgcacaacacttttcatgtctctgatcgtgtaagatttgctatcgtcccactgaccaaagccaattacgtgttcaagctcagattcaaggaaggagctctcacttctcagggcagtgctgccaagagtttatgtacacttcagcaatctatcgataccacaaatatgagaggccagctttttctcttttaaaaaaataaagcttataaaataacacaagtacataatttccctacacaatgagtaactagattttatgttttctctttcggttttcctcaaaaacttgtatagatcatcttttgagatgaatagcggagcccttgtgatacaccacattctaagaatgctggggacactgtattcaacccaggacagctgcctaaggttgtatagtctgtgcaccgcatgatgcaggagatgctattcatgccatattcctaaaattttgtatatttattgcaataatttcctggcaaacaatagttacatttctagagagaaggactgctttttctgattcttacaaaaatgacttgttgatttgcaactcatgctgacaagccatcctttcttaaatgaagaaagacttgtttaaccaatggcaaagaattctccaccttgtattgattatctttagcccctcatttcttctgccttgaagtgcatgatttttcctgttttctagagtatgaagtcactttagtcttaagtcttatagattgtgttagatcacattcatgtttacaagccaaatatttcacaattttcaagtaccttgtattcattgttaattttccaagtctgaaattgtttctctctggactcatttttatttcaagttctactctaaatgatttttctttttctgtttcactacataaagttctttcttcctctcaggggatctctgctaatccctttaaccaccgattgccaaagacattcacaacccctgtgttggcttatttctttgttaagtaaaattttttcatcctttgaaattgaaaacctgaaacattttttcttaagtctatgaccaaccattatttataaagctgtatcatatcttagaattagcatattagcatcagttgcaaaaaaaaaataggcaatagagaaaataaaagatatatgtatatagcatgaaagttactgcaaaaagaaaatgaggctgtgtgtgtgtttgtgtgtatgtgtctgtgtgtgtgtgtgtgtgtgtagtcgtgcatcgcttaacaatggggaaatgttctgagaaatgtcttgttatgcagtttcatcattgcacaaacatcatagactgtgcttataccaacctaaatgttatagcctattacacccctaggccatacagtataacctattgctcctaggctacaaacctatacaacatgttactgtactgaatacagtaggcaactgtagtgcaatgatatttgtgtgtctaaacatagctcaacatagaaaagatactgtaaaaatatgatataaaaagataaaaatggtccacttgtatagggcacttaccatgaatggagcttgcaggactggaagttgctctgggtgagtcagtgagtgagtggtgagtgaatgtgaagtcctcaaacattaccgcacactgctgtagacttcagaaacactgtacacttaggctacactaaatttacaaaaaatatttttctttcttcaataataaattatttactgtaacacattttactttatgatttttaacttaattttaactttttgactattttgtaatcatacaatttaaaacacaaacacattgtacagctatacaaaaatattttatttctttatatctttattccgtaagcttttttccatttttaaattattaattttcatgtatgtatttattttcacttttcagactttttcgttaaaaactaaaacaaaaatacacacgttaccctgggcctacacagggtcaggatcatcgatgtcactatcttccacctccacatcttgtctcactggaaggtcttcaggggtgatatactcatggagctgtcagctcctgtgataatgataccttcttctggatacctgaaggaccttcctgaggctgttttacaattaacctttttaattagtacaggagtacactttaaaataatgataaaaagtttaatatagtaaatgcataaaccagtaatgcaatggtgttttgttttgttttgtgtttttttgttttttttgagacggagtctcactctctcacccaggctggagtgcagtggtgcaatctcagctcactgcaacttccgcctcccgggttcaagcgattctcctgcctcagcctctcgagtagctggaattacaggcgtgcgccaccacgcccggctaattttgtatttttagtacagacagggtttctccatgttggtcaggctggtctcgaactccgaacatcaggtgatctgcccacctcagcctcccaaagtgctgggattacaggtgtgagccaccacgccccacctaatataattatttattattaactattatgtatgtatataatcatgctagacttttatgtgactggctttgcagtaggtttatttataccagcagcaccacaaacgcatgaataattgtgcaatgataatagtgcacatgagtagttgtgctctgacattatgatggctatgacattattagacaataggaatttttcagctccattaaaatcttataggaataacactgaatatgcagtccgttattgaccaagacatcattatatggcacatgactatatatatccttaaagttattatgaaaactaacactgaatctccatatttacttctcttcgaagagtttaaaggattctaaaatttgtatttgagagtgagtgtgcaagaaataaggaaggtcagaaaagttttacatttgttaatctcatcctgagagtattttttgtaaattaaaaatacatgtattttcatcaacaactggctcacattccttaaactattaaagttcccaggtagacacacatgcatgtgtgtgagtgcgcccccccacacataatgatgtgttttagttttgcatctgaaggaaaggaatgctaggttttcttgcccataaatttatttttttaatttattttaattttcttttttttttttttttttttttagagatagggtcttgctttcttgcccaggttgctgtgcagtggcatgatcatagctcacagcagcctcgaactcctgagctcaagcaatccttctgcttcataagtcactgcatccagccttgcccacaaatttctaattttacctcttcttctttatatcttctgagaagaaagagatgtttcctctatcagtggtcatttatagcctttctaagtctaaggaagaattgtggcagacataaagatcgttgaatcaggactaagaaaagtagattctagctgatcttgaaagactgacttcacttctctggggagatgatgggtttggatgaaataattccagaagactttcccatttttactcatctctgactctattacagcttttctatttcacccttgttcccaactctcatcaggaacttaaaagaaagacacaaactcacaaacagcgagaaagagagacagagaaaacaataatgtagggtatcagtcatctattggcacaataatgctgcataacagaccatcctgaaactcagtggcttacaataaggttttgtttttttaattcacgtgtgctggagcagacctgccttaggctgtaggtcacccaaccttggctccaggctaagatcctgaaagaagggctcaaatccactccctgtgtcttaatctaagcccttagataaaggggccacctcctgggacacaccctcctcctggcaaacaatacaaacataggtcctggccaaacacccaagcacacttaaaccttcttctcgtgtccaatctgctgacattccattggccaaagcaagtctcgtgatcaaactccaaatcaatgaggaatgagagtgtgttctgtccacgggtaggagggatttggaaaagccatagatatttgcagaacaataatccaattttccacattctgctacaaatatcatacactgaaatgccttcagaaactgacaggaatgaagcaaacagcagagggaacacaccatcaaaatcaggcagcagggactcagcctcagggtcaaatgtctcttcttcttgtgtttgtttttttcttttgagacaaggtctccctctgttacccaggctggtgtacagtggcacaatcatagctcactgtagcctttacttcctgggctcaagtgatcctcccacctcagcctccaaggtagctgggactataggcacacaccaccacacctggctaattattattattattttttttttgtaaagatgggattttgccatgtagttcaggctggtctcaaattcctgggctcaagtgaacctcccaccttggccttccaaagtgctacgattatggatgtgaaccatcacgccctgccagatgtttgatttttaaagaggggagatagaaagtcacagtcttttgtctaaattttctatttaaaaaaaaaaagttagaaagcagcttactttctgtctgtctgtatacatatggaaaattacatgtatgcatatgtatgtatgtgtatgtagatgtatgtatgcatgtatgtaatatatatgtctgggtaaaacaaagcatctgcagaccagatgtaattttgagattgttatttgcaagctttgactagaaacctctcttgtttaccaatatatgaccctataattacacatctaagatagttttaaaatctttctgggccaggcacggtggctcatgcctgtaatcccagcactttgggaggccgaggtgggcggatcaaaaggtcgggagatcaagaccatccttggctaacacggtgaaaccccatctctactaaaaatacaaacaattagccgggcgtagtggcgggcacctgtagtcccagctactcaggaggctgaggcaggagaatggcatgaacccgggaggcagagcttgcagtgagccgagatcgcgccactgcactccagcctgagcgacaaagtgagactcggtctcaaaaaaaaaaaaaaaaaatatatatatatatatatatatatatatttcttttgtattcaatgaggccataatttcatcctgccccatgcagagttaacacgtggtcaagctctttggcctaaccttgtgtagatctttcctaaaaactaaggactgtgtacctatgatgttacaatgttgcattactagagaaacacaggatttactcagcactttcaagtacatacattgacttaatccacatagtaagtgattctattagcattttgtagatgagaaaactggggctcagaaaaattacatgaaattttcaaggtcgtagggctatagcagagctaggtttctaggtcatttaactctttctcaactggcaaggaagctaagtaatcacagattcacagaacaccaaaagctgttctggctactgttatgatttgattctaatattaattatgtggttagaatgattgtattagtctgttttcacactgctataaagaaatatgccagactcaggaaagaggcttaatagttcctcatggttagggaagcctcaggaaacccacaatcatggcagaagacgaaggggaagcaaggaccttcttcacatggtggcaagagagagaagaaagaaggaggagcttctaaacatttgtaaaaccatcaaatattgggtgcaccaaaatctcagaaatcgccactcaagaacttactcatataatcaaatactacctgtttcccaaaaatctattgcagtacaaaataaatttataaaaagaaattaagcattgaaaacagatatttctttcctggaaaaaaaaatcagatcttgtgagaactcactatgacgaggagagcacatcacctccctcttaacacgtggtaattacaatttgagataagatttgggtggggatacagagacagaccatatcagtggtatttcaaaatatcttccttttgagtcatttaaatcccttatttgatgcagagatagtaaaagccctaccagataatcaggaggttgctattatccttttttgtactttgtttcatctgctcttatgtctttgaacctcatttccgtcagatgattaaataatgattatcttgtctacaaataattggttttgttttgtgatttcacttgacctcaagtgacatgatacagttttaagaatgtcacagatgttaagttgtaaatcagggagtgctattttttttaatcagagaaatatgatgattcagtgtttagaacatattctttaaaatgaggggacagagattctaaacttgattctgctgcaaatcagctatgtcatttggggctctgacatctcattttactctctgaatcatctaggaaaaagtaagatgatgattacaaagcactgggagctctttcaaaaggcacagctttcatctaaaatgatattactaattaattaatcagatcaattccctgttaactcatcctaatagcccaagccctgttagccaagtatattactgtgatttattttgacacttaatggaaccgtgcagcatttcagtcacaggttgataacctaagcattataaacttcaagcagtgtttatagttttgttgttgttgtttttcctgaagacagctgataaaagatacccttttaggaggtgctagctacatccctcaaatgataaaaaatacaaagtggtgagtagatgttatgaacagcattgtccttaaaagagaagtcaccactgatctcgaagaaaagtttgcaaaataaggaagaagaagatgaggagatgcagtcttcatttcatttcttttcccaatattttgctgctgttttgtttttaatatcttccttggagcaatgaatcaaatgtcttccatcaaagaaaagcaatattgatatacatttgcacatagtaaaatctgcatgaattcacggctcctggaaaggaaaatattttctctctttctctcttcctgtgtttctttaatgtaataaaatagcttcccttggaggtcaaaggattctgccatttctcttttctgtgctctaagacagttgcaaccacttgttttgaaacttgcttttggttttggggagttttaatggaggtattaactggtgcctaaagggagcaggttatgtatatgtaaaagcagggaagttataggaaagtagctataaagactctaagcagttcaagagagttatgttaattgctgtttcaaaatgctcccctgtagtgggagccttaggcctccagaactcacttttctctcagtgactcttatttagtttattttcctttttatactgtgctttttagagttttcctggtctcttttactttgaaatctcaaaggctgtccctcggaggatccactgtttacttctgaacactttctagagattctgatgggtccaaattccccaaggagctggtaaaggtctgcttcctcccttcatgctgagtgtgaaagaagggaagagtctttcacttcaaacttcagagaggtctacctaactggagagtgaaccgaaactctgaggagcactggccagggagggggagggcagcacactgcactgtctcacctgggcattttcattgtcacccactatgaaagatctgctaggagaatcgagtttcagagaaaaaaaggaatgaacatattttgcatgacagcagtagtatttcccctctgttccccttctacagagaaaaaaaaaatgtgttaatgactttctaagaacaattactatataaatgtgacaaatttagattgaatttggatttgatcctcttctcacacccatttaaattggtttgtgctcctagctcctgtgccatatcctatgtggaaatttaagaatgacaaagttcataaatttggaaaggagaagtttgtttctcataaagggttgcagcttgcagggtggccattctgacgggctgagaagtgtagcctccagtcagaagccagaaacagacactttgagggaggggcaaagggaacaggaatttatgctgagctagtgactgaatatacatatttaataagctgtaggaggagtcatgaatatttgtgatagaagaaacatgcacagatccagcggagctttatgccccttcctgagtctcactacaaaaaaatggcagtacaagcatgatctgagggtggcgttttccatgctctaacatcaataggtgaagccaaggtcgcaaaaactcttactgcacattctccatagactggacagaaccattccatggtcagtgttctcttatcagccaaaaaaggaagggcagcctcaggcagatcagtagtgtggtcttttgaaagaactggtttctgtttagcccttagggaataaagcctaattgtgattagcaagggagggggtataacaaggcatgtctgacctcccatttcattatggccaataaagcagttttcaagcttattttggggtccctttggccaagagatgatctgttcggtcaggtgggggacttagaattttattttccgtttacatatggaatagccaaatattttatgatacactttgctagattgtgaaatgtttggcaaatgaaagaatgggacattttcggggcgaggggaaggtcagcgaattcatctcaggatatcctgaagaaatcaaataatgaggcagacaagaccacccttgaacagactgccatatttcttgagcttcaggaagtttctttggaatgccaaagtaagaataaagttggcctcccatgaatactagggcaatttggtgatgcttactcagatccaaagaaataaattataacaaaactggaaaagtacccatgaatcagggccaaatttataagcatacacctaaaagtatggaattccaggcctgatatgtgaaacgtaaagccctaaggcaaatatatttcatgtgggttggcataaggttgcttccattttcacagtattttaaaaaacaaaatgaagtttttggcaatgcttcacaattgtagttttcacttaaaaatacagatttctggcttctcttggaagactaggacacacatgcccaagaattgaatagcagctacttctttcggcagtaacatgaactcacctggtccatgtgttcatgtcttacccaccatcccctcacacacatactcccaagtatctgactcttgacacttcccttactcccttgacctgctgtacctctgttgctgttctatttatcaagcaggaccctgtcctctcccaaaatattctccagagtgatggactgtgttttctgggaggcttctctcacctgaaggacaaggttgacctgtctggctgcctttgctggctgatgctgactatttccaactcagctctctgctccatttggtgctggcttcttccagttgtggatcctagtctgtcatcttgacgacactccagaccacccaaaatgtcaacttggcagttgtttaaatcaaatcatataataaaataattaagctgttaggctgtgctgatatacattgatactcttagtacacacacctgcaagagtggtctctttgtaaactacatgacaacgagaacattcccttttaaaagttcctattttcaaatctgcctaacagcaacatatttgctccaaaactacatttctattttacaggagagagaacagaaaccaaagcaaaactaaatttcatgtcttgattactcaacaagagagtgtattgatgacacaagttgtcctgggttaggtagtgattatatttaagtgccatagaagattttcttggaagagattgcaatcactataagtacttagcattgcattgcttacatgaaaagaatgcgactgttgagaggaaaagaagcctctttagtatagattagtcttcctattgtccattaattatgaatgaaagttgaaattcggctcattgtgattcaatgctagattctataaaaacaacagtgcttgtttaaggaactgcctggaagatctgctttgctcttttgctggtgcagttacttgtggaggttataggaatttagggacatggatttttcctgttactacagcataaatatgttgtaatatacaaatatacatgtatatctgaatatgtatgctgtatatatttacacacacatacatattctaaaactcttctacttcaaccagggcagcagctactcttctgtttagttttatataatgaggttccatataagattatacttaaagagaaagtgccggtttggttaagtaaaatttagaaaaatactaatctagtccaactgtcctattttctgcatgaagagaccactgagagacatgttttttttttttcatcacactgttggttagtgacagagccaagttgattcttttttttccttccttccttctttccttccttccttccttccttccttccttccttccttccttccttccttccttccttccttccttctttccttccttccttccttccttccctccctccctctctccctccctccctccttccttcctctctctctctctctctttctttcgagacagagtctcactctgttgcccagactggagtgcagtggcacgatcttggcttactgcaacctctgcctcccaggttcaagcaattctcctgcctcagcctcccgagtagctgggattacaggcatgagccatcacacatggctaatttttgtatttttagtagagacagggcttcaccatgctggccaggctggttctggttttgaactcctggtcttgagagatctgcctgcctcggcctcccaaagtgctgggattataggcgtgagccactgcaccccaccagagccaggtttagaatacaacgctcccaactcctagtcagtgttctttgtactgtatttggccaatatgtattgattgtttgctatgcacagacactgtgccaagattgaatttcctcaggtgataatcccactaaccccatgaggtcaatcttacgtatgttagagaaaaggataaaaaccctcagggaagataagtaacttggtcaagtttgcacagctacaaagtgcagtgtcaaaaattcaagtctaatttaatctaattccaatgtcaataactgtactcttatccacttctctctactttcctcataaccatttttttcccaggttggtagaatagaccacaaaagccaactttgtgtgcatttctatatccatatataaaataatataccaaaatacatttgatcatggcatatttattaagtgttctatattactctgagctctattactctttaaaattttttaaattctattcataagcgacacataataattgtacatctttctgaacttcattcttaaaggaacaattgtagctgcatcgaagttgacatcagggcaatttctgcttcacagattttgagggcctggaagaagatttgatgagaatattttaatccctggatgaattttatttacctgtgtaggcaaaaacttagtaaaagatctttgaaccctaaatattttactttaggtacagaggttataaaatacctctgtacctttaggtacagaggttgaaatgaatgaactgttatcttagatagtatgccatttcagcatgagaagggaatctgaggatttattatctataaacacagaatattcttgcagaatatcttcaacaagcacttccagtcataattgaaggaactgaccagcaaagagagaagggaaagaaaagtgatttatagctcatatgctgtcttgataaaggatctaggttttatgaaatattatggaaactttaagtgctgagaattctatgcaatctaatcaaagattgtagtgctgtgagtaaaagaaaaaaatgtaacaacagagagggattggagaggagtggaagaaacagcaagtaggaatcacacagagactaacaatgataattcacaatgataattcaatttaagctggtcctctaactatcatatcccatggggatcccaggagttacctggagactcggcattattattcagagaacacttggaattaatgcctctcttattgttgaaattctccctagagttgtttgcatacaccttgatatcgatgttctaagaagctattatccctttatgtgcattagatcacagaacagctacattagagatgctcttgaattttgatttaatcaaacaggcatttttatgcttcagtcctaataatggttccagtggttcatccagtagttcctgatatttgggtaaagaggtaggcaatgtgagctgtccattgagatattttgctttgcttaattcagtgtgatgctgtgaaactcaaccaataacagtttgaaagtgtgcccatgtatccaaataccaagtagcagcaggaaaagagttctctgcagccagtaacaattagagatttattaagactctggaaaacttactggctggtcaaaaaaaccaatgataatctccacctcactcagggaatttaaggttgtttgtttgtttctttgtttgtgtgttttcccctccacagcctaaggattcagaaaggtcagaaaaacagaagtcacttctcttgatacttcttcccataaagacttacctttctgccagggaaagatatagatttgtataacttccattattgtagaaaacacaaccaagaacctgccgcaggagatatcctgaaaaccattgcaactgttccacgtggggcgaaaagacatctctagttgtgttggagccttattgatgttttgtattgctatgttctgctgtgccattcttgtatgaaaaacaggaaaaagataagttataaggcattttagcatatcagagcatggttagcacatttagcttagaggagttgctccattacaaaattacctctttgtaaatcatattattaaaaaaaacacacatctgtcttctcagggaattgccttctgaatataaatctttgagaactgatacttaaattccactgtaatttaagtttcactgtaattaaccaacattttatggcctagcccacttctgccttctaatatatagtttagtgggaaagacacaagttaaacaaacagaaaaataaatatttatttaagattctagaaaatcttttaactggacagagaacagccttgccacatgagagaatagactaagaatggcttacattaagtttactagtctggtatgttctctctgagcagatagttaagctgagtcctgaaggatgagacagtaaaaccattgggagaacaaaggaagaagactaggctgtgcagaaattgttgtggtttgaaaaagctgagtggggaacgggaagaggcccaccttgccaaaaaggtatttaaaaacaaggaagaagagggcaatgacatgcagtggtaggcaaggctttatcacgtaagactttaagaatattgtagctctagtgaaagtttgaatcagagaaatttaaatacctaaatgtcactttgaaagatcattctaactattgtttgatgaatggtggttgctatagggcaaggggcaaaatggaagttcattgggaggcttctgtagttgtttacaaagtaaacaatgatggcttagactagggtggtatccatagagagagaagtagacagattcaagatgcatttttgagggaaaactgagagttgtatgaattcagtgtgagggattcaggactatgtgacatctcatgaatgccctcctggtttctgctctgagtgtgtgggtagatggtgacattatttactgagatgacgagggcatcatctataccttgaatacattgaatgtatttcttaatttctccctcattcctccttctccctttccttaccatgtttctctaaatcctagctatcttttcagattcagcatgcttaataaacatattgagtaataattaaaataataagtttaaaatttttgagtggttctaaacactgtacatgcccaatttatttaatcctcccaataaaactctataggagaaattctctttacaaataaagaatgtggagacacagagagcatacataatatgcctaaggtcacacagctgtatagcaattgctaggaaaagcaagcatttacctttacagagttacagtcaaatgcaggtggcagacttacaaacagactgatgcaatgctttggcaaagctgttttaacaatggtttcagtggccttctatgtgacccatgcaggggaaactgatctggccctgggcaaatgtctgtgctgttataacaaaataccacagactgggtaatttataaagactagaaatttatttcttatagttctgaggctgggaagtccaagatcaagatgctagcaggctcagtttctgatgagggctatctctgctttcaagatggcttcttcttgctgcatctctggaggggaagaacactgtgtccccacatggtggaaggtggaagtgcccttcaaatactgtctgaagtctctttaatgggggcctcaatcccatttatgaggagaggaggcctcatgacctaatcatcttaatatgtacacattggctagtaattttcaacgtctgaattttagagaggacacagtcaaatcatagcagcagagataatgaagacaggctttctagaggggatgatacccgagctacactttgaaaagaaggtaaaaatcctggtggaattaatgggggcagggaaggctttctcaggtaaaggaacatatatgcaaaggacactatgtagtggggtaagagcagggagaaataatgagatagtattgagggacaattgatgggaaatatggctaaagagatagattacagagatgaagtctggtattcatagagatgtactttaattatttaaaatagatctcttggcactatatcgagtcgatgaattggggagggcttaagtcacaagtctagaaatacaatttgaaaacttgcatttttatttttctattggagaaaaatgatggtttgatacagagcaacggtgttagagatgaagaaaagatgaatttgaagattaaatgagacaggacatagaaagcactcagcacaaagtttggcatagattacctacataagaaatatcattgtttcagatgtctgttgctgtttaacaatccattgtaaagcttggttgcttaaaacaacaaatacttactattttcttctaattctgtgagttgagtgggctcttctgggtggttcttctagtcttcagttgcaagtaaatttgatttaattgattatgactgaggtcactcatgtagctacattcaatttcaactggactggggctggagctgcaagaatggcctttctccaaggcctcttttcagacaagctttagtcattcactggtctagcctggacaacatggcagctgggttctaagagagagacagtggaagctgctaatgctcttactgtatggtcccaaaagccctataaccattttcctttcaccttcaaattggtcaaatcagttacaaggccaacccaaatccaaggagaggggaaatagagggagacatatgcagatagagaaatggcaaaaaaaaaaaaaaaaaaaaaagttgttggtgactgtatttgtagactgcataccagttatttaaattgtctaatgccaatttaattccttaaacagcattcttcatttatatttgtattagtttctttctctagctctataagcttcctttctatctcacacagagtctttcctatcttgtactaaatctatgttttagggtttttttccccttaatgtcccggagaatacaaaacagcagttaccggaaattcaatttattttcctagctgaggtaaatatttttcaaaattatagtctttatttatcttttacattctttcttttttaaattttcttttttagttgctgaatattttcaaacatactggttatgcatatgtatgcctgtatgtggcttgtttatttttcttgactgactattgaggatgacaagtctatacagtctatccatgttttctatttgcataaaaattgtttgtctcgattctccttgagacctgggcagcttgagttctccccatttatatgggcatctttaactcttgaggattgtgtgctggaggtttctaattagcaaagtggaaaggcagctacagtcctagttgataaatactttacgtcatggtttttgtcttgtttgttttgcaaagaatgtatcagactgctgtgttcacctgaccttatttctagatacaccatgtggttctcatcactatcactctggagtttctacctatcactctggggagtctccagtcctattggaggggtatttgtctcattaattaaaaggctcctcctggtttagtcacctatattgattaaaagtcatgaaaattccactatctttctctttaatgatgccttaggtaaggatacagcttactatccaaaataggacacttttaggataaagatacattgttaataatgtataataataaataagacaaaaaatgtaactattttggaaaatgaggctatatggtcactcaagtgatgccataactggagcttttgcaaccagtgtgtctccagttgcctctctttccccgtagccagacctccatccatgtcctccagactggtggagtttaccccagtgggagcaagtttacactgatattagtagaaactgtgcttggaaaaaaatacacttaaaatagactcatgctttctcttcccacttcacacggatgctgacccacgatgaggaaagggatgcgagctggctacctatgtctcagttccctcttccttcaaaaggtgcaaatattaaatagtttgcacttcttcccctcaacatttcttgcgatattccttgaaagaaaagttagttgttagtggatattccatgtaatagtctcaaatgtcgaatctgtggtagagagcaaagcatataaaaaaattataggggattaagtgtgtgactctacagtttgaaaaaagcactgtagctagttttaacatgcagtatctctgacttccccagcgcatgtgtattgagaaccactatcctctctgatgtaacagtaaggtgtgttgtaacaagtgcctggtagctcatgctaccaggatcaagaaaaattagctctgaggaatgatttttttctacttttattttatatggtattaatcacatctaagtaaacttgctttttgtttgaagccagatgccccaacagaccaagttacacagaaaagaaatttatgcatctggtcattaatgcatatttggcccctaatagctacatgtaaaataattcacttgaaaacattactcatttttgtcaaagggctgcacaagagctttattatacatcttatttttaaactgacttctactataaatgaagttttactacttcctgatcatcttcttctgacaacttgctattcagtttttttggcaaaataaaataacaataaaacgtgattaatttattgatgaatggatggagaaatagatgagtggatagacatatgattaaaacaagaacagtaaagctttagtggtagaatctagatggtggataaatggggggccatggtagatttctttcaacttttctgaattttgaaaatttacataataaaatgttggaaaatgattacttattattttctattaaaaatcacggagtaggccgggtgcggtggctcatgcctgtaatcccagcactttgggaggccaagatgggcagatcaccaggtcaggagatcgagaccatcctggctaacacagtgaaaccacgtctctactaaaaatacaaaaaaaaaattagccgggcatggtggcgggcgcctgtagtcccagctactcgggaggctgaggcaggagaatggcgtgaacccgggaggcggagcttgcggtgagccgagttggcgccgctgcactccagcctgggtgacagagcgagactccgtctcaaaaaaaaaaaaaaaaaaaattaaaaaaaatcatggagtaaagggaagttttgtagtgctgtcctctctctaactgaacaagagccactaaaagcagttagaacacaagttccaagcaaaacaaaacaaaacaaaaaaacacagcagtggctctgaagctctccctcctgtcagagatcgtgcagtccagatggattcatgggaactgagaactgactcctgccgtcttgattctcttggagaatatagattccctctcccccaacaacaagtgtcgtgatcctgaaagacgtatctaagaattctttacatcgagttgtaaaacctcaggtcatttaagtgactcagtaggggagaaaaaacataaggcaaacagaaaaagagggtaagtttagggaggaattatgcagcagagttattttctatgttctgtaagtagatctttaaggggaggagtgttctctgaggtgaaggggtgtcaaggagtgtcagattgaagcagagagccctaactgaaaggcttttagctgagtttccctgaggcaggtcctcaggtgtccaacattcctgagcagccactgtgcatgtttcatcatacatatcccaccgtgctttctcttcatcccgatactcttctgcacaaaatagccaccctaactttaaaaatcaataatacttttggaccagttgaaaaaataagagaaattaaaagaataaaagcaaaattaagggatattaatataaagcagatggacatcatatatcacagaaataatacccaaagagacacaggaatattttataaaatacttcttcatatccgcagagttctggttaacatgttttatcaaaaacaagcgatcgaagaatagatacaagggttcaaataaaaagtaatggcataacataaaagcgttagagttaagccccgttaaaaataacaaaaggagaataagatggactaaaattaaagactaaggagatgaatttgagaaaatcttaacaatattaaaaaaaaaaaacccagcaggggcaaatcattctagattagatgacagctattatagacagtcaaaagatatccagtgtattaataatttatgttgctcagaacaagtggaagagaaaaaattatatttaagatagaatgagaaaacatgagttgagaaacatgatcctaatttgtaagaaaaaaaagtgtgtgccagaaaaaattgatgaaaattttcaatagcaaggcattataatattgaagttactgaactgcaaggataaagaaaaaaatatcacatttctatgtaagcagaaaaagtaaattaaatgtgatgcttgatgtattatagtatctgatgccagaagatagttggctattgtctacaaagttaaaaggaagaaaattataacagaataagataatactcctcctttttcttttgaatagaaagtcaaataacaaattatctcacatatgcaagaactgagggacgagagtagacttgccccatttttggtgtgaagggcaggtggacacaaggctgtgaagttcagccaaccaagagatctggactcttgaaaatgaagggataaagaaggtaaagaaacagtgtcactcaatacatatatttaaatttagaaagcagataaaacaacaatggggattatagttataaatagaatacaaacattttaaaccttgacaatacaaaataatcatataactatcaaaattaagtgattgagatggcatacaaagtgtaagtgtcccaatttttgtatcccatactgtaggaataaagaaaatttttgttttgttttgtttttgtttttgtgtttgtttttgagacagagtctcactctgtcgcccaggctggaatgcagtggtgtgatctcggctcactgcaacctctgcctcctggttcaaacgattctcctgcctcagcctctcgagtagttgtgactacaggcatgcgccaccaagcctggctcatttttgtatttttaatagagacgggatttcaccatgctggccaagctggtctcgaactcctggcctcaagtgatctgcctgcctcggcctcccaaagtgctgggattacaggccgaagaaacattttctactgttggcatacatagttttatgtatatacttatttattttttatttcaacttgtattttagattcaggggtacatgtataggtctgttacatgggcatattctgtgatgctgaggtttggggtacaatgaatcccatcactcaaatagtgaacatagtacccaatctgtagtttttcaactcttgcttctctccctccatcccccagtaggagtcccccgtggctgttgttcctatctttatgtccatgtgtacccaatgtttagctcccacttgtaagtgagaacatgcagtatttggttttctgtgttaatttgcttagggtaatggcctccagctgcatccatgttgctacaaaggaatgattttgatatttttttatggttgggcagtgaaatacatagtttgcccatattgactccaacttttaaaatgctttaaaaatcttcttttttaaaaaatttaaagaaatattttagaaaataaaatttttgtgctatggaaatgttatgtaaaatctttcaatttaacttttttatcacttgaattcaagtttaatcttctctcctgtgaataagcctactgctgtatgaaatgctgtttaccaaaggatgacaatgattatttctgaatttgggggaattgcaatgttttttattttacttttctgtattgattttttaagtctatatcactttttcaagaaatatactctttttaatgtaatcgtttccatctggtgttaacaaaggcaaagaatgactttgaggataattctttaatctttccatatccacaggcagctcatttgagcacgagtagttagttgctttgactggatagtgatctctgttagccatgaaggtggtaaagtcactggaatcatcgattccatttagattccagtagcttagacaaaaagcgaccagtttactaaaaaccttagaaaacaccttagaaaacacctggaaatgccacacttaactgccgttgctgagattattagagttttgctgctgttgttgtgggtatactttaagggtaactaaatttccagagccataagtatatgaagccttgtccttcgtaatagtggaactgaagttcttaagaggggctcaggaggctgactcattgtttcctcttaggaagtattggtatttaacatgtgatttaaaatatctataaattgagttatgacatgagttttcacatgatgaccttctcaccaatgtatttgtgtaattttgatgttagtggagttagtttatgtagtgaaggtggaaaaatgtgttactaagaggtaattactgtaaagctatttaattattgatttccccaacatagcaggattgacattttgcagatatagtgaaggaaaagatatgcattaacagaatgagaacagaataaatgtacgttttaaaaagaaacacaattcattttaataggtatgcagtcattattcaggaaatgtgactgcttctccataaatgacattagctgtttaagttaaaatgacagacctataataagtaaagatattatgagggcgttttaaaccctagcattggcgtaaggttatattaaaacttcatatttaccaacattgtttttttgtagtctctgtcttcattaccctttatgaaaagcacactttattttgaagtatttatattggcttgtgcttcattcttcacttagaaaagcattttgctttgcatatttgtctaatagctataaataaatgcagctacttcttcccttgaaatgagcaactttgcattttaggctgaatgaaaaagatcagctcaggacttctacagaagttccagccttgctgaatccttgctttttcatccctggtttatctgcctttctgatttctagccacagcgaacaagcatctgactacatggtaatgagcccttaaaatgacaaaaagaagtgcttacacattcaaaggagttttagcttctaaagaatagcctttggttgaaagcatgttttgaactgtcttttggattgcgttcagagtcagtgtatgagacccacaagaaacaatgcctcatttaattacggcggcacatgattcctaacataaaatcatatgacccagctggtcaacattcatatcaggcaagctttgtttgaaataatattcagccatttttcttatatgacagcaaaaacacaaagggaaggatttgtcaccatttaaataattcaaagaatgtaacagcgattctaaaatgagttcccaaaaatgaagtttcagaaatattctgggccataaaagactattgagtatctaagaaaaagttggaaatagaaaagcttaaaaaatgaaatctgcagaatgaaaaggaggtggcaaatataaaaataatgaattgaaaagtgaaaaaatattttcaaattgattaataactttaagtactttttggaaacactacataaagaaggaagaaaacacaagtgcataaaatttaaaatggcataaaggaaatgagagttatattagaaattaaaagaataataaaatagtgcttcataaagctctacaaaaatgcatgttaacaattctcaaaatttgaggaaccaagtgttaacaaaagtgattctacagaagagatgaaactcgttgatgaataactatgaaaattatatagaaaattattaaaaaggtatagcaaaaagaaatttccagactcaaatggttttcaaagggagaattcttctgaaattttaaagaaccaatttactaattacttaagctttccaaaacagagaagtaatgcagcctccaaattttttatacaaagacaatgtaacatctaagttgaaatttgatagagatgatgaaataggacaaacttataacagtcttatgtaatataatcgtactactgttggggccaaaacattaaatgttagccaaatgaatggtggtatattgaaataattgtgtgtcattaatcaagaatatgtatttttcaaataaatattcagcatcaagttaaatgataaaaattttgaatttttacattcttattatgaataagatagtaatgcctactatccccgccattaaaattattctagaaatagcacatgtaattcaatatgagaaatgagaattaaaggtataggtattggtaaggaagagacaaaaattattgttagttctattcctaagggactttatctcaggtatccctctctgacaacataattgagaagagaaatgagcaagagtcagattatccaggaggccgtgtctagggttcttatgtgatttatgtctctgatttatgtaaatattgacaaatatagattaatctctagatggtagaaaaaccaaaggaggagcccctgctcacagagaaaataaaagatgaattcaatgtttcttagatccagcttaatctaaaccatggggcattaaatctttttagaaaaaaaattatcattagttgctgcttatgtaattgtatacctagtaaatgcagtggaatcaactgagaaatgtgcaaaataattagttaatatagaaaagtaccaggaacaaaatcattagctttgattcttcatcttttctatttggtcagtttaattatatacagaaaatagatgtcaatgtatttggatgagttttataaagtattatgttatcattaatttcattttctctatatctgttattaccctgttatgattttaactgttgtgtacatgtctttgtgttctgcctttttcatttttattatgcttcatttttcaaaaggtctaaaactcactgatcaattctactattatttttctttgttttccatctttcctgtcaccttccttttgatttccatggaagtagttagtcattcttctcaattctttatttggatgctcaatgttctctccattggcaaggccacttctggaacttgatatttggagatttctttgaagttaacattcttttctttggaatattttaaatggtcacaaatactcttctatttattttcattgggtaatacaaaaaagtagttaagtttatctaaagaaagcttagctgatatacactggttgaccaaggtaggccatgtcaatctgtataaaaaaaaccatgtgtcactatgaagtaaatgagacattgtctcttgtgggcaattttaaaaaaaaaaggatgttcaaaatatgtttttaataaagtctgattatgtttcttttcagtagctaacattcatttagatgtgtaagcatcatttggggggatgtataatttttaagaattcattacaagtatcacaaaagataaacacacataaagaattatataaaaattagtagcattgtaaacaacccaaagcagttagaaaatacaatgggagaaataatccatttataatagcaacaagaaaagtaaaatgcctggtattaaagttaaccagaaatgtgaaggacccatatgaagaaaacttgaagctctaaagataacataaaagaattcttagtaaaattagagatacaggtattctttataggaaaccacaatattatacattgacaaactgacaaatctcagtttagtaagctgcaaattcaatgtcttaacactccatccaaatttatttttgtacttgacaaaataacacaaagttcatcatgaaaaataaaagtgaaaaatgctttgaaatgtttcgaaaaggaaaatgaatgagctggaaatagtattatctatataaaaatagccaacaaggctgtactagcttaatcagcttgacactagagaaccaatagattgtgagagaatgttcccagattctccagattcagaggtaatactggcattcaaatcattgggaaaagagctttttcactaggtggtgccgggacaaggtactaactgcatgcaaaaacaaaaattggatggtagtctcatttctcttaccaaagtaaattacagaaagtaaaaattaaactatgacagtttgaggaaaaacatgagtgaatttatttaaaattttggaattagtggaaagtctttccatgaaggacacaagacacagagcacaaaagagaaaacattaacaaatctataaagttacaaccaactaaaaaaaaatctgaactaataaaaatacagtctaaacatgtgacaggtcgagactaattttcttaatttgcaaaattttatacaaattagtaaggaaaaaatacacttaacccaagggaaaatggacaagttgctgaaaaagaaatacaaatggacaataaaaacgtaagaggaccatctttgccttcctaattaaagaaaggcgaataaacaataatgagatgtcatgttttaatcaatcagattgatagcagttaaaaaaagttagataatatccagtgtcaaatgaggatccagaaaaatagccactgttaatacattgttgcttgaggtgtaaattggctcgacctctttgtcagacatttaggtcatatgcgcagaagtctggaatatacatttcttcatgactttgtgatgcctctgatgggaatttattcaatagtatattcacacatgttttctaagatgtactagcaagaatgcttactgtaaaacatacaaactgaaaatactagaaatgatcacataacggacctggctgaaccattaaggtatatggcacaactgctgaaaggctaaataatcttaaaacatgaagcgtatctcttaatcttaaaacatgaagcgtatctctaagtgcagatatgaaaacacctacaagataaatgacgtcatttaaaaattaaagtgacgatcactgtgtataatgtggttcattttgtataaaaaaagactgtgtgtgtgtgtgcatgcgcatgtgtgtgattaaaatatatctggaaagaggtgagatattgaactccgattgcctttgtgtagaatacttgttctcagatttcagtgtgcatcacaatcaccaggaaggtttgttaaaacccaggtccccaccgtagagactctgattcagtgaatctggggtgaagcctaagaatttgtatttctaacagtttcccaggtgatactgctgcctctgttccaggcaccacactatgtagaccctctatggagaggaactaggcttttcacttgatatcttcctgttcatttaatttttagaaatagtatatgtatttcttttgtttttcctttaagatcaaaagcagcaatctgaattgtaagattctggggcattttaattttttctttatacttaatcacattttaaaaagccatactgttaaaaaaaattctaccaaataagatcaaatccactgctttttagttgctccttaaatattttgtttggtaattcatttccttaagaatagacttagtgaaatattaaatttttcttatatgtattcctcctaggtagatccttgtatcataatttgaactcagaagttagattggcttgtgtggtatgccaagaaataaaaatattttaagaatattggggatttacattattttatattatatataatatatatcataacatctatattatataaataaatatataattttattatattatattaagaatggggatttacattattttatataatatataatataaaaattagtggcaaatataaaagataataaaagatattttatatataatatatttaaaagaatgaaagaaccgtcaccattttctgtaaaataagaatgacaatatgcagcatgcaacagctatcatagagaaccacttaagatgacagacaacatggcaaatccttaaggaagactcctggcattgggatatgctgtcttatttgtatttctgttaatacagctttatgattgcattgcatttctgggtttgaactttgtaaagatttagagcaataacaacaacgacaacaaatggattgtccaattctatccactcctttttttcttttagcaagtcatattcctgtaatcttctcttgctattatttttcttttgttaagatttatattattttttatttattcagcgttcattatatagtctcccttaggagcactgaataacacatacaaacaaatatgaaatagctaaaaatttgaatccctgtcttgccaaccctcatatcttcagctggggcagaaaacctgagcaaacaggcattgcactagaccgtgtcggcagcaaagcaagctgtagtcaggttcccaagggaatgaattcttatgttttgttttccataccaagaccattttttctcctttcccctaaagatcaaatctggtggttcattagctattctggctgatctcagcttcctctgtgcatgctcttgtcttcccatccccacaactccaggggtttgatagaacaaggttaatactcggaatcacggtcaggagcaaattgattgcaagtggaggatgtaaagcttgtctgtcaccatctccttatggcctcaagttaagcaggcggtttgcatcaagtgaagctttaaaagtctcttttttaactgacatccgtaacagagaacgctatttctctcaaaccatatgccactaacgcctgattagctatgatcagatagaccgatagatacactattaaaaagaattgaaccccgtggctagttcctatgaatgttgaataagtaattaatgtcttcctctttcctaccccccacccaaccagtctgctgttatttaatttaacaagcatttgacggagcatatcttgtatgctaggtaggtactaagaaaagatctccttgtctgcacaattccaaaagttgccatttatatggattttaatgtgaatagtgcccccagggagttgtgcaattgcaaccttcctagccattcatgtcactaagctaggccaaaggagggggaattgttgtgacgagttataagacatcatttgtgccttgtcagagttcacataggagaacggttagtggggaaagaggtacagccacaggttactataagtcataaatcaagatacatttatgtttctatagatatctgactaaaggggtgtgggatcagcaatgagggtgtagtaaattctgcttgggatggggtgcaggaatcaagaaaggcatcaaagagaagacgacatttgatttgggcgtttgagaatgcgtcacactcagagccaaggggagtgggagggtaggccatggtgtagttggaaataacaagaatgccactgttgcccgccattgtctggagtgaatgccagccgggaatcatttaaacactttctcttgtaatttgaaggacacaaaccatggcttctctctcagtgaaagaccattattctctaaattgtttaatctgtagtcccgatttattaagatatgtgtggcttgtcttgggagtctgagtaatcactgacattgtataggggaatacatttgcatggcattataagaatgtcaagttgtctttcaaaactgagtatagataaaaggctcaccaatgcctgggccatctctgagtgccgactgtgggaacatccgttggtggcattcgttctactgtatgcacacatttcaatcagcccaaaaggcctcctgtccacagaaggctggacagtccttacctctcactcataatgccacattagcatttctattctcatgctctgtggtcataagaggctgggagatcttcggagagacatttctcaacctgtagacacaaaaggggtgctttgagctctttgaagggcagcatttcagtgggggtgcatctgttaaaagactgtgttgcaccccaacacctctggagactgaaagggaagcaatttgggatagcagaaatggacgcaggtattaatggaaggagattgtaataaggaatgtaaagaaatggaatacacatacactgccttatctgagccattttccatagtggtgttaactataagaagcccacgttaatactctgaaaatctatccccttcaatccctgcagctatacttcctgctaagacgcaaggcagatggacacattttgaggctcaggccaaaattcattgagctctctaattttaagaattttgaactttcctaccacacacacacaaattttagaagtcttttcctcttgatgtacacatttgtttcaagattgtgcctttcaaaacctttgcacgtaacaaatagttttgagtatgcaattaaataaagaagttatttaatattagctgtgattgaatgtgcaggctctaaaatcagattccctgggttgatatgcacagtatgccaactgaaacagtcacctctcttaatggaccttagtcttcccctctgagaaacagggattatggtcaaaagtataagaggtcatgtcagcagagtgccgggcatttggcaaatgctcaataatacttagaattattatctcctgaaaatttctttggtgtcagatgccatcaaatgtaacttctaaataacatgaaatgagtactggtaacagtgaattgacacgattctagccaaaagcaagcaaacttgacttttcacatagtttatagtatctcttcaaggccaagtttgctttgtgagattcactttttttgaaatgttgagaataacatatatatttgaatgcctgttatatatacgagctaggagtgtgtttgactgcaattaatagtgttctaaataattagcagtatattttcttacgtatcaaggtaggagtttgttgtccttgatttaggtgctcaaaaatgtccttgaggaaccagctgtttctgtcattttcttctagcaacctgaccttttagggttctttttttgtttgtttgtttgtttgttttgtttttgagatggagtctcgctctgttgcccaggctggagtgcagtggcgtgatctcggctcactgcaagctccgcctcccaggttcacgccattctcctgcctcagcctccctagtagctgggactacaggcctccgctaccacgcccggctaatttttttgtattttttagtagagacggggtttcaccgagttagccaggatggtctccatctcctgacctcgtgatccgcccgccccagcctcccaaagtgctgggattacaggcgtgagccaccgcgcccagccttggggttctatctttatgctagtgaccccatggttacaaagtagctgtgatatccaggcctcctaccagcatcacaagccaaaaagagctcaaggctcatcatcggatggtcattttttatcagcaaagtaaaagcttcttagatatatccccagcagagtcttccttatatctcatgggctaaaactgtcatgtagccacgcatagctacaagggaagctggaaaagcaagtaaagaattatcctgagtagactaatcataatctaccaactaagggttgggatgttgcagccttaaaaataatcagggttctattagcatagagcaatggttctcaaacttcagtgagcatcaaaatcacctgaagggcttactaaagcaaaattttgagtcccactgccagaatttctaattcagtaggtctggactagggctcaacaatgtgcatttctaacaagttcccaagtgatagtgatgctgttatctgggatcacactttgagatcttctgtataaagtcacagactttttctgtaaagagtcatatagtaaatatcttatttttggaagttatacattctgcaccagaaatttcagtgcaaaagctgccatagacatttcatgaatgaatgagcatagctgtgttttgctaaaactttatttacaaaaacagatgtgcactggctttggaatagaggatgatagaaattaatactgcatattgtttcagttattgtggtagtatagcaaattattccactttatgttcatgaattcagtgaattatgaaagagcacagtggggatgactcttccctgtcccacaatgtctggggctttaggtgggaagatccaaatgcctgtgattgggtgcttggggactggaatcagctggaagctccttcattcacatgtctggcacctcagctaggatggctaggatacccgctctgccctgactctggatcagaacacctacctgttgcctctctttgggactgagattctcacagcatggtgtctgagttctaagagggaaactgccaagaaaaccagggagaggtttatggtcttcatggacctgccctggaaagtcacgagcatcacttgcatctcattctattggtaaaaagtaagtcacaagcctgctcaaattcaaagggagaattaaacttcaccttgacaaggaaatgacatggtcacattatagaagggtatgtatgatgggagatattttttgtagctacctttggaaaatacattttgccataagcagacacataccaatgtctgttgcctccctcagacagattactgaggctctagatacctcattagaagcctgtgtcccagcatcagagcacagaatgtaggtctatcagagcatgatatgggaggatttctgggtatgaccactaagttttacctggccaatacaactgcttttctatggccccattgcctgtctagtcagccagacagtattgattttttatttcagcaggaccttggctaggttttcggggatagaatgaaaacaaatgaacaaagaaagaaacccggggtatgtatcatccatcatccaacatcattatttagcaaagacctttaatttcttttgtgtgtaagagtaatgccaagaactgccaagttcaaggcaccaactcttctcttcaaagagcttatgatcttttgggaaattgggcctatagttttaaaaaagataaatatcaatgaagaggcatctggtatgtcaaaagaaacactttatattgatatataataattgtacatatttatagggtacctgtgatattgggatacctgcacacaatgtgtaatatccctcacctcaagcgtttatcatttatttgtgttgggaacatttcaaatcttctagctatttttaattaggtaataatttatcattaactagagttattctaatgagctatcaaatgctagaacttattctttctatctaattctctaatatgtttgtacccattaaccaacctcccttcattcctcctcccacccacactttccagcctctgggaaccatcattctatccctcctccataagattaattttttagcttccacatatgagtgaaaacacacagtatttgtctttttgtgtctgggcgatttcacttaaaataatgcctccacctctattcctgtttcttgcaaataacagaatttcattatttttatgacagaacagtattccattgtgtatataaacatattttatttatccattcattcgttaatggacagtaaggttgattccccaccttgactatgttaacagtgcagcaataaacaggtgagtgcaggcatccctttaaaatatttgatttcctttccttttgataagtaatcagtagtgggactgctatatcatatggtagttctgcctctatattgttttgcataatggctatactaatttatatttccaccaatagtttataagagttcccttttctctgcatccttgtcaacacttttttttctttttctttttttcgtctgttcatttgataatagctacgctgattggagtgtagtggtatattattgtggttttgatttgtattgccttgatgactcatgatgttgagcaattttcatatgcctgttggccatttgtatgtcttcttttgagaaatgtccattcagattttggcctgctttttaatggaattctttgtttctttttgctgttgagttgttttgagttctttgtatattctgggtattagcagcttgttgatagtttgcagatattttcttccattctgtaagttatctcttcactttgttgatagtttcctttgctgtgcagaagctttttaatttaatatggtcccatttgcctatttttttgttttttgcctgtgcctatgaagtctgagccacaaagtctttgcctagaccaatgtcctgaagcatttcccctatgttttcttctagtagtttttatagtttcaggttttatatctatatctttaattcattttgagttaatttttgtataagagataaaggtctagttttattcctctgcatagggatattcagttttcccaacaccatatattaaagaggatgtcctttccccaatgtatgttcttaatgcctttgttgaaaatcagttggctgagccaccccgtccgggaggtgaggggcgcctctgcccggccgcccctactgggaagcgaggagcccctctgcccggccaccaccccgtctgggaggtgtactcaacagctcattgagaacaggccatgatgacaatggcggttttgtggaatagaaaggggggaaaggaggggaaaagattgagaaatcggatggttgctgtgtctgtgtagaaagaggtagacatgggagacttttcattttgttctgtactaagaaaaattcttctgccttgggaacctgttgatctgtgaccttacccccaaccctgtgctctctgaaacatgtgctgtgtccactcagggttgaatggattaagggtggtgcaagatgtgctttgttaaacagatgcttgaaggcagcatgctccttaagagtcatcgccactccctaatctcaagtacccagggacacaaacactgcggaagtccgcagggtcctctgcctaggaaaaccagagacctttgttcacttgtttatctgctgaccttccctccactattgtcctgtgaccctgccaaatccccctctgcgagaaacacccaagaatgatcaattaaaaaaaaaaaaaaaaaacgaaaaacaaaacaaacaaacaaaaactggacagtggatggtatcccaggttgaagaaacagcagaaacaaagactgggagggagtaatgtacaagttgtggtctggatagttgggctggagcagaggatgctggaggaggctcagcagggcaggtatgaccgtcacagccactggctggcactagccaatgcagggttcttctgggaactctggggtcctgaaactaaggcagctgaggaacttccagaatgctttaataaattaatatcaaacatgaaaaaaaaaaaagaaaatcagttggctgaaatacatggacttacttctggagtctctattatcttccattaatctacgcatctgtttttataccagtaccatggtgtttgggttactataggtttgtagtatattttgaagtgagattgtatgatgcctccagctttgttctttttgctcagaattgctctggctattcagggtcttttgtggtcctatataaatttaaggcttttggtctatttctgtgaaaaatatcattggcattttgataagcattgcattgaatctctagatagctttgtgtagtgtggacatttttattatatcagttcttctgattcatgaacaggggatgtctttccctttgattgtgcccctttcattttctttcattagtgttttctagtttttattgcagaagtctttaacattcttggttaaatttattcctacatatttccttttattttattggctattataaattgaattgctttcttgatttctttttagctaattcattgttggtgtttagaaatgctactaatttttatattaattttgtatcctgcaactttactgaatttgattgtcggatctcagagtttttcagtgaaatttttaggttagtctgtatataagatcatatcatctgtgggaagggacaaattgacttcctctgttttcaatttggatgacttccatttatttcccttgactgattgctctggctagaaattccaatactatgttgaatcagagtggtgaaagtcatcttcctattgttctagttatttcagctttcagcttttcccccttcagtatgatgccagctgtgggtttgtcatatatagcttttattatgttgagctaccttgctactatgtataacttgttaagagtttttataatgaagggatgttggattttattgaatgctttttctgcatctattgagatgatcatatggtttctgtccttcattctgttgatgtgctgtatcacatttatttgtgtatgttgaactgtccttgcatccctgggataaatatcacttgatcattgtatataaagttttcaaataaacaccctaatgatgtaccttatgtttaatcccttaagatattaaaaaagcaagaacaaaccgaatccaaaattaacagaaaaagaaatagtaaaggtccgagcacaactaactgaaatcatgactgaaaagcaatacattggatcaatgaagtgaaaagtcgtttttttgaaaagataaacaaaataaataaactgctagcaagactaatcaagaaaaaagataatatatccaaataaatcacataagaaatgaaaaatgagacgttacaactgatacaacaaaaatacaaagaatcattagaaattattatgaacaactatacgctaacaaactggaaaacccagaggaaatggatactttcctgaacacctacagtctaccaagattaaagcaggaagaaatagaaaacctgaacaataatgagtaatgagattaaattggtaataaaaggtttcccaataaagaaaagcccaggaccagatggcttattgctgaattctaccaaagttataaagaaaactagcaccaatttttctcaaactattccaaagacttaaagaggagggaattcttcctaactcaccctatgaggctagcatcactctgataccaaaaccaggcaaggacacaataaacaaagaaaaatacaggccaatatccctgacgaaagatgcaaaactccttaataaaacatcagcagagtgaatccaacacatcaaaaagagatacttttgatggctttaaaatgaagctgagattcttctcagctggacagtggaaaaagctaccctagtgtaggattttattaatttgaaccttgaaaggtaaaaagggatggatgaaaagaaagagaaaatatatttcaaataaaaagtgcctgatgatgaaagggtgggacactattggtctcattggagttgaggaggagatcattatgtcagaagaaaaaatgtgtattgagaatgggaaataacattaaaaataatggtggtcactctgttgaaggggctcctacataacatttaataatttagtgatttcccacagtgcaaggcctgggatgctattgtctctactgttctatcttccttctccactagctatttcttacagggacattctgtcatggtgagctcagggcctgcttgtccttctgattacaccagtcataacaaagagtagaccaggcttttccatccaacacactcatcaaagtccattacactgaactttgacatagcaatgcaaatagagacgaaaaacaacaataaaaacaataaaattctagtaaaaagccaaagataaattgctcttaagcacctactctggttattctaaaatgcttcccaatgtttctttaaactataagttcttagaattagggaaaaagcagtttttggtttaaaagattttagactcccaaagaaatgtgtaagcctcattttagaagtttcgagtagatgtttgcacctaatttaatgtgctaacccagtctaatgaattgagtatttccccaactcagtgcttggcttttggatgatgaagtggcttaaaatcatgaccttgagaagttctattccatcagatcaggccctacttataaacttcttaaagttggcatttgatacatggagctattgtgagctgtgctgtgacaacatctttggatggttttttaaattgtagagtcctaaaaactggcttggtcaccaaagcaatacaaatgctgtccttatgtgtatacgaaatccttatgcttgcctcactttgttttaaaggcacctaatagtattctgcttaatacttaacagtttgacagaaaagttcatttcaatcctataaatcaatgacctttctaattacaaatattcactgattctgtaaacaatgacaaactttcatttgaataacattttatagtacatttttctatgaaatgtgaagtgctttcaaaaggttgccttatgccatggtaataaaaacgttttagagcatgtgcgttgtcaaaagtcactaaggtatgttctttgtagaaaagcacacagctgagagtttacagtggataggactctgccctatcccacccacacatctaggtttcaggctgtgtctgtctggagaaatgtgtcagtgcttacctatatctctttggcactccaatctcatggaagccagtctgctggcttccaactgcaaatacctgtgactctttgcccaagggtcatctttccctgttacagcccatttagcccaggcaagaaaagccaggaatttaatatctcccaccttcccatgagtggctttcaacccatgatcaatagggatgattcctgcatgcctcagctcccctgaccagcagtgagataacgccaagatattttctacactgtctcccagagcttcccagtaagattgcactcgcgttgcccacagtggttacgtgctgaacaatgcatccttattgactcccttctctatctcacttttcaatgtccctactggtaattcccaggatcacttcccaaataaaccatttatacttaaatctgtgtctttggggtctgtctctggggaaatccaactcaggacatactgagactgattcccacaaaggcacagtgtgggttagctgcagatgttgggatctgagaagctgaagaactggatagaatgggcaatgatgtagaaccactgtaggcttctgaacaagagaagggcgtgttgttaaaggaaaatgatcctcgcttttgtctacagttcactttgcatcaaggggaggggtgtggctgggaagagcctggagcctagggaatcgagttttatcactattgttatggttatctaggggcaggtaaagagaggttggattagtggagaggaggttaaaatgaaaataaggaatatttcttttttttttttttgagatggagtttcactctttttgcccaggctggagtgcaatggcacgatctcggctcaccacaacctccgcctcctgggttcaagtgattctcctgcctcagcctcctgagtagctgggattacaggcatgtgccaccacgcccagctaattttgtatatttagtagagacggggtttctccatgttggtaaggctggtctcaaactcctgacctcaggtgatctgcccacctcggcctcccagagtgctgggattacaggtgtgagccaccgcatctggccaaaaatacggaatgtttctaaggtacatgatggagaatcagtgaggattgatgttgactgagttggtaatggaggagcaaagaggagggaggaagcaaaaataacagtcttggagaactgggagtatggcagtgcccttagcggttttgatctatgtctaatttgtagcctctgcttacagggtaatatttattggtcttgagaatttcctgaagcaaccttacagttcatcagaatagggctcatttctccaaaagaacagaccctgtgaaacctctggagatatagtcagtatttcatatgagtttatggatttttcttcagccttccaatacatataaaattacttatctctcttttctctgcactgaaatcctccaacatgccttttccctgagtgaataaaaaacacgagcttttcttaacaatagaccttctaatgagtgagcagagccacatttttagtatgtccaagtcagaatctgtttaacaattggtggccgtctctcaacattgcagctagtgacagcctcatttacactggttcaatgaagatactgaaatgttctcggccagacagtggaagtgaacttacactttcaccagtcctcacttagcacagattttcaagccacttaacacctttcaagtgtctgaaagctaatagaatgctcaacacaaggctcccctgacttttacagctgcccagaatttttatttattatatgtctgtgattatttatttatttttgctaagaagaaaacagagtgatcttacacactgataactgaggaagcatttcacagctggaccttatgtttttttttcaaagaacagagttctctgagctctaaacaaaacttcttatcagacaattaccaatatattttactattttaattttgcttttcagcttattgattaaatattcagtgtggaggaatgggcattcagccttaaaatgatgtaattttgttacatatgaaaacagcaaaggacaatatgtcactatttgaatgagccaggtgaaaagaaactctatgaccttaattcggccatgtggataaggggttctaaaaaattgaaaggagacgtttaggaaaatttgctgaaagaccaaaagaacaataatttcctagggtgataggtttgagctattttctctccaccctagaaatgagccaaagatgtatttacccactgaccccaagaaaatggctgatctccagttggaggagacgaggatctttgcttggccttgttttatggatggaatttttaatattccgtccatacaaacctatgcatgtatttccagaacatttgtgatgaaaaggaaaaattatgttcaccttgataaggtttcttaatattatctcttccactggagaatccagctgattacactgacttccaccaataaccaagctccaactacgacataggtcccaggagtcttaggtagagcaggcaggtggatgaagttggcttgagaattttagtgaccaaaacatggccttcgttaggctatgattttggtgactgaaaaaataataaggctgtggatcattatgtgggccatcagggaagtttcaaagaaagaaccatcttctgaattcattgtgggtcgtattttgtcaccttcttcctactttagtacatacacacacacttctccaagttagaagattcgagttgaagatataagcctgcactatctaattcagttcccacaagccacgtttgtccattgagcaatgggaatgtggtgagtgcagactgaggggtgttgtaaaagacactgtgaatttcaaaaacgtaatggcaagaaaagaaggtaaattagctcattaataattttttatattgattgtaagttgaaatgataatgtttggatatattgagttaaataaatataaaattaatttcaaatttctttttatttcttaatgtggctatcagaagattttaattacatatgttgccaacataatatttctatcagaaagttctggaaataagggacctaagtgcatgtaagggaggagaccaccccttatattgtcttatgcccaatttctgcctccaaagaaagaagaagtaaaaactaaaaggcagaagtgaaatccacaagcagacagcctggcgccacaccctgggccttgtagttaaagatcgacccctgacctaatcagttatttgcataaaaaagcactgtgaggatccctgtcctgttctgttctgttctaattaccggtgtgtgcatcccccagtcacgtaccccctccttgctcaattgatcacaaccctgtcacgcggacccccttagagttgtgagcccttaaaagggacaggaattgcttactcggggagctcggctcttgagacaggagtcttgccgatgctcccggccgaataaaccccttccttctttaactcggtgtctgaggggttttggctgtggctcttcctgctacacatggactgattttcctcttcttcattactttggaaaataaagaaactgaacttcttacttgtaattcatctgttcacccctttaattcacctaacaacattgtacctatgaatctgatataaaatgatgcccataaacccatataattaataaggccagctacttagaaatgttagttcataaattaaatagctttacatatgtttttgaattctacatgcatacacaaaatgattaagaaggtatttattttcttataaattatgaaaattcatatatttcaacttactattttacttataaaagtatgttctattattttattatttgtgtctgttttttccactaaatttgtttcattaataagctaggtttttaaaaacacaattatcatttgacagatgctaaatatctgatttaaatgatacataataagaaataaaggatctagtctcaaagtaaataatactaatttgtaaaagcatctttgtgacatttcagtaatatataataaaactgtattttttaatcaattaggaggctcatattccaatatccctaccctaacacattggcttgggtagaagaattagttggtgagaacagagtcgttgaacaaacagtgactagccatttcccatttaagttgggaactcttaaaatatataaaccattatcctaactatggaaatataaggacatatgcacaaagcatatgtcctctacttccaagaaagcataatatagtagagtggagaaacagagatcactaagccgacaagaactatcactcttatccagatcaatgtactctttttctacatagcagccattttctatgtagcagtcatcatgattttgttaaaataatcatattttatccctcccacttctaccttttaaaatcccaaagtagattttcagtgcacttataataaaatcttaccataacctgcaagacactgcatgatgtgacctctgttgccttttccatttcactccctgtcccctctacccttcacactcaactctccagctgactgatgcctccaggtctttgcctctggtatccctcatcttagtctatttgtgttgctataaagtaatacctgagtgtgagtaatttacaaagaaaagaaatttattagctcacggttctgcaggctgtacaagaagcacggcttcagcatctgcttctaggaggacctcaggctgcttctactcactgcagaaggcaaaagagagccaatgtgtgcaaagattacatgacaaaaggagaagctagagctagtatgtggggaggtgccaggctcttttaaaacaaccaactctcacaggaactaatggagtgagaacccagttgttacaatgagaatgacaccaagccatccatgaagggtctgcccctctgacccaaacacctcccgttaggccccacctctaacattggagaccaaatttcaacatgaaatttggaaaggtcaagcatcaacctattgcatcccctttgcctggaactctctcttaaagcttaagaataatggaaaatacagggagagtcagtcttgtgggcacatctgagttgccttctctggccaccctatctttttttttttttttattatactttaagttttagggtacatgtgcacaacgtgcaggtttgttacatatgtatacatgtgccatgttggtgtactgcacccattaactcgtcatttagcattaggtatatctcctaatgctgtccctcccccctccccccaccccacaacagtgccgggagtgtgatgttccccttcctgtgtccatgtgttctcattgttcaattcccacctatgagtgagaacatgtggtgtttggttttttgtccttgcgatagtttgctgagaatgatggtttccagtttcatccatgtccctacaaaggatatgaactcatcattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcaaggtaatttatagattcaatgccatccccatcaagctaccaatgactgtcttcacagaattggaaaaaactactttaaagttcatatggcaccaaaaaagagcccgcattgccaagtcaatcctaagccaaaagaacgaagctggaggcatcacgctacctgacttcaaactgtactacaaggctacagtaaccaaaacagcatggtactggtaccaaaacagtgatatagaccaatggaacagaacagtgccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctacacagcaaaagaaactgccatcagagtgaacaggcaacccacaaaatgggagaaaattttcacaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggccaccctatcttaagtagctcccctgtattcctgacagtgaccttgtatctcactttcctatttaattttctttatattgctaacaactaccccaaattatcttttactttaaatttacctagttatttgttgtctatcccttttcatagaattaagaacacaagcctgatctcttttatttgatcttttttttttccccagacatatcaaaggccctcaataattaaatgctggctgactggatgggtgaatggataagatagtttcataagtgtaaaggcagagagaattcagagtaggggaggaaatagagatggtatctaatccagattagaagttttctgaaggatatagtacgtcagctggtacatatgaataagcgggaagtggccaggcaatcagcaaagggtttaaacttctgggcaaaagagcaagagtctggtggctaaaaagaggctgtcatgctcagagaactactaaaagttgagtcaagctgcagtaagaagtgggagtaatgctgagacctgaggacaggtagccaggaaggagcccaccagttcataagaggcaactgcatgagaagcctgatttggatggtattgtaaccccaaatgtctgaacgttctgcaatatgaagcatgctttgcatgtcagcttgcttactccagctcagtgtttaagctgcttatgagattgtaaactgaacaaaatcagggccgtcccccaccccttggattcttctttacttataacacaatgccttatacaaggtgggcttccagcaaatgcctattgagttgaattgagtcctttctcttattatttttcacactgttatctgaactgatatttggggctgtctagactattctgagatatcacacaaagtgcaagaataactcatgctccattgatcctccataatagttactttgaataaatatggaggacggacatgcacaataaactgacatgctccacagcttttgactatggaagaataccatactgacaataaagaaggcccggaagggagctttcagagatgtggataagatatttctcccccttgagttgaaacaggaaaagggaatccagttcttggtatattggatttaaaaaaaaaaaaaatacactcgtctcaaaagtctgcatccttgcaagaattatcaattctgaaatgcctgttcattttccacagattagtcttcattagacacaattttagctaggtattcaattgcatttgtttgagtaggtaagtagaaaccaagtctcagtgatcagaattttagtacagagctaacttaagttgtttgcttttgtctcttcaacgttagaaggacaaatggtgccttgattttacaccacttcataaataattttctagagccacattttttacaacagactgaaacaaacaggcctagatctggttctgattattatgacagagaaatgtgaatacaatagagaaatgacatattaatcatagtgatgtttgatatgctcacttggaatgtgaactaacaggttcaggtaccccagaaatatctcaaagacttcttttatagggctgattccccccttattatggaaagctatatttttcctatatattttattaattccctatgtctttatttcagtgtagaacatattcctttaatcattagcatgcaccaacccctccccaaaaaaagcacaagctaaagcaaatttatagaaacccaacttgaattctaactcagcaactcaaaaccattggacatttctaaattttttatgtaaccatgacttcatctgaaattctgttgcttacacgtcttgctacttcttaagctcacttttctaaaatgatgaatgctcatataaaaggcaaaacaaggcagccctgtagagacatgttaagtctacaagtcaattgatttcctatgagaaacttttgagctagggaagcagggactcaggaaagttttgtttcttgttagatgccagctgaatagaattaaatatattgtcacaccttgaatattaaaatatcctggctggatgcagtggctcacacttataatcatagcattttgggagcctgaggcaagaggatcacttgagctcatgagttcaagaccagcatgggaaacatagtgagatcttgtctctataaaaaatattaaaaattagccaggcatggtggcacatgcttgtgatcccagctacccaggaggctgaggtaggaggatcacttgagcccaggagttcaaggcttcagtgagcagtgactgggccactgcacttcagcctgggagacagagggagagatccccgtctcaaaacaacaacaacacaatatcttgaacttcagatgttttaatagagacagtgtgatacatgtgtacatagggaagaaactagcccacggagttcactattacataaaacagcatggtttacctaccattgcttttattaaaagtttttgtttttccatgttcatgttgtttttggaaatatattgtaaagtaatattgtcaagtaaataattttctcaagggaaaaataacaattagaaaagaggtaagacccctttgctctgatacccttaaccaagttaattgaggagagaagtagaaataggaagagaagaagagaggaaggacagaaaaaaagaaaatatatgagggtaaaataacatcactgcaggagatgttgcccgtgccctgttcacattggaccttaacactttactatgctccacacaatttttagcttccagtatctgcaactctgttgcaggggttcttttccattatagtggaaaccttcctggtcagcagaagactactctgcacatggcaggctgccagtgacaagaaattaacatcccttaaaacctttccctcaatcagtgattctctagtgtatcaataccccagctcccctcctcttggctgccataattctaagctttctcttatacaccacatctcagagcttctctgtagcagtaagctccagtgacccattgtagtagctggcttaataattcacccattattgattgctttgcctctctgtgttacttcaccactctttccatgctccctgggatcacctcctaaataaaccatttgaacttatatcctagtcttaacactatgcccctggtggaacacaaataagataactactatttctgttcataacagtttgtccttggactccattcattagaattgtaatggcttctattattaagacctgtacaaactttttcatgatactgcacttacctgggttatgcattctccctgctttcttcaatatccatcacaggtgtttcataaatattttctgagtgtagactaattccaccagtgcaaagcttttgctacagcacagttctggcacacagtctgtgcttactaaatgttttatcagatgaagtgtgatgattatgcctttggcagtggaaaggtctttattcaacttttaattatgtccagaagaatggcagaatatgtagtgtttgcaaccatctggttgaaatccacctgcttacacaggtatttcagggcagagggggtactttatccatcttagcatctgggaataatttatcatagaggccaacttgcaaaatcagtcactctggatgcctcatccctttcaaatgaaaaggatttggcttcaagtgctggacatggaaactgagaatgcagtgactcatttctttaaaaatgtgaatatgagagaggaagatttttatcactcaaagtgcagcacggtgagagctcgcctgagttaggtaaaatgcacataacttattttatggacacctctctaaagtgccttaaagcttaaaggataaagaacccagtgggttttcgttttgttatatgccccaaggctgaaactctgtggcatattttaacagagtttttaaatggcaaaacaatagttctttttttttttaatgtagtctaaaataaaatggaactccagacctgtgtgcgacagctggtgttcatatgacactgttagatgcctccttttatcccaatctcagtctcccttgggtagacaagaaatgggagagaatagtcaaaagtaagaaacacttctacttgagtgacatcttcctgatcgtagcagaatgaaatattatgacagttgtccaggtagttctaagttttgaaattttttactaaaatattcagatataatggaagcaaggacttcctggaaaaattatctcctcaattatcttttttaagttgaagttatatgagtctgacttttagacttctagtcaaattatgcaacttttcttcttctgccagtcagcttgttgccactgataagtaaaatgggattctagaagttaacagggtttgagtttttttccatgatgttgattattagatttcaaaacttttaaatcttaagtttatttacataattagtcaattgtaacctgaatatctgaggagttattaatgtgtcaagctgacattatttaatcatcagaaaagctatctttccttccccagtccatctctccgtctccctctgcgtgtgtgtgtttgtgtgtgtgtatctctttctgtctctgtctctctctacatatattcattatatgtatataatacatatacatcacatatatgatcctatttggcctgacatactatacccataggactaacttaagtaatatgagaagagtgagaagagttcatggtaggaaggtcaatgaattgatatattgcaaattatctggtagataatgcagctgcttcttccacttagcaaataatgttttctgtaagtgttctgtgatcaagacatagcctgcaatgacttttgtatgctaggtcaactccatcgaacccccaaattgtactggaatcagactttttcattaattcatgcaaaccagcctgaattctactggcaaccatgaaacacttacctatccatacatggcatagtcttcgaattctcatttgtttctgattttaaccaaaaaaaaaatagattttcatcatttacaagccatagcaatacacgttgcagtcactaagctaaactcattacatgcaagtagattaatcattcatagaccttatagcttatcaaaagaccttgataactcccacggcttcttccttctgctccttcgatatttgacaagcaaacttatatctgatactgatagatgatcaaccctcttgttagtttgaccccaggcagcaggacttcattagctccagtctgtactaggcattacgatggtaagtccagatgcaaagaaaggatatagcaggatccctgtctcccatgtacttatggccttgctggagaaagaggactttaacctgtaaaagaccaagacaattttgtgaaaacagatagaaactctggtagtgataaattgataaaccctgatggtagagactttgtctaatggcttaaatgaggtgccatgttcgtgccagcgagaattcaatacctacttgtccacgcacaaaaaaaaacgatgctcgttacctgatctcatggagttcaatgagagcggaggctaagcctttgtaagttctcaagattcttctcacaagttgtgggctcaattaacatgtcttgttatagaacttttattggttggtgtttgatctggttatccatactgtacacaaaagtcgctgtcagctgaagagggaatgcttcaagtactcagttttctcttaaatcaaagcaaagataaacttcttataattatttttctgcaaaccaatttataaagcgcactcatcccaataataagtgacaagaaagaaagagataggctgtgtttatttgaaatatcctactattcctctgatacagcactgttgttagattcctttaggaaatattagaatctttctcacaattgatcagcctccctgaatgtgcccaccaaaaaattagttcttcagagcagattttgtattggcagtttgctaaacacgatactttcttctgaaactcacttatgcaagcttgaatggtatctaatgagttcataccaaactatgcccaaaatgaaatccaagcctcatttctgacataccattgttcaccatgcccgatatcttactaagttctgttaatttttctttcctaatgcctctcacaactgtttcttctcttaatccctggtgccagtatcttaggttagaccaccaccatatctctcctggatcaccaccacacccttctaatctctctgtctatatttttgccaccatcctcctctccatctcaccctttaaagtccagatgaaggttttaaattgcaattttaattgggttctttcctccctaattagtttcagaataaagcgtaggtgcatcctcagtgtggcctggcctggccctgcccttccttcagccttacttcttgtcattttattatttgaatgccagttacctactggaccacttcttgttcccccaaaagctatgctttctttttcctcgaggattttcatagcagggtctcttctctgctcttccttcatgccttggggaacccttgctcattgttcaggactcagcttacatgttttgtcccaccctgtggtggcttttcctggtccctcaaggctgttgctggaaaggggtcccaacctagaccccaagagagggttcttggaccttcctcaaggaagaattcagggagagtccaaagagtaaagtgaaagccagtttattaagaaagtaaaggaataaaaaaatggctactccatcagcagagcagtggcatgggctgctcgactgagtatacttatagttcttttttgattgtatgctaaacaaattgtgaattattcgtgagtttcctgggaaaagggtgggcaattcccagaaccgagggttcctcccccttttagaccatctagggtaacttccagaagttgccatggcatttgtaaactgtcatggcactgatgaaagtgtcttttaggatgctaatgtattcgaattagtgtataatgagcaatgaggacaaccaggggtcactttcactgccaccttggttttggctggtttgggccagtttctttaccacaacctgttttatcagcaagatctttatgacccctatcttgtgctgacctcttatctcatcctgtgatttagaatgccttaacctcctggggatgcagcccagcaggtctcagcctcattttacccagtctctattcaggatgaagtcactctggttgaaactcctctgaaaagactggctttagtatcctgctgatatgctcctggagccagtgccctgtgctaatagattctatcacagcactgaccacgctctaatgatagcaattgttaacttgtttgtttctctcaccaagaagtcacgaactgtggctttttttggttatgcattccctgcagctggtactatgtgccagttcagcaaatatttgcttgacaaatgaagtcaaagccgtgaagttattacacaactagtaattggagaagcagggattcaaaagcaagctctttgataccatgtgacgcaacaatctctctgccaggtatatgcccaaagtagatgaaatcactaccttgtaaagatatctgcattttcatgttcattgcagcattatttgcaatagctgggttctgaaaacaacctgtaaattgatggatgaatgcacaaagaaaatgtggtgtaaatctgtatctatatatttatatatataaaaatatatatatttatatatacaaacatatataaatatttacatagtatagagagatatcaatatatattttatatataagtatataaatatatatacttatatataaatataaatatataagtatataattatataaatgtatataaataaataaatataaatatagataacatatataaaatatttatatatatttatataaatataaataagtatataattatataaatatatataaatatataagtatataaatatatagttatattgatatataaatatatatctatatcgatatatttatatgtcaatataggtacataaacatatatataaaatatacacacacaatggaatattatttagccttaaaatggaaggagatcctgccatttaccacaaaatagatgggcatgaaggacatttatgttaagcaaaataggccagatgcagaagataaattattgcataatctcacttatatgtgcaatctaaaaaaaagttcagatattcagagagagataataaagctatccaggggttgggaagagggggaggaaatggagagatataggtcaacagatacaaagtggcagatatatagaatgaacaactccagagactgaatatacagcatgaaggctacagctaataaaattgaattttggatttttgttaaataagtagatttttgttattctcaccccaataaaaaagaactgtgtgagatgatagatatgttaaatggcttcactgtagtacctattttactatctatatgtatcccataatatcatgttgcaaatcttaaatatacacaatagattttttttttaagcagctctttaaacctcaactataccatgctctatatcctaggagaagcgacactgtgtgctgaagcatgaatgggtacagttaaagtctttccattagccatcctccacccctctgcccgtcttttttctttttggcaggagtagggggtgggggcgaggacagggtcttgctctgttacccaggctgaagtgtagtggcacagtctcactgcagcctcaacctcccaggctcgagtggtcctcccgcctcagccccttgagtatttgggactacaggagcacaccaccacacccagctaatttttattatttttggtagagacagggtctcaccatgttgcctaggctggtctcgaactcctgggctcaagcgatccttcctccttggcctctcaaagtgctgggattacagtcatgaaccactgtgcctgggcccttctgccagtttttagtacagtagtttgaatatttttagaagatgggctgtgtgtctaactaaaacctaatcgagtgatttatgctaaaattgtacctattctcaatggcctgtcagaactgggaataagccctttaaaataaaatcagctttgatatatattttcttaaatgtgttcactgctatcttttctctgcctgagaattctgctaagaaaacctcccagcaaggatagcttgttttaagttttttatagtttctcccattgtcttttcattgtctctgtcactccttaagatgtcatctgagctttattaatatgtatttggtaatttgtattcatgctatatcaacatgagaaataaaagagtctctcagttttagacttcagagccccaagtcgcctgaatatatagccacctaaatatgttgtactcagcattgggactaagcccctgctgttcacattacacaatggagcacctttctgagaggctagcatttacctctccagacatgtgtgccatcaaatagatccacagacacagatccttggtcatactgcaaatatcttctctgtggtttgcctttttattctcttagtagtgtcttaatgaccataaattcttaattttaataaaattcagttcttctcctttatagttacttcgtgtatatatttccttaaagcattgcttgtcttcatattaagttgtacaatattttgtgtaaattattttaaaacatttcttcattttactattttatttaaaatgtagtttctaaatatccagcaattttcctcctttgttttataagtccctcactccgcaggacatattacaaattacttggttgtaatttgtatttctatttaatatttattataaattattagatattttaaaatttagttttgaagacaagaaagtatattgggtgctaataatacatttctgaccctgacatcaccatgatagctttgcattaaatacagtctgggccggatttggaaatgctaacttttagttttcttattgaaataaattgtatatacttgcatgtacagtcaaccctctgaatctgtgggctccatgtctgtagattcaactaaccttggattgaaaatgttcaaaaaatggatagtgtgtccgtattgaccatgtacacgcatctttcttgtcattattctctgaacaatacagtataacaactatttacattgtattaggtactataagtactctagggatgatttaaagtaacaggaggatgtgcatagattatatgcaaatagtatgccatttttaataagaggatggagcattgtggcttttgggatccaagggggtcttagtcttagaaccagtcccctgtggataccgagggacgactgtataccatatgaagagtgtgaaaactgcattattttataggactgcatctttcaatgtaatgtcaggacttgaactgtgcaacagttaggacactcaatctagagccctggaaagtacatgaactacattgaaattctgtcaaataattattatgcgattgctgtttcacttttagtcaagaagcattgaaaaaacaagtagcctcattaatcattgaaaacatcagaatgaactttgaggatcaggaatttagggacatgcagatctggtcaattggccattataatgatacaaattaaagcaaagtccagcagggaaaataatccagcttgaatcctgggatctattcttgtacctttgtggcgtacacttaccagacaacagatctaaaatgtggtgtgtatgttttacaatactatattaatataaactatattaatagtctctaagccaaatgatatgtgatacatcctaaacttttgtttgaatagttgaatttttctttattgttttcatggatagttaatgaaatagttatgataaaatataccatgtttgaagtcataacttaattacatttattaacaagaaatagtaatgtacaggaatgaaactgaaagttattgtgcaatttactattatcttttatggatagaactggttacaagtaacaaatgtaaatttttacatttgcatgtaagaagataagtcctaacagcattattgaatgataacattattgaaataactttaatttcactaaattgatccacatttgctatttatatagagagaagaccaactgtgatttttatatacatatttgaaattatccatcaatatcacatggaatattcaatctggccttttgcgggaggaagaaaggaagagattttagagactaggaaaggacagcaaattaggaaagaaaaccgcagatacagcagataagggaggaagaggtggattatctacctcagtgacaatttacatgctgaattatactaatttccctgtgttctgtgatgctcagtaaatgagactctgctgatgttcctataggccatgaaccagccggcacgttggtttccactacaacacctacaaataaactgctgagttaaaatctattatagcagagaatggcttatgacccacagacaatcattcctcttctaaatatattcacaaatgcctcataaatgtttgcttgggcattttatttagaagcaacatggataaatatttgaaagagtattgctaatgacaaagcaaaagtgaactataaaatagctttaacgatgactttaaaatctgcacttttcaaatcaagcactcactaaggaaagacaggaaaatataagatagcagcaggtgagctcttcgtgtgtgtgtgtgtgtgtgtgtgtgtgtgtgtgtgtgtgtgtgtgtctatagctgtctatgcgaagcaaatcatatttgcaaaataagaccaatatctgctgaatagaaaagagctgcattgaacagacatatctgccagaaaaatctggggttgtaatttaggttttatagtccaagaatgactagattgcttttaaaagcactacttcttcaatgcttttattccattctttgatcaaacatgtcagccaaggaagaaatggtcatttatttcttttgaaagcaggaaaaaaagagatttacattaaatagcggtcatcacggcgttcgtaagtttccaactatttatcaacatgcttggttcgcaactgcaattcacttaattggacttgcatcttcagtaacactgcagcttccatactggaggtggtagagttattctaagccatgggcaggctggtcaaatgtacatatggctgtgtaattgtcagaaaatgtcctcgtgtcagacggggccatggcttatagtgaaaacaatcctgttagtgcttctgcagcatatgaggagacagctccactttattagtgaaattacactggccatggatgactggctgtcttgatcatttacaggccaattgtgaagccactgatgaaatcactgggcagcccaatccaattcagtcattaagacaactggagtaaccagactgtaaaatggttggtctggttatttcttaatgatgtaattggatagaccagagggagatccaattaattgctgagcaattggtggctatggtggtctcactgataagctcagctgtcagtgatggacttgaattgactgtacagcttcctgatcaattgtacaagttactcttaccaagctgggggttggggagaattgatttaattttggtgatttcattgagcccactgataaatcacatatcttaagtgtctctctctctctctctctgtgtgcgtgtgtgtgtttgtgtatgtgaatgtgtgtgttattttctcaattgcaatatatttgtgagatatcagtgatatataatgctattttaagatatggttattttaccttgccagtgtatatttcattggaaaagtctataggctcttgtagagatctgtagggcaatttgttactttctagaataggaggggaaatgcaagcttgaatgaaaattatgtgtttagaaggcgggaaagcaaagtattttttcttcaccctttatgcccagtctgtgaagttcactgcatggttactgcagcctattcatgacatagtgatgctagatattcttctgctttgctgagtggcctgtgaaaagagcttaacaccagtgtagcctggcatgaggaagtaaatgattggtataatattttggggaacaaatatgcagccgatgagtatttcagctctcccccacccattaagagacactgtccatggaaatatcccttcaaagaaaagacttagttactcatgcaagctcttcttggccagggcctgtgtgaggacttaattcactatatccaccactcaaccatgcctggaatagacgctcattaatgtttgttgatttagtgaaggaatatgttcttaagataaatttctttctgagagttgatgccaaataagtataaaaaggtacataactgtggagtttttacttattctaagaaaataaataaatttatgagttggaagtgtgacttgttgaggtgatttaggccacctgtgatttttctaatgatggtccattgacaagtgccaatctttgacaatgttctcaccaggccaaagcacaatgagaaaaacataagaataatggttttgagagattaaaaatgtctgcaaattttttgtcatgccccccactgaaaggtggcatctctttccttttctcttaaatctgggcagcccttgtgactactgaaccaggttaagcctaaactttagggggactagaagcttctgcctcctatgttgaatgcttgctcttgagacactcccttccaggacacaggcatcatactatgaaaagctcaagccacatggcaaagccacacatagatgctctggtccaaggctgaagctgatctcccagccaatgccagctgacttacattgagacccattgagacccaagctgaactcagtccacccatccaattgtagacatgataaaatggtttttttttgttgttggtttttttttttcgagacagagcctcgctctgttgcccaggttggagtacagtggcccaatcttggctcactgcaagctccgcctcctgggttcaagccagataaaatggttttttaaagccactacatttcaggtcaagttgttcccagcaatagatagatactaatgatatgtattgaatatatactacaacaatgatgcatattctcctttgtaagaattgtcacctctgattttctgaggattagctattcagagacgctgtagttcttgctttcttggtgttggaatatcctttctttttggcatgatggctagagaagatatcagtgatgtatgtagatgtatgtttttaactggaataagaaaaagttgagattcatgaagagcagtcaatgttttcagcacccttcatttatctataaaattcaaattctctgcccaaatccaacttcacaccctctgcaggaattccccctcatccagggccatcctgaagattaccaaacttctgctcaacctattccagtggaaacaactgattcatcagaaggcagtgctgtctgcctttaaacatctgtgattataaagaaatacagtaatataaaactttgatcataaagagaagttttgcacagatatttgtaattcttaatttaaagaaatattccgatattgttaattacacacaccaacacatttgcaaggaatctctggacttcagatacctcacttcaaattgtattatttcacattattgttgttgtctctgataagggaatacgcatgggggatgggaagtggcagtgggaggtgttggggagggaaaggtgaaaaaacaccacatttactgaaaacatactatgtgctaagttctactgcatatgccagactctcaagaacttggaggttttagaagttctttaatgcagacatttccataaagatgtatgttttccctacaaatcaaacattttatgaataaacattatttaactcaaagctttttttaagcttttgaatggagaagaagtctcatctaccttgaaacattattgctatgaaattattttattccaaagtcaatggatttgttttttacaaaaagcttaagtaaaggcactcctgaacacaaattcttttatcaaactacttttgtcacaaaggtgtttagtataatgcgttataaattatatgagtgcaaaatatgaagaggaaaatgtgtctgtacaatggacattaggaaaaatataagtaacaaaataatgtgacgtgaagcttatctttgaaatgatacggcatttacttctaccatatgtgtttgctacggtccttctaaagttctcagcatttttaataacaaaaaatgtggctgacatatgaactttagctcttacagcattaacatattccagtactagtgaacagttaaaggaataataagtgaaataaggtgtgtttgtcattattagtgagaatatggagccctgaattatggtaaatagtgaactaattgccttaaaaatggtagaacttttcttttgggtagctgtttcttgaaagccattttcttccttagaaactgttttcaaaaactgccatcttcctcacagatataaccttcattccagcagtcattggtctataacaaagcttttcaaagataagaagaaaaactatggtagtacttcagtgaatgtcacttgactgcagactcatttttctaatttttcagaataaagatatccatgatttatacccaattcaagaggagactttggatcatttcaataaatattaagggagattatgtatataagatattatttagataaaaggattattaaatacctcagataccttttcctatgacacacctgttaaagaaacaaaatattctgtacaagtctactcttcataggaaataagatgaaaattgcaagaagtttcttcaaaacccacctgatgttctttgaaataagatgaaaattgcaagaagtttcttcaaaacctacctgacattctttgaaatggaagaaaaaaatgctatgtttacgtacatacctttagaagaagaataaatattattctccttgtccgttgcctttccctcttttgtttatagggatggggttgaggggggactttgggagaggtctccagaattaatgaatggaatcaatcatctagaaagttatcagcatgaactaaactcttaacagcagactgtggaggtgctgactacctttcatgctaattgactgccaaggcaccctaactagccatttgcatagggcattgtggtagatgtggctctgaaatgtgcatctccacagcaatggagcaagttcacctgcctgaagaattgacagagttgctagcccagaatgcatggcttctggagacttctcaggaatttcagctggatggtccagctcacttatcatactaataccaggttagaacagttaccttagaatctttgtacattaccagagaaaatctagaagtacaatgcttcagttagacaggaggaataagttctggaggtctattgtacagaatgatggctgtaattaataatgtgttgtgtatttggaaattgctaagagagtagattgaaatattcttatcacaaaaatgataaggatatgaggtgatgaatattagttagcttgattcaatcattccacaatgtatacatatatcaaaacatcacattgtataccataaatgtatctttctcatttatcagtttaataaaatatggataaaacttagtttggggacaagtagggtcatttcacattgccttggtttctttttggtgataagtgtttacaacatatatgaaagtagaaaaaagtttgatggccaaatttaaacttacctctcatatgttccagaaacaccactgcctcccctcaaaatgatcagattctactctacttccgttcaaaggtacaaggtaacaaatatactgacatttgctcttgaagggaagaaaatcagatttctgccaatttaaagccatgaacaaatgtcagaattaagatcagtttgttggatgagtttgtaattccacatgcaaaagctaaaatattttcacggtggattttactgtcctatgtggcaatgcacccatgagtagattgggttcactgggtacattccaaagggccatctaaaatgtgttttctggttttcgtcattacatgttaagtttttgaacactagtggtcatatattacctgtgttcagcaacacgctgcttatactgttgttgaaaaactggttaacatttagtaggcacttaaatatctattgaataaatagtggggatgcatgactgcattacatgctttaatctcaggacatcctttaagttcagaaataatcctatgagctgtgattgttcaatggtttgtaaataccataattttttagagaagattgttattttaaaatgttggtgtttcacctgcctgttatttacaaacaattcttttcaatgatgttcaataattattcaattaaaaattaccttttgccccagtcagtatttaggtggagtagattgttctggtatttatctgattattatcggaaaaaaaaaactgaagttgaactggtgtcagagtggatatatatttacaggaaaaggatattactgttcctcaaaaagcattcctagaactttgcctatgctgcttgaagctattgcttaacagtttcttcccatcttatactcagattttaccatgtcccttagctgtaaggttttctccttctctcctatcccaggaaatccattgcagcaacttatcagtagaacacatcgtattccgtgttgtctcaccagttgatggtttaattagcacctagttacaaactaagtagaatcattcatggaaaacatggatctaaaaacaaaacacaaatcattcatccaggccgtagatactataaactacgtgtaatgacaactgtgatctcctggtcccaccccttgaccagcaagctgtcctgaagatgctgtttgaagattctcaagtaggctccagttggttccttcattcaaaggcccaaattatggggagctcatctttgatcctctttaagttctacattcaataaacttattcattcattcattatttgttttactcattcaaaaagcatatgaagtgccagagacacagagaaagcattctccacagtcacactcttaagttcctttgggtgagggtggcaagcagtggacataacaggtgaatgaaaaattgcaaaacaatatgataagtgttacagctgagctatacaagggcaatgtgagcatacagaagggatttaactaactcagcctagaggagcatggttaaagcaggagttgaatctggaaggaagaaattttgaaggaaggatgaagaaaaagactttgcagactcaaggaataggatgcacacagctgcaaggcaaaatgatggcatgttccagagtctgcaggcaggtgtgtatgaacagaacggaggacgggtttgaggggatggaggaaaggtgccagacaattaaggacattgtattctcatgaaagtgcaagtggtgggcagccatatatgtgttgtgggacccattgccacagtggacaacataggtggagatcatgtcaacgctaagtgtttctgctttgtatatccatacttcaataaaacgttcccaaatcaagggtaacccagttggaaatagagcaagaagaggcatccacagcatacaaagtcacaaggtggggctgctttcataggataagtaagtgaaaaccttttaaatctctctgaatcaatacatgccagtataactccgatcttccataaagctttctaaatatctaggctggtgtcaatatctaaaattccatagccagggttttatctttgtctcaatactgttcattcatttaatatggatccctgaggagttggaatgcactaaatcccataggtcaagtcgtttggcaaagagagtaagtaagcattaaacgacacagaatgaggagcggaagtacccaaaactatgaatgaagactcccaaaggggagtatttgcacattgacctgggagaatccctcttttgtgtgtgagcttgtagaataaaagaaatcagtcactctgagaccaaaataccttgtcctgtgttgtttgttactggatatcaaattctctaaacttctgttttttcaacttaagtcatattatgaaaaggaaattaaatgtatccatcaaatgagataatatacatcaagctatttgcaaacaaaaaacaccatacaaatttaaatgactatcatttatgtgttatagatatgtaggcgtatataacacattagaagttgatgttttttcttagaatatttgcagtgtgatagtcatatagcattcttttctgttcagggaaaggcctttgttgggccatgtggtctaatcaggctgtttgactagatttaaagactcaaagtatttatattatttaggactaacacaaattcaaaatgggaattttgaaatatgaagacattggatgctactaagccagtcatgaatgcccttttaaaacataataataacaccctggatttcaatgacagtgatcctagagctcctttatgggtgatgttctctcatgtttcttaattaccacaggtcatatagaccccatttgcaaaaagagttcatgaggctgagctgtgttatgtaccttgaccaaagtaatatcaaggaaggtcagtcctgagtctattagattgttgtgatttgctcttctgccaggtgcagctaaaggcatttttcctaccttagtcagagatgtgctggcttgaagaactaactcatgaaacctgaatacctgaagagttagtgcaatgtctggagggaggagcctaatgcttgcatgtgtctccctggcttgacccatccataaaaaaagatgtatgcagaatgtctttgctgagccaagggtgacctgcaccagctcttcctccaccttcattcattttgtgcctattcctttcatggtccatcctcctgactgcttcagcccctgcccagcttggaggttctgcttgcctgttctgtctctgacagtccatgctcacaacttgagcttctcttctcccttgacattgcttgaattgtgcccaggattttgtcttcttcctcctggcctcaggaccttgtgaacacacctgactgttgtgacctagtcactcctcagactctgcctctgaactatcaggtgctggatagcaaagccagtccagtgtccctggcatttatttgggaagcaatcatgttaaagaaaaataaaatccatcttcaggtgacctattcccaactcctgatttcatgtgctgatatgtttgtgttgtttagcaaactctcacagaaaatgttatctaaatgtcacaccgctatctcaagggtttgttggacttaatatctaagccttacactgagactagagctgagaatccagattagttttacctacgtatgttctttgtcggacctgcatgatttgattttatccaaatggaaaaaatggttcaaaatggaaaaaagttccaatactgagaatatggatgtcagtggccaaataatatgttgcattttaattttttttgcagtcctcagtgaatttttatgtgtctctctgcgtgtgtggcatgtgaaggaacacaaagttagaaataagagagggagacaacctgtggggtggccacattccagggtctgatcctctttggggatactgtgatatgctgcccagatcctcccatcagtgctaaagaagacagccaagtgggagacagtgaggcaacctaaatgttctcaatggcaggaaaccattaccagccctggaatggaaaaaatacagggggtggtgctgtcacctgcccagaagccaaggtcattagacaggagctgagaccatgaagggatgaactgtcccatgtagactggaacttcagaaaaagtacagccattgccacaggtgcccctgaaacagaaagagagaggaaaaaacacccatacatattcccgtttataaattgccaggcttctgtcagttattcatgttgtaacaggaagctacggggccatgtcaccagggacatgtgcatccctggcacacaaagccgaacagggcatggagccgagggtgaagagacaagtgacaggcaaatggcacctgctcagtcaaatctctgagagtgcagcctggaacccgcatgttcaacaagttgtccagaccattcttatgtgcaccaacatttgataacctttccgtaacatggaaaatcccttaaattgccaggctcttataattgcaaaacaattatagtcatcaattctgatggaaggaagatgttgaattttgtgagcctttccccttctctgattgttttaaccaaatatgataaataacctgtggaatatacgacaaaatgtcccttaataacaaatttctccctttcagtgtaaaattatctggaaaaaagtctcctttttgcacagccccttgggagccattaacatggcattctacagtaatccaaaatgtgcagaagaaagtgaggtacatttacttaaaattagctccacagtgtagtacaactatttccagcattcatcattgttaatgactataattgatggctgaaaatagaaccctcaaatgagaataatgtccaaattcacacacgcacactaattgggaattgttcagcctgtgagcatggcagccagatgcaccccacacttcgacttctttcttcaattcagttctacactgtacttcattaatgcttaaggctttaaaccgctgcccttgtttaacacatgacagtttttatgtgtggaaatgttctatgcatgtaggggtgtgggaagcagacacaaacattctgatttaatccactggaattctgtggcaaatcagctcaaaatgccttagggaaagatcctgtattggctttaattgttcctaatatgaaggattgagaaacgtgctttgagtgcttttgggtttatatgtaaactaggaagggaaaataagaaaatggaatgaacatagcaaagaaagatattcttaaaacagggctgttgctctttatagaaaataaaggtttaaagcagccaagtacttgatttaccaagcaggactgactcatcttcatcagtggagatccccaatacctaaggtacatttttaatataagaaattaacatcattataaatagatttctgtgttgctgttctccaaattcatctcattaaaaacgtgaccattaattgatgatcatccttgagtcactcactcttatcgtcactggtttcttggtctgatactaagaggaggccaggatgtgcagtaaactgtatttatttccagtgcttcccctttccaggtgactttgggtaactcctgcaaagtctgatcttcaggcccctcaattaaaatgataggattggaattagattatctacccagctctttgaatactgcaattcagtgagtctataacacagaaacttacctgtgtcctgtaaagttaaattagattttgccttcaccgcttactataaagcatacagaattactcgttgttatttaaacacgctgcaaaaattagctgggtgtggtggtgggcacctgtaatcccagctactcgggaggctgaggcacgagaatccctcgaacccaggaggcagaggttgcagtgagctgagattgcaccactgcactcccgtctgggcgacagagctagactctgtctcaaataaaacaaaacaaaataaaataaaataacacaccgcgtattttccagcatttgtagtttttctcaagcctaaatcccattcccaactaccaagtacctctttatttcttaaggccaagatcaaatcctatggttttcattgccttatccgttgccccggttagattcacccctctccctttgtgctgccatagcttccccatatacattgcttgcatctcatcatatacaagtctgtccagtttcaattaatttttgtttattatcgactgactcctctacttaacgaggatttcttcaatggttattattctatctaaccatctttgcaaccctgaaggttggcacatattagacactctgatgatttaaacagtttcatagatttttttgcttaaacattttgtagtaaaacattttgttttgttttgtaaaaaatgtttatttttgttagttaaacattttgtggtagccagccttaaccatggccccatgactctcccccactgacattcatggctcatgaatatcgcactcccctcccatttcaatcatggctaacgatgaggccaagagaatatggtagaagcgatgatgtttcctttttgaggctaagttataaaaggcttttgcagcttctggctggtcttgtgtacctctccctctggaggaagccaaccttcatgccattaggatactcaagcaaccctgcagacaatctcaattggagaggatccagggcctcctgccaatagccagcatcaaattctcagccatgtgaataccactttgtaaacaaacctttcaatctttgtcagtcctacagatagctgtagcctcaatatttgactaaaacctgttagccaagccatttccaaattcctatagaaactgaaagataataaataataattattaattcagtaattacttattgaaattatttattatttggcaatacataattaatacaaatttcttcctccccccttttccatgggaaccaatattatggagtcaaaaaaaatgggtttgccattgaaatcttgcctgatacttaatatcaatatgaataatgtattatgaatagtaacagctattggcattattattaatgtattagcaccattaactattatattattcattctaattaacatagccagatgattggtatgcaattaatgtagtaaattagtaataatatcattggtatgttgttaaaacactaatgtttggatgacaatactaacaataattattaatatcaattattatatctatttgtaagtgatagaataattataatattatatctacatgtatgtgaaatattatgatccctatttgaataatgaggaaactgaagcttagagcagttaatttgtccaaagtcaatcaactcgtataataatgagttatgactccaggctagattcatcttaagcatcaaaaactagcactagagctttgagtttcctcatctacacaattggtacagcaatacttaatatgcactgtgcttgtggggattaaatgagatgaaacctgtaaagttgcttgcagaatgcctagaaaagccacatgcatcaaatgccagtttatctcccttccctccacaatctgctctgtttctaagaagcccctgggaacacaggccattaggcagagctgtcagaagcagaagcctcagatcaagtccatttccacatgggaccccaggtcctgaaattgtgcaatgagggtgactcttatatttcctgtggaagaagtaaggttacaactcagtcttttgcctttctcaaactcaggctgagtatctaataatagtgacgttttaccttttgatagtactctggagattacagaactgtttccattttctacttaggagagggtaaatggatttgatgcagatgtgaatcagattggccatggaatgaaagttggaaagtatttgtggcaacaaaccccttatgactgacacacacactccttccttaaaacctttatcttctgcagaagcaatctcattacaaccaattggtggtcagttacacagaatggagtcataagagtcattatctatgggatgttttttcctttattcacaatgaaggcataatctttttagagagaaatacaattctctccagatatataacaaaatatatctactgatgttggtttagtttcatgtggttgacaagaaaaagcattcatttacctgaatacgcagctcaattttaaaataatttctgtaattttattataattcacagagctgcttttattcattttacaaattgctttcaaagcataaatgatgtattgaaagggattgactatccgtaatagctctgatgtgtgagtggctggtggacttaccactttaacatgatctggcatcaacctccatgagctgcgcagtaagaatagcaataccaaattgtggtaaacctcaagagttttcaaggaagcaatatgggtctaattgggcagaagcttagcaagtagaccacagctatttctttgtagaaagtccagttgtgtattacaaagattgtgcctataaggtttgccttgctaaatggaaaccacaaggaatgggcctttggatgtcttcttgaatcagagcattaaagggacttagctggagttcaataaggataacatttttttctttgcaaaaatatgagctgtgtgcaccagcacacatatgtacttggtctgcaggcttctctctaggttgccaagaaaataggttttgatggacagggctgtaccatgaaggatagtagacgaaaaaaaagatattaaaggaagccccctttttaacctttaaacaaagttaaacatgcagtgtttcttaatattgtttaaccataaatgccttttcaaaagtataatatgcactaagatttgctctgtggaacttgcttgggtaatcggatcttttaaaagagagagaaattctgtggagtgagacacagaaaatcttattgaatgggaccccttttctccgtgtgggaatgaactggtctctcaactttctccttagctaactgtctgcaacactacagactcgtatctacctccaacatgagcctctcttgtcctcacaagaacccctcgagggctctactgtgtcctcagtagcagacactgtatcatgttcaggtgcttgtctgtttttttgatcactagccccatcaatctgtttttttccaacttgccgcattctacacattttcctcctcaggtcaccaaagtgcagcctttcatttctacctccagaaactcaagagtttctggaaacttgatttgccccatattattaacaaaacaattttattaacatatatattggcctctgagctgcttctgaccacagacaccttaggttcctcttggttacaaaagctgtggtctatctctgatgatgtacgaaagaagctgatgcttatcctgtggttgttggtcctaacctcctgtttagtctttttgtaatttgaatctcatgcaacttttgtgatactcttagcccatcatcaactgcttagcccatcatcaattgaaaataatcagatatcctaaaatcatcagccagcgaacttttcagattgttggcacttgagtttttgtagcactaagtaggaactatcaccttaccccagtgtcataaatctatgggactaaaaattttgagaaaaactcatataccgtattatattcaatactccagagatctactcaggttaattttcttgtcaagattgggcagcttttgacctagaatatcaagctttttttttactatggggctgtggtacattccattctttccttttaatttagtaacacttggatttcctctctaataaggaacaaagtaaacaataaactcagaagctcccaatgctcttcagtgtaggagaaattatttcacattaccagggaagagaaggaagttgcttttatcctaatagtgatattctcatttcttatctttctatgcaaaatgtttaatgtttccatcttgtggagcccttaattacatccttaccagatgtgatgcaaaaattaagcatcaattagctttttctggattgcacacatccttaaattctgttttcagatcactgcaacttaactttgtgatttatattggaaagatagctttgggggttcatttcacttcattattcttcagcaattgtatttcatccccttagctatttctatggcaattgtgctctgttgagaagagattgaccagtgttgctacatcacaatgactgtgagataaaatccggtagagcacagctagattttgatgagtttttggatcccacacgcacaaaagcagcataggaaaataaaagtgataagcatcattttttgcattcaaagttgttctgatataagacagactgaaccttttaaataaatacatcaataaaatggactaatgcaactgtaagcttgtagtctggtttcatttgataaaagcatttataaaaataagaatgatttcccagaagtcagttagtataagaggtacaatggaaagcccagacagtttggaggacggctttgggtactcaactcatacatgtgtatgcatatgtaaactgtgtgcttatatatggatatgactatagatatagacatatgcactgtcttttgcccaaattatttcctgttatgtttattggtaatatttgcctcattctacatgtagaattcctatttcagcttaaatctcaaatgttagtgaaagcctaattttttatccatcatttctcaaaaaaggctccttacaatatatctcttcatgaagagaagaaacagaagcatcccttgagaggaaatatagcattacacttgtgagcaaggactatggacaagattgcccaagttcgtctctttcatcacatgatgaaccgaaccattggcccccgttctcagtggctctgtatgcctatatccttgccatggtctcattgtgagaaaagagtacatcccgattccttgactttttccttggctctgtgacttctgtcggcttactgaaaggtgacggaagtgaggctaagttagttccaaggctgggcctcgtaagaccttgtgcattttcactttctgctcttggcactgccatgagactattgacttgataactcattagtccagaggggataagaaacatgtgaaacagaattgccccagcccacctatggtacaaagcccagctgccccaactgtcatagcctaaatcagaagctcccatccattctcagtctagatttggtgaacctcagctgaccacatatcatctataagaagtataatgaaaatcccagatatttgaggggctgctttggataataacaacacaaacatatatatgaatgtgtgtagttcatatgtctatatatcatcattgtgagaatcattctgtattattatattacattgtaattttgtgattatttattatgttgcaatagctgaaaatgtgaccacctgttatctgtgtaacttcaggcaacttacttaaactttttctgcctcagttccctcatctatgaaatagaaacaagaattatctactggctcctagaattgtagcacatattaataagttaatttataattaaatttattagactaatgcctgaaaaatagaaactgataaatgaatattacctatgattattttatcattcttctatattcactcctaaaattttctgtgggaccactgtgaagtcaaactgctagagaaagtctggcactgtggccatgacagtggctcaagccaccacagaatgtctgaccagcccatgaggatttgacaagcagcagttacagcatctatccagcgaggacaataagaactactttacctgttggcagaaaacaaagaggaatattttatttcccaccacatcttcacttcccatgttatggtgagctggtcagaaattagtgccataattcttcagctttgcaacttgccggggacaacatgtgtggttggttgactccaaatttttctcagcttcccctgccctcttaaggagtggcaaaaaccaaaaagcatcctcctttaactcaaaaattgttatcaattcacaaaaaaagatcttttagatctcgacttatatttgctaataaactatggcttcaaaaaatgtcataaattatgccatgctcacctatatctacttccacagagttgaacctggatgtaaaggacaaaatattattataagcccaaaggcattgtgacatcttaaaattttattgactgtgaaataaaagaattccatgactgaagaaatggctactgactgtataaatttcttaaactagtatcaagtaaaatataaacacattgactaactctactggaaaaaaatggaagctataaaaaaattcatccataaactcttccaaggcaagctgtgaaagactccagagcatgccaaatgttacccacattagttaaattatagtaagaatccccgcgcactaagtctgagagggattgtttttgtccttatgaagaaaaataaatatgtttttcaacaagaaaaccttctgaaggctgttgaaattttaatcttttaaaaaatggttttaccacatagcaaaacctcaaagttgtatttcacttttaagactctcaaagcattccatccttgcaatttcattttatcctcatctcacatctggatatcctggtgagatggaatgtctttctctgtgtttcacatgctggccttgatcatgggtggcccacactaagttgtgagaaacagaatgagctaagcaaagggaaaacagaagggatgttaaggcagagaatgatcaagggccgtggccaaggaaatacaagcgtattttattacattttcaggcatcagcatctaatcatgatgttggggtggtccaggatgggggggtgtattagtccattctcacatcgccataaagaaatacctgagactgggtaatttaaaagaaaagaggtttacttggctcaaaattctgtaagctgtgcaggaagcatcatgctggaatctgcctgggttctggggaggccttaggaagcttacagtcatgtcagaagccaaaggggaagtaggcacgtcttacatggtggaagcaagagagcaagtgagggggagttgctgcacacttttaaataaccagagctcgtaagaactcacattgtgagaacagtatttacgggatggtgctaagacattcatgagaaatccacccccatgattcactcacctcccaccaggccctacctccaacactggagattacaatgcaatgtaagatgtaggtagggacacagagccaaaccatgtcaagggaggagacttagaatgatggtgggaggtctaggctgtggtgcttgactagaagattctggtgacagtttattaagggagaggtagtttgtgatgggttcagctagatatccacccctggaaaatagagatgcaaaaaattaaacaagagggttcagttctaccccatttcctcttatatagtaatgggacttggactgaattcaaggggtagaaaataggaagcaaagaccagggaagagatgaacaggaattgggtaggtgtgttgggcttggttggaagaggaggttgaaaagacactagacactatggtcccaagagaagagtccatgaggtgaggagtctgatgcaagactctattcctggggccatagcagcacaatccagcaagagagtgacacaaggcaacatttaactctttcttgaccctatttcttagtattaaggaccacctactgtcagggtaggctttgtgacttcccaatgccggtggagctggacctacaggtgcatgccacgtctttggggtccctaggatatacactgatggagctgttgggaaagggacagcatccagaatgtgagaataataggccacagaaacttcatattacgcccatttatttcaaagatgagaaaacagaggttcttagtggctctatgatgtatttgcagtcaggacccagaaccaatgagccaaaaatcccgagacctttcatcctttttttcatcttttttttttttttgcctctgtaagacaccaaagaaattggctaatgttaatttgcttcttctccagttcccttgcttatcacattaatgggaatatcagaaaccacaaaaagcatcatgttggttgcattgctatttgaacatcacaaataatttgttttaaattctactgttactcatttttgatgcttggattagaaagatggatgtacggatagatggttggatggggggtgggtggatggatagatagatagatagatagatagatagatagagaaatagacagacaaatctgaattgtaagtggtttggacacagtgcatataccacagctataaggcacgtaacactttacctcctttgccctggggggttgtgtcgtctctcaagaagtcaacatctggctttagttgataagctaggtgattaactttttatatcaagatccactgcccaaaataatttgactagtgataaactaaatttttatgcagaattatttagtagagtaggcacctagaaaagagacaggaaacagtagactagatttcagtcacgacccttttcctcaccacttggtggcactgagctcaccacttaaccttgctgtaccacactcacctccactctggacactatgagtgtaatagtgacttaaatgaggtaatcaacatgaaaaacactttgacaatgaaacagagttgcatgctgatgccaagtggccttgttattatatgcatttatcatcaccatttccctattcttattaactgactgggttagaacaagttcaaagaaggcaggagctcattcctggaagttgactctactttgttatttaggtaaagtgtgactaccgctttttgtaaatgtgcactgtgagcagagtgacatttttcatgtggatggtttataccagttcatgttcgtgtgttgacagttatgttaattctatgtgatattttccctccagtgcttttgcttttgaaacagcataataaagtgacttctgctaaataaataggcctgttcacaataactgatacttaagtgaatttatgcaggaggtattttggtcttgtggaccaaactaactagctgcaaatcgattaacttcaaggatccagcagagtatttaggataatttctgaagtgcaaatgtaaaagtcatggtagaattttttttggcatatgtgtagaatttctaccatgggcccatttaaaaaatcaatatcataataattacatcaaagcaaaagtaacagagcattatgtgcatgatcagaaagctgcaactgagaggaaagtccaaccactccaggaaaatgagaaacgtgtaattaacatctgcaatttgcattgctccctgacactcctgaatttttatgacaaatcatgctgtaacctttgtaagttggacatcagtaatggttgttttttcatggttttaaagtcaggaatatgaagcatcctctttcacaatcactcatccctactattgccttatatggataatctcaatcctaccccttacaacccacctcactgtagtattctctcttgccaaacatctagcatgcctgcacatatatgagtagcaaaaatgtacatttcttaaagagaaaactgtgaataggagcagaaacctagaacatgtaaatgttttgctgctgttgccaataaagggactgacagaatcactcaatgaatcaactgactaggactgcatttggtgacattatacaaattccctaggaggagcaggtctgccaagagttatgagagatgctatggtaatataattatgaactccctgcagtcaggaagcttataatccaggtgggaaatgacgaacacataaaatgtcatcatcaacctatcaaacatcctttcttcccctgggtcccggtaactgctatcatttagtgagcatttgctgtgtgctcaacacaatgcagacattaattcatttactcccccagatagcctagtgaggtaattgaacatgtaagccccatttttacggacatgaaaactgagctttagtgaggttaagcaacttgcccaagattatgcaactagtaagtggtgacagtgggatttgtaagtaagctcccagacttcaccgtacacctagtgttgtactatttatgaagggtcttatcttttctgtccaggaaagtctcctggaaaacaagacaatttctgtcgtacacatcctgtgtccttctcaacccccaccattgtttgcagaatgaatgtatacattcaacttaatatttattgagtgtcggctctatatttgatacacaatggcacataaaaggataaggaaaactacaaggcagtacaaaaatgcctcattaaagaccaggatgcatgccagctgcatatttttttttatcagaaatatcatgatgaagaatagcctttttatagaaagcataaaaatatgttgcaagaaggttattttatgaaaataacattaaactgtaattgacaattacctagaagattcataagtggcatcacacttcatggcagtctttcacatcatactctagtcagctagtgaaacaactgctgttaaagtcaaggttttggaggtatactgagttgaagagtgtgttccccctaaattcatgtctactgaaatctcagaatgtgaccctgtttggaatagaacctttgcagatataattagtaaagttgaggtcacgctggattaaggtagatcctaattccaatgactgctgttcttataagaagatcacctgaagaatctctgatcacctccataaaaatgtccaggactgaggaatactccctaaaaattctgattctcagcaccacttcaaacgcacaactcataatatctatgaagacggtcagtaactaggatgtttactaagcacactagaagttttttgctcattacagtttgaaaactatggctttgggcaggatgaagatgtagaagacgtagtgcctttctctactgggttcaccttgatcaaggaaatgagtcgtggaaagcagcatagcaaggaataatcttacttgtggcagtaaccccctgtcgaagtacaaaagaaagagaccaccatgaatgggagcaaactagataagtgtactaagaattcacaaaattttatcttggccttcaatttcagtaagcacagcaatctaaacatgtccaataatagttttgcatgcagaccaaattaagccttgataagagtgatagctaccatattttcaacagttgctatgtgataattacttcacacacatcatttctttgaatattctggacaaccctaccctacagtattggtctattattagccctatttaactaatgaaaacagagtttagagaagttaagtgattcactggaagtggccaatcccacacacaaaactgtgaccaatgaaatttaagcctattctcttgatccgaacctcctctcccacaaaacagaacacctctttttaagccatgtggcctgtctaaaacaggttttccacgtggactggatagacttgaagtcagagagtaaaaatgttatttcttctaggagcttcaattttatataaacatttagggtaagaaacactttttatcctaacataggcataaacatataaataattgggtagaattgtaaaatatggaatgcagttttaaaataaaagatgtatgttgaaggaaactttgcaattgaccagaacttctcaggctatcctccatgaactggagtgtggaagggtccccatttagaatattcagccttcgaggatacttcatggtaaacattgtgaaataatctcataggttccctcactggttttgtcccacactagactgcttgggatgtcacagactttcattagttgctttaattagttcttttcaattgattcctgtgttagtttgccccacccctccaacatagtctacaaagtgaaggcagcacacacttttattgacttgagacagcagcgattttctctcatctagttatcctgacctttctttctactgcattttcactgtgggtggcaatgatgatatggctttagtccatttttggcagaacaaaggaatttcctggttggacaccaaaaggaaaaaacggtttttccacgactaagcagtatcaagaatatgccataacaagccttacgtaagccatggctcatgcagtctagagccgtcctgttaaccaactcacacccactggctagagagaaaacatggcgaaatgtcagagctgctaactgagatagaaaacatacaggctgccacatgactagaacatatggtgacccaacatggcagcagcgagaccctcggcatcaagaaaaaacaacaaaataactccttaaaaacaagggctttttctaaagtggaccttgacatagtcaaaaaaaaaattatatatatatatatatatatatatatatatatatatatatggcttcttcacatccaggttcccaaagatgtaacttaggaactaggtacattttaaataatttgttgtccagaatgtatctgtttcacaactcagaaattaaattacatagaaaaaatagaatccttcttaaagtttttcaatgaatacatcatcagtggatctttccaaatattttttacagctgttcacagaattaaattttagctttcttctcctcaacatttccaaaagtataacgtagaggattggtttgtttttaatgaataaatcattcggctaagcccatggaacaaattcatacttaaggtagatggtttagagtggactttcggcagcattattttaggaatgtatctctctaagcaattgagtggtgactctaaattgtgccaatatgccaattccatttgcatatctttgtaatttggactcttcctctcctgctgaaagatggttggataaaacattattggatacagcacaaacgcaaataaagcatcgttttcctgctgaaatgcaaaccaaggctttattttgactggccttaaattttgacctgtaactggcattggaaacatcagtgaaaaccgagaaacagccactgcagcatttagcgtcacagatgctggagcagaatcgagtttagaaaataaacttttaagggattacagcagcagacgttatataacaagattagtataatgggtgggacatctgttggctgttttcagaaagccatcattctattaccctctactaaaataatcttagtggatacctgactgttattgttctttttttccatatacccccagtgagaaaggttgacatttagttgacatttctatgccgtagtcttctcttctttctttttatgtttttgtttttatttggttagttattcttttgtcattgttttaattgttcattttgcttaaaagggaaaaaaagactgtcttactacaaaattagtatcataattgttttttctcagttagtgttcagggtggctttaccttacacataggaaccaacatacctcagagtatagcagagaagtgttcaatagctattaattgttttctttccctttccattcccttgagaagattttgatattcataataaatgttgttttaaaacataaagcttataacactgaattttaccttaagactataatagctgaaggagaaattcttttggaagttaaaatatgttgaaacatctgtatcaatcactctctctctctctttctctctctctcccatgcaaatgtaccaatacaccatgcattctggctccatgccactaagtcatgattttccacctgtaatggattcccagcccccgtgcaggatctggtgcagtgtgccgaagagaggccaaagtcactgtacaagccagggggaggggggggtcatcttcctcaaggattagtaacgattaggaagaaaagcattgtctttatatacagccaagcatgaatattatagatactacattactaaaagaccatgtgacaaaacccaaatttaaataaaattttgtagggggcattttgggcatcatcccaagttcccgagggagacttaatagccctcaggaatatttgcatataaacatttgaaaagcacttaattaattgataagaccactggaagttgtgagttcaattttcaaaatatgaagcagacaatgttgtggaggatggacaacctacagagggtaagagggaggagaggaaaagctatttcttccgcagagagaaagccagggggcccatgtttctacctttttcctcaagtggtctttccttttggggtccctaagtcagttagtagtcataattaggtcactcagagcccactgatacagtggagagatatgacagaccttttctcatatcctccagttggctacactgattacaagctggaaagatgactaaaaaggggtgtctcctccagggatctaccgtctagctgaggggcatgttcctctatctggcatttaaagagagagatgatatgaaatagctacaagttcataaagatataaagcgacaatcaaaggtttggaacagctcatgcgtgttgggggaggtagaggctagggtggctaataggagaggcacagatgtaactcaccattttccttcctttcttttatgttcacacatgcacacacacactcacacacacagcactgttgccaccagaatgcttttggtttgtgctttcacattgtagaggacatgaacctatggaaaattactcaagggagattgttctgttgaggtttgccttttgaacgaaaagattctttcttgcaggagtgggagggacatcagcttgagaaaaacagcttttgtcctcacaaaaatgctcttttggaagatatgttaatgagcttcctttgaactgtaaatggcatctgcatgcacgtcagatgctaatggaaatgtcgagaaaacgataaggcacaggacgattgcacggttatgcagtgggccccgttccttcgagcatcgtgaccaggctgcggagccaccttgtgacttggcatagcattctcattttgagtggagatttttgtttctcccactgatggcatcttttgaaagtcaagatgtgttggctttataaagcactatcctccctgggcaacctcataagcagcaatgaatgacaattcttccttgaaatttttaattacttcaacaaagaaagtaattattaacttttgtctctgaaccacctctgcagatattcttaatcaaataaaagaaagaggaagcagagctttctgagaagcaggaggatgaaatagacaataggggtctgcagctggattgcggggtgacatgagcgctgcatgtgtgctggataaacaatggctccatggttggaagggtaatttcatgtcatagactagatggcgaggaagaagtttgagtcaagagacctattcttggcactgtcttcttcgtgtaagggtaccaagggcaccatgggagtgatggcaaagtataggcagcagcccgtaccttatcggagtgagaagatgaattacattgaattaacacttgataggctgaatgttgagagatgaagtggatatctgaccaattttctcctcacctcttgatttggattctcccaaaagcagaccctaagacaagaattagagtgcaggtagattatctgtggatcatgcagaggtgaggagagttgacacagagcatgccaccaagagcatcaccctgggaaaccaggcatttatccctctggagaactctgggatctctcccccaagggtgatcgaacagggggatttaaacatcaactcccgtcagtctttggttgaggctgccagggtgacaggcattaattttccaaactccagctcactagatatttgctcagagcctgccagcactatgaaagccctcaggcaaagaagtgcaggtgcttggccattgtctggctcacacttactacttagacccacgggaacatgaacagggcacctcagtgctgccacacctccagactgtgtgggcccgcttatcttttatggatttgctaacaaaccatcaagtaatccatttctcacatagaaggagatctgtaactcttatctagaaggatctacctagcattaggcaagatagacatctgcagagatgtgtcttggctctgggtggctttggccatgtgagatttaccctcacagctgatggcagtcactgcacggttgccctcggagccagtttcctgtcctttgaacagagtccacagagaactttgagagacacgtttcccaatggtcagtgtcggatggggccccaatctcaacaaatctgttgctgtcactttgttagggttacatgtatagcgtatattgacttcaagtgctcttttacaaaacaagtcctgacttcttaccactggtcagccaaatgctaaatatggtcactcctgaaattactagtaagcaaggagcgggtagcagtcactgttggacagagctcaggtggccggcttcatgtgtgattggctgctgccactcagaacgttggaaatgatggaaaaaatgggcatgggaagaaaagaattcagattgtcaaaaatagagcgttattgtcctaggtcaagtgtccatggaagtagactgagaggggaattgcaagtaggaagtttatcggattatgttcctgaatcatacctgggtggagaggaaacatgtgagaagcagggttgggagaagttgaactgtgatccggtcacagcaaaggcttcggctgatcccaacaggggctcaggagtggggaaagtgtcttagtctactcaggctgccatcataaagtaccacagactgggtggcttaaataacagaaatttattttctcatagctctggaggctagaaggcaaatatgaaggtgtcagcagggggcatttcttctgaggtttctctccttggctggcagatggccatcttccccctgtgtctttacatggtcttccctctgtgcatgtccgtgtccaaacctcctcttctgatgagaaaacttgttatatgggattagggcctatccccgtgacctcattttactgcattacttctttcaaaactctgtcttcaaatatagtcacattctgagatactgggggttaggacttttatgactgaatatggaggagacacactttggcccagaatagatggcccttccgagctgcatcaaattgagggaagggggtctgggccttgaggctactccgtgagtcagtcattggatgcaggctgacttcaggaagagagaagcagcgtgggtgaggtgcctgcttcagcagaacacagtcctctgagagccactccttggagctgtcagtcaccagcacctccagcaagggaaggatgatgtgcattgtcctgaagggaggggcagccaccacgagcacacggcagcttcctctttaatcgtgaaaagaaagcccattttttatctttgactggcatttcccctcagtctctcccaggatcatctctttggatacaagggcagaacaggtcatgcttgctgtgctagaatatagaacggcaggccctaagcctgtgtgtgtgtgcacgtgtctgttccacactaaacatatggagcagcttcaaggaccacgacagatgtgtcgtttgtgaaattttgatcaatatgaggcaggctcggaaattaacttgtgtgaatgagcctccagctcaagccaaaataactcttggctcctcagatgcatggccatttttcttattgagttgaagaaaagtcaagaagagcaatttatcaaaacaaaacaggaagattctgaattctgctgccacagagtaatgacagatatactggctttgcaaaaaagccccccaaaataaaggatcctttttatgcccatagaagcaattttaaaatgcaaaaatgtactttgagagtttgtggattataaatgttttccaattcacccaaacatctctgggaacatggggagaaaaattttcccattctgtaatttggagattgaagtagcaggttctgtggtgttgtgcacaagtgcgaacatggctaatactttcacgaagaagaacaatgatattcggtgacatttgacaaagatattaaaatctcagaatacggactcctatggggtcttgtgaaatctttatccgttacaccatctccactatcagcttacctgtttcccgtttatctcattggctgatatgaccagacaaaaacagagctgcttatatataccatggcctattttcatgaatgtttcttttaagatagaatttctcataaccagcctgggcaacatagcaagactctgtctgtacaaatattttttaaaaaattagccaggcatggtgtggcacacacctgtagacccagctactcaagaggttgaggagggaggactccttgatttcaggagttctaggctgcagtgagctatgtttgcaccactgcactccagccggaaggacagcatgagattctatctctaaaataataataataatagtaataataacatgattttcactataacagataaaaaaggtgcccctgatattctcatctggctatacctcgtcttaacctggcttacaaggtcagggtagaaataaaggactcagcaagtgaacactgattttatttccatgccagcaccagggtaggtgttttaggtaccttatgaataataactatgcaaacaagcaactgatgtttatggagcatttactctatgtcaggccctttgctgaggactttatgtagaatttctatgtggtcattataatcaacggtggcaggcaggattctaagatgatctttcagattcctaagtcatggtgtacacagacctcccaattttccaaaccataatactgtaaagggattttgaagacgtaattaaggtctcaaatcttaaaatagggagattatctaggtgggcctaacttcatcacatgagttctttaaatttggaacagatgtggaggaagtcagagaatcaacactgagaaggagttgacatgcctttgctggcttgaggatggaggcagaaatatggcaaggaatgcaggaggcctccaggagctgagctgtcctccagctgtcaaccagcaaggaaatgaagacccccatcctgcaactgcaaggaactgaattctaccaccaatgaaaaggagtttagaagtggatttctctcctgagcctccagacaagggctcaattcagctgacaccttgattttagcctgtaacaccctgaatagacagaacccagtcatgcaatgtcagactttagacttacagaactgtgagctaattagtaggtgtgttttaaggcactaacccccagaggtcaatgtctccattttagagatgagcagactgaggcttacaaaacttaagtaacttgttcaaggtcacaggtaaatggtaaagtcaagtagggacacaggcagctgcttccatggagggaactgcgtgggaggctgaagttcaaaacagcctccaagatgccaatatgatcgcccctaggtgtgcacatcttgttcagttttctccccttcagggtgcgtagaaccttcaaatatgatggggtagtcactctgttgattaggaaaagagatttccacagagggaataaaggtattgaatcagtctggctaattacaaacaggtggacttgactaattaggtgggcttttagaaggaacgtagaggtgggaggtagagaaagtgatagaggcacactcttgctggcgtggaagaaaaagagcgctcgtgtcctgaactgctttggggaccatatggcaaggaaatgcaggtggcctctagaagataaaagccatccctggtcaacacctagcaggaaaatggtgacctcagtcctgcaactgcaagggatcaaattctgccaaaagctctaatgggcttggaagaggattccaagcctgaggtgaggactctagtgcaactaacactttgattgcagcttttgagactcaaagcagaggacccaactaggttgggcctggactttcagccaactgtgaaactgtgagataataaagtgttgttgttttaagccattaattctgcggtgatttgtcatgtggcagcagaaaactgacatgctgggagaagagcagattgctctcttttgcctcacttggtgggagaggagggactaggacccaggcaccccaatttcttgttcttaattaatctgtagtgattgcttccctttgctgctctgtttatccctgagttactctgagtactggggaaacttcacttatcctggtcctccaacctctcaaaacctgtctttgtacaaatttgatacttaagctttgaaatttaattcacttattaagcagcagccactgttttatgaaatcatcccatccaaccctgcactggtgagactgttgatttctctttcatgaaggctgggacttaagcccagctgtccatcaggctatatttacccaggatagccctccatcagtcctcagttaaagcagcatttgcatcacaccagatctctaaatgttggttgttggggaagcaaattacattcatcagaatccattcattctcctcgtatcactgaacacaggataatcttggctgtgtcagctgccctatgactggtggctctgaaaaatggaggttggctgcagatactccaaacctgcttcgctgtgtcaccctcttcagggccagtggatatgatgctggaaaagattaatggaacatatgtcatcacatttatggggtaggaaacccccaactgtggattaatagatatcttggtgaaagacatacatctttactcctttatgcctcgatgggtgagctacagttggctgcagtgaaaatacacagagagattacctttaggaggtcagcttgtaaaggacttttttcaaccctgaggtcaacaaaaatagatttttgattgttgaccaagagagctgtaacataggacttttaacctttaaaaaaattcttattgaagtataacatacagaaaagaacacagttcctgagtgcacagcttgatgaattttcacaaactgaacacatccagggagccagcatccagatcaaaaaaccaggatcccaggcatttccctaggtctctttgcaccaaccctccaccccagggtaattgttacattaacttctaactccatcgatgattttgcctctttctataaggtttttgaactttataaaaatgaaatcatccagtgtgtcctcttttttttctgggttctgttatacaacattatgcttgtgagatttgcccgtattattttgtatggttataaattttttgttctcattggtttttaatattccattatatgagtacatcgtaatttatccattctatcatttatggacatttaagtagcttccaatttggagatattgcaaatagtgctgctatgaacattctagtgtgtgtcttttggtgaatatatttgtaggttctactaggtatctatgtaggagtgaaattgctaggttataagacatgtacatattcagctaatttactatgtactgccaaataattttccaaagaggtttccaatttttattctcaaaagcagtctatgaaagttcctgtcagtctatatctttgtcttatatcaagtataagacaatacttgatattgtcttttcattttaaaaagctgttagtttttaatacatcctagtttagagggcatcattgttgctactgtgaaacgattaagcactctatatgaaaactgggctgaagagccattgtactcaacatagtatcattggataagatgtcagttggtgacaataatgcctcatgccctttatatagtgcttttgtttttcttttttatagagtgctttgcaaaaccatctaggtttctctgtatttctgttctcagctcttctggcaaacttaaaggaaagtcctccgaaatatcttatgtttttggttctagaactaagtacccttgaaaactatctgccacatacctacattttagtcaaatctgtttgtctaaacatatactctgtggatatttacagagctcctattatgtgtcaggacctatgctatgcactggtgatgcaaagatgagtgccacctgattcttcatgaggttccagtttaagacataaagtgaactgtcagattgttagttctaaaaatattaatgttgttttttgtattattttctattacattttagactagggaatcatctgagtttattgacagcttgttcataaaagagcaaattattttaaatatacaaagttgctttaattacaagcggggatggaaactttaggaagttaaccaagaagatgggccgggaccaacaaaagttcatcgaaaaagaagtaattggaatttgagaagccttgacagattgcacacctgtaacaaagaacattgttattctttgtacttcattgctcttctctacataatattcactgaaatgatattgaagattacatcagctggagttaagtcagataagcagaatccttgaatgatatgggttaatggatttattgcagggattagatcttatacaattgtgggagaaactgggaaagtaacattccacaaggggatgattgactgaatagaaaagcttctaaccggggcccatggaatggagctggtgaagatgtctatggaagtcccttgcctgtccatctggacagggccagaagtatgtcagcagggcagatgataaaagaggaagtaggaaagctgcatgcaaagcgggagagaacaaagacaaatgaaagtcacaagggaaaactggaatccacagagatccacaggcccatatatctgtctctcactgattggaaccccaaagctgtgatgtcctgccgaaggatccagtgctcttgctgcagaacttcatgtgggcccagcccagctccaagaacatgtggcagaagaaccatcaagaactggagaagctgtggggccagctgctactccacacccatgtgataagcaacagcatgcatgatcgcccaagccctgcacccaccttcctggcacaaagtctctgactgcacttctgccctacaaatctcatggaaatttctctgtggccagccctaacccagaaccattcagagaaatgcaacttcagcttaactaacttttgacatagactgtaacagaggcatagaaagaaagaaagaaaaaaactatagagatgagataattccatcttttcttgagaaagatgtaaaaactagggtgaggagagatgatggcttgtccgatgtcacagaactagtgacaggcctagaaactcaattctgtgtgtgtgtctctaggtgatatcacagaaaaaacaaacaaacaatctctggatgtgaggttcatgcactgtctttgtatagtccaagccactcaagaggtttgcttgaccctagaaatttgagtccatcctggcaacatagcaagactccatctctaatgtatttaaaacattaaaaataaattctaaaaaagaagacacctgagtttttgccttaattgattgcttgggccttgggaaaaaaaaaatcactcgattcctggactcatgttttctataagtgaatggcatataggctaggcccaacaaattggaaatgatcactttatatctgatgaataaatgaatgaatacaatctctcaagaaccactatttcacaaaattattttactgcctaacatttaaaaaaaaatgaaacaatgctcctgggcctcaatagcgaggcattcttataggttctcatgaaatttatctggggctagtatggggcatatgggccctttttcctttgtacaagtcagatttccaatctctcagccatataacaattagactttctcctcacccactgtgacttcttttttacttattcagtctgggcttttcagtaggagtcaagtactacatagctggaaaaacaagagactctggaaaaacagttacagggagaagctggaagaatatcagatttctagttatgtattttgatggttagctcatgaatttgaaatcagcatttagcaggattgacctgtttcccgctggtgtgacattagctgggatggctcaaaggcctggagttgaaataatctaaagtctacctactttcagtgagggtagttggatccatattgtctctctgcttcctcatggcatggtggttgggtacaagagcgaggctcccaagaagaccaggcagaaactgtatcacctcatggattacaaagttatacagcatcatttctatcatagtcataggcttcccagattcaagaggtggaattacagttgacccttgaacaatgtgagggtgagtggtgactatccccagtgcagtcaaaaatccatgtataacttttgactccccaggtacttaactactaatagcctactattgactagaagccttacagataacataaagattgattaacacatattttgtatgttatatgtattatatagctgtattcttacaataaagtaagttagagaaagaaaatgttattaagaaaatcataaggaagagaaaatatatttactgttcatgagatggaagtggatcatcataaaggtcttcatccttattgtcttcacattgagtgggctgaggaggaagaggaaggggggtaggtatactttctcaggggtggtagaggtggaggaagtggaagaggaagcagaagaggcaggcatgatctgcttaacttttactgaaaaaaatccacatataagtagacctgtgcagctcaaacctgtgttgctcaaggaataactgtagatcccatttcccaatgaggggagtatcattattacactgtaagaagagctgtgggatggaaagcgcatcgcatgccatcttggaagacacagtctgccacaagcactgatcagtacccatggtgcattcataaacacggagcttgtcaactatatgagctcttgttcaacaataaccccagagaatatgtttgtgcacgcttataataaatacatacacatatacatacataataagtacttagtgaataagactaattcttggattcaccttgcttccaagacattttccgtgttatgcctaagggtaagggcagggaattgggccactcaattaatttaaactaaaaagtgtttcactgtcaccatccccgcgcttttttttttttttctgggaaaataagttgggctgctgagttttggacttaaatcatttccatggcaacagagcctaaatgataaaaggcagattatagttccttccaatatttgaaatgtctgtatatggtctgcatggctgaggcaggcagatcacgaggtcaggagatcgagaccatcctggctaacacggtgaaaccctgtctctactaaaaatacaaaaaattagccgggcatggtggcatgtgcctgtagtcccaactactcaggagactgaggcaagagaatcacttgaacctgggaggcggaggtggcagtgagctgagatcgcgccactgccctccaacctgggcagcagagcaagactccatctcaaaaaaacaaacacacacaaaaaagtacacttagcagagaataacattgccattaaccccccatacacaaacacacactcatacacactcatgcacatatttatacacactcacacaagaaacatgagtgttaaatttcataatttatattaaatgattttaagtatgggggaaatgtgtaggaatgacactgttcagccttgtcttctcagatctgcattaagccaaattttcttgttttgattttttgatcggttggttgactttagaaatattctgatcacgtaaagcctgggggaaaaaagtcaacaatcgtagatacagaagtgagaataattacgatctttggaaattccaagtagttcaatgtggcttgagagtcgtttatgtctgagggaggataatgaggctgcacagtcttatttttaattttaggatttttgattatgaagtgtttcaaatatatataaaagtatagaaaatataataatatgagagccatgtacctatccccatagttagcagctattagccatttgccatgtttttctcaaatcccctttctttctaaaggaataaagtattaggtcttcagtcaattccctacttacctcctcctttacctccccaccctccccagaactcatcattctcaaaaagttatgtgcgatattcctgaggcactttaaatttttggaatgtttttgagcagacagcgattcatgaattgggcagctccaaattgcaggtgattctgggctccactgaaggggcatgaagggcttttgtagagttgacatgaaaacaagtcaaagaaaatatatgatcactccaagtggagcaatagccttatttgtatcattccagtggaaagaccctagttagagattagttggcagtgtatgactggctaagcttaaattccttttactgtttacactttggtttgattatgtaagaatccaggatgcttaagccacctcagtctaacagcctcccaattaattatttaaacagtacttatgaatagatccctacactcttgtatctttacgttttgaaagtgtgcagaaatggtatcagagagtatgtatccttttgcaacttgttgctgtcactcaacattatgattttgtgctttagccacaggacataaacatgccatacagagagtggagatgagcattcactattgcacagtttacatttattcaactaaatttagagttcacctggggaatgagttgacaatgacaggtttagcatttatagaaaatgctaatgataggcagataggactggacaccagacacgaaagtgaacacaagaaaaaagaaatgtggttgtttgtactctagttgttccatttcccgtttcccttataatccatcctttgaaggcagttataagggctgcatggtctttgatgattacaggttagaaactgagtgattttccaagaggcagtctaccctaagtgaggtctaggcttgggcagagactaaggagccaaatctctggtcttccgtcagaaaatgtgattgtttataacccagcccctacttcttgcccctgtagatctccttttctactgggaactgtcttactagtgagatctgcatcacacaggtttggagagcagggaggttaggtgggtgacttccatgggggttctttcttgtcctgccatgtgtacacccacttccatttcctactgccacgagaaacacctcatttgatgttctatgcaacttgccagtgagtgcttttcaatttttttatgttgttaaaacaaaataactaaagggttatttatttccaggacacaaaattaagtcactgatttaatcagatatatgtgagctattatgtatactccgtgtctcttctccatttactatattactctctgaatgtttccaagaaactctttacatacagaagttccctcaaaacaaaaaagggactatgcacacattttacttttgaggtggcatttacttattcaataatatctacaaaattaaatgttatatcgaccttgcgtcactgtcagctagttactttttatttctgttgcatttccaagtgtgttaaattaaagcaagtggcttcatgccaactaaactgcatggaagctttttaggccttgttcaaatactaacaggtttgataaatatatttgtctagcaagagtaggacaatgagctctttgtttactgacatactttattgtcattctgctgtatacctctcgtgtggctgttttataggacataaagtctagctatcctgtcggaatctcagatcttatttatagcttgctgcaaagtggcttattgtcatttattatttcttatttgatttatatagcatctttccaccaaagagcccataggtttatttatatacagagtacacacacgcacacacacacacacacattcttacacacatccttgaacttcactcaatgctatgatgtagatagcagtatagaaccaaaaatctgtatgaggcctttccatttgtttttgttctacggctatgtcctggcagggcaattgccatattttttttcactttgagtgttttatcttttgcctctaggtggatcggatcattttctgtgtcttcttagaagttgacttcaaaatctacaaaaagaaaatgaatgagtttttctccgtaggtgagtaaagcaacttcttgttttctttcaaattgaggatggaagaagtggagccgtcacttctattcctattgtttttcatcttcaggactgttacacatggtgatcctgccaacttgtatcatagtttctaagaactgaacaaggtaacagaaaatctaggctgtggaactcttgccccaagaggtcactgtgttgtcttggggaagtcagttcatctcttggttctcggtgcctcacatcaaaactgaggggctaattattaataaaagatttctaaagatgcttcccctggccttaaattgcatgatgtgtgattccttctccaacttgtaagtttaccaggccccatgcctgcatctaccatgttaaataccattgttggaaattgtaagcccatttatattcatagtcagaattcaaacttttcctgcattccatccctattccttcccaagtttctcactccaaatttcaatgcctatagtagcacttctagtgcagtctgagaatggcagtcattcacacttctttttagaaaataggagaaacctcagggttattagagaaccttgagtaatgtatttacatcgattgaatgtgccgttagttggatttgggtaatttggatgtttttctccactctccctcttccagcctattaaggctgaggcttgtttaatgccttgttatttttatggtgccattaaagtcacagtgtccaaagtgctttccttagccatggcaagaatcgcttccaggaaatttcaagctactgtgagcattgttggtacttgcctttcagagagctttcttttgaggtttctgtctccgtctgaagtagtttgtcatatcacaggtgactctggcaggtgggatggagtgaatgaagggtgctgatgcatattcatcctcttaagcagtctatcagagccaaacaataaagaggatgccttgcctgtagatcagagtaggatgtgttctatccagaacagctgtagaaaaccaaaaaaccaatggagatggtcagctctctgctaatgccctaaatggactaagttcttctaagtaatttcaagttcttctccctaattttataattgaaagctggctctgctaagtgcatttaatttaaggcttcaactaaagtattcctctaactgaaacataatgtaaattcctcagattcccatgtgataaagaagaggactgtggttataatctttttctcctcttctttctctttctcctctgcctccttctccttctttcacctttcttcatttttttcaagcatctcagtgttttacagagtggaagcacataacagctatttaataattagttgttgagacgagttgaattaaataaatttttcttgccttaatctgatgacttttattgtttcaatgtccttgctccatttttccttttgacttgctttatgacaatattgagctgattggtacctgtattttgaagtattgttaaaagaaaatgctaattatatttttaaatgtgacttgccatgatgtgtgaagcaaatattctcatgtcttgtcagtatcacatcataattgataagattttataaactttagactccttgagatgtttggaaataatgacatcatattcattttcatgtattctaaaataaagtctgcaggaagccatactaacataaggtaaaaaataattgcataattatgatctaattgatattgaaacaaatatttctatcagcaggtatttccaatgatgcacagtcaaaaagcatactgcaaattttttttaaaatgagacagttttaggagggtaaaatatattaatacttatgcaaacaaattattgtttgaaaaattgctactttaaatacattttaaaatgcattgcagtacatgagcaagtgaaataataaaatcatcctcaatctcacatcaatgctttgaagcacacagtgctcatgaaattattttcagtccatatttacaataggaagtacattttaaactaaatgtcaaaatcctcaaaaattgtgatttctgcaatgttgaagcattaggtatttgaaaattctaaatatgcaatatgaaataagcgtgatgtatgatggaatgtgactactaatatacataatataccttacctgtcattaattttaacttgtgtttaattcataactataccatctttaaattaggatacgtttcttcctacttgccatgtatttccctatagtgcattattattcatgatatctctaactagtgttcataatctttcccaatgcaataatgataatagtttagaaaagaagtcatttttataatcaaacaaaatatttgtgttttggggtactttaatcccatgtctgtaaattttataattgggaatctgagacacaatgcatgataaaacaataaaagactcaaagagatcatactaaaggtatgccacatgcataactactacagttcaataataatggttcaatgataattgctattacagttcaataataatgattaataataatcataattaatatatttaataacataacaataatggttactaataattcaaacctttttgaattgctttctattagccagccacagcattcatttctttacatgggtaaatcactaatcttcatgataactctaagaaaggaggcaccgtattaaccctgtgctgtggttccattgttagggttttttctaatttggtcttaaggtttctctctcttgagaatggccatcagccaggatagtcactctccaggaaagctttgaaaagggttgggggaaaattgggttcagatatgtatgtcaggggagacacagcgaggaagtaaaaccaaaatgcacaaaacagaaggcatttattactcacaagtcccagacaggtgagggatgcccacaggagaccaacaggaagcctggaggtggcagggagcccagccagcaagtgggcagcaagagagagcaagcacctgggggctgtctttattagttctgtatgcaccaccccttaggctttcccatgggggttgtggattggctagtttaaagaaaacactcaggaagcaggaacttacttcgatgattctgacactattagatttttaccatgatcagcagttgtggagtatattgggtttggggtcagctggatgaggaacaagtggaacatatcacaactgatcacacagggagggaagtttaagtaggccaaaggtgacaggatacaactgggtttcaaacaacttatgtcaggcctaagaatggaggctggccaggcacagtggctcatgcctgtagaaggaggattgcttgaatccaggagtttcaggctagcctgggcaacatagcaagaacttggctctacaaaaaataaataaataaaaattagctgagagtggtggtgcatacatacctacagtcccagctactcaggaggctgaagtgggagaatcacttgagctcggggatttgaggctgcagttggctatgattgcaccactgaactccagcctgggtgacgaagcaagaccccatctctaaaaaatataaataaataaataaataaatattgtagagattttaaaaccaaaaggaaaaaaagaaaaaaaaatggatgccaaggcagcaactatatgaaacaaatttatgataccctatgttttaggcatgaaaaacgaggattcagctaggaagcaacagagctgtattttaaaattgagattggcatctgtcattgcccaagtgataataggttcgttttctcagagcatctttagagaaggctgagatcaacttccaggctgcatttggagtattggggaaagtcccatttcatctgctgcccatcatttttcagagatgccatgcttctcttcttctagtacctataaataccttcatggaaacttctaatatgagttgaattagtacttttatcattcatctcaaaattgaattccattcacattatagaggtattgtggtgctattacctgcagatgagcaggtaagtggtaaacgagaagcccaaaggcctttatagcatctacaggacaagatggaaaatggcttatattagtttgtcaggcctctaaaaacaaagtaccacagagcaggcggcttaaaccacagaaatacattttctgattattctggaggctagaagcccaaggccaagtggaggcaagattaatttcttcagaggcctcgctccttggcttgtagttggctgtcttctccctgtactttcaaatgaccttccctctgagtcatttgtgctgtatctttctctttgtataaggataccagtcaaatgggatttggacccactctaattaccttattttaatttaattagctcttaaagatcctatctccaaatacagtcatattctaagatatgagggttaggccttcaacataaaaattcacagggcacaattaagcccataaaattgccccttgtagaaatgctttaagaaactccagggaaagaaaccagcatcgaattttttttcaacagttttatatcttgctgtggggtaaagcacatttgactttttccttccacaagtattatttgaaagtagagtgtggcagctttatggaattatcatacactttggttgcaaataatttatagttacagtgcaccattacatggcctacagcaaataatatttgtatgattcaactcagaaatctctttgttctttacataaaagtgcttgtattttttcagtgtgtagaatttattgtgtgcagttttcactagacgtaaaaaattaaaaaaagaaaagaaaagacaattcccgatctggaatgtggaagtcattttttcttttttttctactagagtcttagtcctgctagagaactgaaggatattaattttccccgtaataacaataaagaacatacggtttataacggtattaaagaatcttgacgttggaagcttaagacttgtcatggtaaaccctccttcactcctccctttaggaaaaaccaacctttgtttactgcaatggttctcaactacgagcgattttgccctcctggggacattctgaggcatttttgtttttcacagctgagggatgggagaggttactgtgctctagtgattagaggccaggggtgctgctaagcattctacagtgcacagtacagcaccctccacaaccctccagcagataattattcagccttaaatggcaatagtgcagaggttgagaggctccatctgctggtactgtctcttaccactcaggccattgccgcagtctttgcctttggattggggttattttacagtgtttcgactgctgatgctttacccataagtaactatctagctggatttggaacatgtaccctcagcctggtctctggcttcctggattcatgaccctcctagtccagacttctggttttgcaccctctctgttcactctgtacccacagatttctatatcttgacctttgttaaccacatacacctgccacccaacccctactctccaggtcctcctgccaccaccccactcctggtatcatttatctattactgcccatgaatctagagtaataatctcagaaaatatgatcattacataggttttatatatctaataaaagtgtggaactaaaggctagtatacagagcaatgaagaacaaattcactaattattttctttatataccttaagcaagtttcattgcttcttgggctaatacttttctttttttttttttttcattagtttggtgaccattggttgataaacttaccttgtgagctcacaaaatatgttttaattttagataccttcaaccccttatcattatctgcatagtaactgattcattcacaatgaaatcacctatgactgaaaaaactaccaactactattttttaaatttgtttttcagagtcagggtcgtactctgtcatctagactggagcgcagtaacgcaatcatactgatcataactcactgcagcctcgaacttctggggctcaagggatcctcctgtttcaacttcctgggtggctgagactacaggcacactccaccatgcccagctaattttatttgtttgtttgttctttagaaacatggtctcaccatgttgcccaggtttgtcttgaactcctgggctcaagtaattctcctgcctcagtttcccaagtctttgggattataggtgtaaaccactatgcccagctctaatctctttaattttttaaccataaaaacaattaaatttgtcaattttgtttccagctttgaaatttatataacgtatacacaatacgcatgtcaactttacttaaatgtgattaacatatatatatatatatatatatatatatagagagagagagagagagagagagagagagcaatgctgggaaaactaataagataggaaaattaattgcaggatatccatgtgctcatcccaaacctgacacctgtttataagaggaagattttatttaagatgaaaaactctatttatgtctatgaaaataattttaaaactatatttaaaaaattaatagaaaaaaagctaaaatattcccaatgttcttgacataaatagtaaaataatgagctatttgacctattaatatttgggacatctatctggtacaacataaaatgataaaccttataaaattgcaagaagtttgtatgccttaaaaatgagcttgcaaaatagtagacataaaacatgtataacaagtgttttgtagttagaactaggtaaacttaatccataggagttataagtttataaattataaactttactggaaatgttttgtggtcttaaatacagattttctttttgtattatatataacataaaagcatatagatgataaagtaaaaccctaagtcaagtttgagaattatatctcgggaacttcttgaatatttaacatatctcaatgtctagctaaaatgcatacattttatttctcaaatattgacagacatgttattaattcactttacttgagtacgtgaacatatttaggttacatgtattttaccttcttagatacagatagcactgagaaagtgtagctttgcataatcatgataaagaaaattctaaattcatattttgataataatttttaatatcttaaatgcatgccaaaatttttaaaacgaaacaaatcaagaaacttctcaaccacgtttcacttattttgacctccttatagtcttccaaacatgtaataaatattattgatatgaatatatctttcgtttattttcccaatcatgaatttctgccatttatttctgtctaaactatacacactcctgcaaggcagctttagttgggttttatattattattattattattattattattatttgacctttttatcttgatctcatcaatgaaaaaataagtttctggagaacagaaattattcctaatattccattgccctttcagaatctggaaaattctaaatatatagtaggtgtttattaatgtaaataaaaacgtaccacgaacctagactgaaactgctacagttggaatgtgtatctcctccaaaactcatgttgaaatttaattgccgttgtaacagtattaagaggtaagacctttaagagtgataggccatgacggctctagcctcatgggagggattggtgtcattataaaagggtgagttcagcctcttgccctttgccttccactttgtgatgtcttccaccatgtgatgatgtagcaggaagaccctcaccagatgccagcactttgatattgggctcctctgtctccaaaactgtgagccaatacatttctgttcattacgtattacctagtctggggtagtctgtagcagcacaaaacagattaagacagagagaatatttaaccaaagtttcaggtaaaaagtcagtttttcctagaaactcttaagtattgttaacacagctagacaagggtatagcactgctttttacgtatttatcaaaattttcaaaaattggctggtcacagtggctcacgcctgcaatcccagcactttgggatgctgaggtgggtggatcacaaggtcaggagtttgagaccagcctggcaatatggtgaaaccccgtctctactaaaaatacaaaaattggccaggcgtggtgataggcgcctgtagtcccagctactcgggatgttgaggcaggagaattgcttgaacccgagaggtggaggttgcagtgagccgagatcacaccattgcactccagtctgggtgacagagcgagactccatctcaaaaaaaaaaaaaaaaaattataaaattaacatttaaagttctcaaaaattaaaaattacttctctgacaaatgggcacaaaactttaaaattttacccaggcagtatttaaattttttcctggatttcacttttaaaaatcttagctctttaaaagcaaacaaaagaaagtactcacattatgtcttctgcatcctccctttacactgattttataagtttatctcatccattatcattcattatctttctatcagttgtcaaatatttgttatgtgcctactatgttcccaaggctgctacattgaaggtactgttcttgtaatagtcctgaagggcacatatcatataaaacagttggaaaacaatattagcaaataatcaagtataacattgatacagtcatagcacccaggaattcagaggcaaatgtgtatgaggaccagattgattgggacagttttcatgaagaatgtggcactttcagtgatctttaaagaatgaacaagggtagagaagttcacgtctggtgttgggtaagcaacatagagggagaatggcagttcagattggaaaaattgtaaaataaagtatgatgcttatatccagtttgtgaagccctgactgagaaattttgacactcttgtcaatgtattatgcaattgagcctaagagtaagtccttggttgagaaataggatagattctatatttaagaaggattaactcaattcacgacttgagagactggcctttcaacaacacccatgccatggattcatcatctgcttttattgagatagtagtgaacaaaggctaaagaaaagtcagtaaattgaccaaagtcacatagttgggtatgtctgagctcaaatcctttccactccgtaatgcttcttcccttagcaatcctgaaaacatggacagttgtttgaagctacttgtctgctaaaaaagccacatattatccatttgcattagtagggctagagctcctgaaaagctagagctcctccaatcatatggtatatccacatgtcctctttccttcttcttcttatctcctctctggtcatcagttttccaagaataataatgaagcacacagtgtcatgagctgctaaggttttctttcctcttgctatgtccgaataatgattggaagatagaagcttgaagaaggggtggtgaattcctgagaaaggtagcaattgtctaataatgaggtcaacagagacaaaagcatctatggtaaaggggaagaaatgctaggcttgttattataagaaatggtctcatcttgtcacagccaccttaacactgtgtggctttgcgcatgttgtttaacctttttctgcttcagttttgtcatgtgcaaacatactaatggaccaattccaaatataaggaatagtaatataaatgaaagttcactagatatgtacaccaagcatcataaatgtttaaatatccatgtttatttcttattacaattttaaaagtaagtagttcaacttttgtaatcatctttgaaaaatatataaaacttcttatcacagaagtaagataggtttatagtgaaaaacagataagcaaaaagaaaaaaatacaaactattttctgtcctataatctggagatgaattacattttgttgcttatccttctgatctttagaaatggaaaatgcaaacagccagaaattagtcttataacttgctatatgtcatttaacataaatcatgaacatttttcacatcattatgaattcttccataacttaattttaatagacccaaagtttactcaaaaccatactattgaacttaggaattatttctgtaaattatttctctatttgcttataaataataatttttaaaaatcatctttgtagttaaatattggcatcatcctcattttaaaaaatacttttctaaaagtggaatcactttttcaaaatatatgcaaaaccaagacacttttgctagtaattgtcaaattgtgcactgtgtttgcagcactgcagttgaatgtcatgtactatacaacttacagggattaccatccacagggacagaaatataaatgcccgagcctagcagtaagcaacctgagtttacattcccatgagtggtacatgagagtttatttttttcctacctttctcagtgggttacatcctactgttttgatgttagcacttttatacatgaaaaaaaggtaattaatgggtaacaacattcatttattttattactaatgtggtttaacatttttccagttatttatctaaatttcttacacaaaattgctgatcataacccttgtacatttttatttcatctttttcttattgatttataagaactctttgtatattaaggttattaatctttcaaatatatgttgcaagtggtttcccagtttgtcatttgcctttgtgatattcttttataaccaaaacagtgagaaaaggtagaaagataagattttaaaatatataaaaaagaaagaaggaaggaaggaaggaaggagaaaagggaagatgaaaggacgaaaagtccgaaggtttaaaaatagaaagaaaagaagaaaccctttttaatgaaagagtgaggttaaaccaaaaactcaaaaatgaccttgattttaagcctatggacttcgcctcacagaaaaccattttatttctaattagattgtttctagttctcctcttcagacattttattattattattttttatttgttattatactttaagttctagggtacagtgcacaatgtgcaggtttgttacataggtatacatgtgccatgttggtttgctgtacccgtcaacttgtcatttaccttaggtatttctcctaacgctatccctcccccagcccccccaccccccaacaggccccagtgtgtgatgttcccctccctgtgtccatgtattctcattgttcaactcccatttatgagtgagaacatgcagcatttggttttctgtccttgtgatgttttgctgagaatgatggttttcagcttcatccatgtccctgcaaaggacatgaactcatcctttttttggctgcatagtattccatggtgtatatgtgccatattttctttatccagtctattattgatggacatttgggttggttccaagtctttgctatggtgaatagtgctgcaataaacatacgtgtgcatgtgtcttcatagtagcatgatttataatcctttgggtatatacccagtagtggggtggctgggtcaaatggtatttctagttctagatccttgaggaatcgccacactgccttccacaatggttgaactaatttacactcccaccaacagtgtaaaagcgttcctatttctccacatcctctccagcgtctgttgtttcctgactttttaatgatcaccattctaactggcatgagatggtatctcattgtggtttcaatttgcatttctctgatgaccagcaatgatgagcatttttaaatatgtttcagacgctttgtatacaaagcaatctgcttcctgatttaccaaatgtggtaggcggaaaaatgtcccccacaaagatgtctacaatctaaaccccagaccctgtgaatatgttaggtggcattgcaaagggggaaataagattggtggtggagttagggttgcagttagctgaccacaagataggaatgttatttgggattgattctagaggtggggtcaatgtcatcaagagagttcttaaaattgaaagaggaaagcagaagagggaaggcagaaggagctgtgactgtggaagaatgttcagagaactgcaccattgctggctttgaagatggaggaagagggccttgagctaaggaacatgggcatctctagaagctggaaaagcgaggaaacagattctttcctggagcctccagaaaggaaagcagcctagctgatatgttgattttagtctagttcaacccatttgggacttccaatgtacagaattgtaagataataagtttgtgttgttagtagaaatatgttacaacagtaatagaaaactaatacgccagtcatctatgaataagtgaaagaaacacaagagaaacttcttactcagtctgaattgtacattttccccccaaatgatacattcaatgtagagaaaaactagagtaaaagaattcagtattttctttaattatgaatgtttacaagtacatggcacatttatgtacttttaatgtgcagatcacattgatgtttagaattctgcaagacaagctctctataatgtaacataaatgagttaactgccttcttaggaaataggtgctaaccatttccacttgatgggcctcaaaagctgcaaacacattttgccttcaatgaaaatccagtgaagtgttgctgtaaccaagcaacctgaatgcaggaacaagcagccggcatagacagaaagcaatctgtcccttccaacggaggggagtgtgcagtgagtgtagcaaatgctgataaccagcagaactcatgaagacctgggaacatgagccttggctaagcagagtttgatctcattaggaagttctggtaaaacagacacaactaaatgctagttggagaagggagggaggatgttgtagtcatctttatagagaccgctgcagggtgcttttgaaaggcctttcaaacattctgggtagactggttttggttctttagttgaaaacattgaggcaaatgcaggggaaaaaaaagtctttttaggaataatatatcaataaaataattcttaagaaggcacagaagtaagagtaaagacaaaaataaacaatagggaaactaaaatttctgcaaactatattccactttatgtatgaacctgacttttattgtcagctacatgtcttttatatatatatatatatatatgtgtgtattttttttattacactgtaagttctagggtacatgtgcacaaagtgcaggtttgttacatatgtatacatgtgccatgtcggtgtgctgcacccattaactcgtcatttacattaagtatatctcctaatgctatccttccccctgcctcccacccaatagcaggccccagtgtgtgatgttcccttcctgtgtccaagtgttctcattgttcaattcccacctatgagtgagaatatgcagtgtttgtttttttgtccttgcgatagtttgctgagaatgatggtttccagcttcatccatgtccctacaaaggacataaactcatccttttttatggctgcatagtattccatggtgtatatgtaccacattttcttaatccagtctatcattgttggacatttgggttggttccaagtctttgctattgtgagtagtgccgcaataaacatatgtgtgcgtgtgtctttatagcagcatgatttatattcctttgggtatatacccagtaatgggatggctggatcaaatggtctttctagttctagatccctgaggagtcgccacactgtcttccacaatggttgaactagtttacagtcccaccaacagtgtaaaagcgttcctatttctccacgtcgtctccagcacctgttgtttcctgactttttaatgatcaccatactaactggggtgagatgatatctcattgtggttttgatttgcatttctctgatggccattgatgatgatcattttttcatgtgtctgttggtcagccacatgtctttgaagtgttgtctgtctccctcacttgctggtcactccataatccactgcaataacgtgactgtctctgccttcctactgcaaccatccttgttgaggttattagaacatttttgatggcttgagcatgggaactgaaaccattgcgtatttgatcacatgaccctttagagctcttctcactttggactgggcactctttatcctggcgactgctctgccatcttttctttctgaccgtcatctgtgtccatcccagccctctctggtgtacttgcttgcacacgtccatctccagctgggagtctctcaggcgtcttcaactgaacatatccaaaattaaattcaaaatctgtttctccactcctcaatcctcctcttcctaaatcccatatctctgtaactgatgctataatgtgcccagttgggcaagccagaagcagcagcatcaggcggtgccttttatttattgcttgatttataaagtaattagatttgagtgctcattttggccaaggatcagttgaaggaaaaaaaaaagttcccttttttttaaaagaacaacaaaatttctcctggctttatcaatcaccttcaaaaagtagatttagcaatttgttagatgcagtgagtccaggtattcaacttaatggcaggagtcctactcagggaggactctcccttatcggacattctttgcctgaagtttctgctttgtcaagtcctacaagaagtcatgaggataacgacctcttccctactacgtagaagccctaaacaaagctttatttttgctaataatatttcttttttctgcaaatccaaattgttcctagaagcttttggtaatgaaatattaaaaagatgaggagtgcacaagaagcctgtggtaagaaattaagctctaaggaagagaacttggaagcatgtgaaataaaaccacagcaggattatcgtaattgttctccttgacagacctgcccatatgtacggatgttcctgaaaatttgacaagggaattttatgatctatttcaggtgtctgtccatttttttcccttgggagtggagaggatgccgtaatagctcataagggtaacattccccttcataacaccctccttttctcatgccacccacagacctccttgaggctagtctccattcatgctcatgtctcctagccaatctaggaatcctggccatggaccatgataatcttgccactcagctgcatggtagctgagtgacttcaagcacataagaaagcatacagtatcttatgaaaagcataactgttcctcaaacccagcaaccatgtggcttgggcacctcttaccacattagtgttagtgagacatcacaagttagttcagttgaaatattggacatctactcttttgaaaggttcttcttcaacaggccaatattggtgctttggaccagtggctctcaaacttcagtgtgcatgagtgtcacctggagggtcctttccccagagctttggatgcaatagatcttgagtgggacctgagaatttgcatttctaacaagcgttcagatgatagtggtgctgctggtccagagagtacactttgataattaccttaaataaagttctacggggttttctttgcttgtttttgtttatttcacttccccaaaagactgtattaattatggtggctctaggtaatggagtaagacaaatctgaagtcattccaaaacccatagcatacttccttttccaaagaagtgtggactatttgctgttgggaaatgacaggtacctgctcagaagacaagtataataattaaaacaaaaatcattcacattaactctgtctccaataaaagaaggtgaaatcaatgttatagagctcaaagtaggttagacatttccttatgaaggggattctgaagtatataaagctagcttttacccaaaacttgttattcatgagaaactagttggttttcacatatattttgtgatcaaaataagaacttcggtcatattcatgtgtttgtgtagaatgcaacagggtaatctaacacaggagatacagtgaacaaaaacagcgtctattatgaaattaacatcaaagaggtcccgtaagattaaatggagctttagcctctgtatggtctgtgcctgggaaggaaaggggatttttctggaattggcatttctgaacacacagaacaatgccgtctgattgattgctctctatttagaaatagtatttctatcactttggtagaaaccttttatttcatttttgtcctctaacaaagaagtatgatgcttggagaactgtttaaaagggctgcaactctgtgcccatgcttcatcagtctcctaactactttcaaactttgagtggcatgactccctacttccatagactatcacctttttttaatatttttttgttcctagttttgttagaaaaattcttgctagcaatttgttgcacaaatatgactcaagcaagcacattacatagaataatgttgaactaaagtagatttcattaatatgtaatggcacattaggtgctttgtagagcaaaaggactctgtgcttgattttaatacaaataattgcaaaatattaaggcatgtgctttataattttcagtaaatttgtctcataaaaagttatctttcaaaagatggtatgtcactcctctgctcaaagttgtttaatcactctacaatttttcaaaaaaagtttgaatgcttcaaccttgtatattagtcaggtttttgcagagaaaatgaacatatattaaaatacatggaaagaggtttatcatagcaaatggcccatatgattatgaaggctgttaagtcccaagatctgcagttggcaagtgtgagacccaggagagctcatggcatagtttcagtctgagttcaaaggcctgagaaccaatggaaccaaccgtgtagttgtagtctgaatgctggcaggcttcagacccaagaagaattaatgtttcagtttgaatctgaaggcaggaaaaaaaccccaatggccaactagtagaaaggcaatgaggccggaggagttccctcttactctccaggggtcagcctttgtgttcttgttagaccttcaactgattggatgaggctcactcacatcagggagggcagtctgctccgtacccattcaaattttaatctcattcagaaacactcacagacacacccagaataatgtttgaccaaatgtttgagcactctggaccagtcaccttgacacataaaattaaccatcactcctggcatggaaggtctgtattatctagccagaacagatcgggttagttgcaatttctcagataactcttcctttggccattcatagctagttttatttccttaaaaacatcttgatgattcacgtccacatgtttttacagatgtttttccctctgcttgagtgtgattacccttgtctttgtttgagttccccaataagcagatcctgaaacaaggactgaagtagaagtatgttggggcggcgggggtgtggcagggagatgatcccaggaaacaccagtagggaagtggggaagtgagacaagcaagagcagtaggcagtgaggttaagctctaagccagttaccactggacaactggggctcaatcccagtaggagtgaggagactcagggagatagtacagaacatgctttgaattaggccacttgggaagcaagggatctggggtacttatatgcaaattgtccatcatttgagaaaggctcaaccctaaagggtgttaattctctagtattacttgaatgggattcagcaagcagagagagccctcaggcaaagagacccaggagctggtggctcaaaggcaggctggcatgcactgaattgtcaaggaacaaggagttataggcaggacatccacatctaggcatctactgtagcctttctttttccctacataactttaactcactctttaagactcagctgaagtcttgcctcttctggaatgccttcatagaccttctctctgactgagctggctcttgtatatttcccaatacaacttctgtttacctccatcagataatctgttaccttcttctctgttgttttgcttttctatatcgtccactttgtgacctccttgagggaaaagattgctaacctgtatcttcgtaatgggtacacaaggtagagctcaagaaatggttatttgactagcaaaaatagttataaaaatgacattataatgtaatcactcaatgggttattcttgcccactgcacagataaaactaattcagtgagacagcagtattgcagtagagaaagagtttaatgcagggctagccaagcagaggacagaagtttattactcaaatcagtctcccaaaaagcttggaggctacgagttttatggacaacaggcaggggtctagggatagggtgctgctgattggttggggatgaaatcacaggagtgtggaaaactgtcctcatgcactaagtcagcctctggatacgggccacaggaccagttgagtaatgaggcaaaggtcccagtggagtcagtcagttgccagaatgcaaaagtctgaaaaacatctcagaagtccaaccttaggttctagaatagtgaagttatctattagagcaattgtagaggttacatgtcttgggacctctagaacaatggctggttattgtttaaatgtgcctacgtcttagtagaatccaggcttctctcataatcatgaccttggggcctttcgttagttttacaaaggcagcttcagtcctcaaacaaggaagggatagttttgagaagggctattatcattcttgcttttaggttaaactataaactaaattccttccaaagttggcttgggctatacccagaaatgaacaagaacatcttgtgaggttagaagcaagatggagtctgctgtgtcaaatttctttcattgttatactttttctatgtcagatttctctcattgtcacaatttttgcaaaggtagtctcagtaatagcaataatcagtatttattgaatgctcattctgtgtaagcacttgacatataatcctaaccctaagaagttgataattttattatccctatttttcagatgaagaaactgacatataggttatatgttacttggaggccaaaagataacttcccctttgccctctgaaagttcactaaaagtaagctgacaaaaggcaggttaatagcagaaaaatcatacaaaattattttaacatgcataagcatgggagaatcgcatgagaatgattatccactagctaaattgggcacagaagcttatctcttcttcttcataggggagtggacagatggggaaagtagacaattttttgaggagcaataaataattattagggagaatgaatggacccaggagacagaaattaacttgtaaattattctctttggaatttgaatgagcccaagaggcaggcattatcttgtgaaaaacatctgtccaggtgtggttacattctcagctttcttttctgcaatagataatgagatttcaggcagaggatggaagacaattgtgttccttttttggggctactgtttctagatagataagggaactgcagagaaaatcttcaccctgtgctttgggagagacaagggattgagagacggtagtgaggggaaggtccctcatatttcagggtgaaatattctggtattcttcttacccaagatttgcatagttatatgtggtttgtcctggaagtaaaccgaaccagtctgagtccagactctggacagactcttaaccactgtatgactaaatcagtgcgtgaatgaagtgaatgaatgaataataaccccaagcctgatccttccacacatgggagtcattctggggatgacgttatcaggacagtctatgtagttcaaatatcagcttcagtgttatgttctacatacaagaagacttccaagtagcttaactagaagtatcaatccttcctctgacactttttaatagcattgactaccatatgttggaatgtatttgcatgtcttggtttctttactactgacaagattcttaaaaaaaaaaacaaacaaacaaaacaaaaaaaactgcttaagtttctatccatcttggtgttttctacagccccaaacataaagccttgtacacaataggctaaccaatgagtgtttgccaggtgaataacggaaatataagtgacaagcaaagggatctttgactcttcctttatttttccccagaaactgtagagactcttttttatctctctctctgagattccagagagtctgttgtcatacagattttagatggctctgtaaaataaaattatatttaaagatgttaagttcagggaagaatctatgaagtttactttgtaacattttggtaatcatttggttagaaaattatatttctaagaaattggtattcttccttccaaaactgcattcatagaatgaattttaaaaattatgtagaaaatcatcagtgtttctaaaatatttccatggtaaaaaaattacttctttaaaagttaaccatagttatcaagaattgcctttctaaaacctcaaatgaaaggcattttctctttcctctgactaataaatctctaatcatcattaataattaataatcaattcttagaagaggggcagactgagtaaatttggctgggatgactaaattacaaagcacatatataggagaaagttgtaaatcttcactgacttcccattatttacaaagtatcatatagctaatatgtataaaacacatagaaaataatataaatttaattcagtggacatttattgattctagtatataaaatgaatggcattaagtgccaaggaatatacaggaacagaagacctggtctccatctttacagaatttatgatctggagaccgatgtttgaaagagagataaaataacaagtagactgtgtgattttattataataacagctaatatttagcacttaacaatgtttcagtagctgtcctagtgctttacgtggcattatctcatttaaaccttaggaaagctctatgtagtaggcattattattatcccactatacagctgatgaacctgaagctcaggaagatcaaggtaacttctccaagatcacatgcccaggggatggatggatggaggagccaggatgcaaacctaagcccatgtgtatttaaagtccataccaagcaggcagcaaaaataaggtacatcaaagagcacatgattcattcaaacctggggaaatcagaagctatggcacctaagcttgcacttgaaggatgaaggtgaatagagagggagaagggcattgctagcaggaccaaggcaggtagacgaggctgagggagaccttgagagatcagagaagagttaagtgttgccatccatgtgggtggtagcatgcatgtaacagaggaggtgaaactgagaaaagtgtttggaaccaggtatcattggccttgagtgttatcgggaagagtctagacttttctcattaggcagagggcagtcactgaactgttgtgaaccagatcagagctgtattttaagactgatttggcagtcacgtgtaaaaggagtgagatacaggagagagaaaaagagaggagcagttaggaaactgctaaaatagctaaggcaaatggcactgggagtctgaatttgtactgcaataatgtgaggagagaggaccaaacatagaaacaggagaagatttggcgctagctgatattttagtccatttgggctgctgtaacaaaatatcatagactcagtggcttacaaacaaaagaaatttatttctgacagttctggaggctggaagtccaagatcaaggtgctggcagattcggtgtctggtgaggtccctcttcctgtagagagccatcttcttcctgtgtccatgcatggaggaaggggtgagaggtctctcttaggtctcttttataaagacactaatcccatccacagggctcctttcttatgatctaatcaacttccaaaggcctcaccttctaatcaccatcaccttggaggttaagattaagcatatgaattttggggggatacagatattcagaacatagcactggttgtggggagcataaggagagagacgacaatgtgtcagaagttcaaaagagcaagcgtgtcatctatagtgcagaggaatcacatgtccttgtccagttaaaagggattatactgggagatgatgggagctaaatgggagtggtgcaattggtgggacacttgaaagcacatgagtgaaggctgggatttccaaatgcagcaaagcagcactttccatggtgtggtgcggggatttgacatgtgtcggtctatgaccaaataatgatgtccatacttctcagatacttgaagtgagcatgcagacctttaacaaagttagaacatgtggcatttaaagtctgtgatttttaattttgagcaattgaaatgactgaagtgaccatatataatttctataagtaaaacaaacgattgcatatacagttataaatataacaatttttaaaaggaaatgtaaactctaggctttaaattgtgcattaatgtgtatactttcttcttaacttagcatgataataataagacaacagaaatgcatgttttaacagtctgttttctactgatctgttatccctttctttgattttttttaataatccatctggaacattcttgtgtttcccactttcatataagtatttctttatgttttcctattttttaacagacgataataatgaagaagaagaggatgttgaaatgaaagaagattcaggtattaaattcatacttttattattagggggtaggtaggggtcattttgttgtttatgtacacttcatattttttcaacgaaagacaaaataagattaataaaatagaaatatatgctcagtgttataaaattaaaaagtagttgttctaacacttaaggctattgcagttgctgtatttaaggaataaatttgaccttgagtttcctgacagcgaaggtaaaaatggaacatgatgttgtggttaatacagttatataacgaatcacccccaaaacttagagtaagctgaaaacaaccacttcttacgctcatgagcatagcagagataacttaatcatcctgttcacaaggtttggagctcagcaggaagattcaacagctggaagctgggaccatctgaagattcactcacttgtctgtctagtgattgatctcaactgtcagctaaaatcttagctgggacaacttcctaaaacacttgttcatggccacctttatgtggcctgggcttcctcaaagcatggcggccagcttccaaaatgagcttctcctggaaaaagggagacactgtattctcaggcttagacattccattgcatcactccatgtaattcattctttggaatagtcacaagcctgccaaaattcaagaggaaatgaaaatgaactcaatctgttttggggagtggttctatagagcgtgtaagacctaaaatattgctgtggccatctttggaaaatacactttccacatactatattttgctctcattatcagaattgagatgcatgccaactcctcaacaaagcccacttgttatgaggaaaatctagtagttaaatgcacaggttatggcctaaggtagccattcagtgtgtctttgataataaaggcataaatcagtagacctgaattcacttgtagctctatcaattattgaccttaggcaaatgtcattttctataagctgagtttacaattctgggggcaataattcttaccatatagttttctttggaggattaaatcagataacatacctaaagtttcatacagtgcttggaccatagtaaagattcagtaaattattgcttttttctttctcattctaacagatattagaaggatatagagcttaagtctatgattaaaagctccttcttcctcattttggcagtcacagtgttctgaccatgaaagaggtatctcagaggccctgattttgtgttgcttctcatttgatgccagaattccctacaaatcactgacaggctcagtctgggcagctccatcagcagggagctctttaaattctgatgcatttgatctcaatacataaggtttgatcggtgtggtccttctctatgttaagttatatctctctccctccccggactgcccactatcttcaaggggaaataacaccagtttattttcttcataaaagttcattggaacaaggattatagcttctatctactcttctccagtccaaacatgtctgattcctaaggtttccttggacttccaaatgcaatggattcagagggcatgagaagcagaagcagaatctaaaagtcaggagcaggaataaaggaggtagaagaggaactgtagcagtggctgttggtgccctacttatgtctccttggtgcttgctgttattttatagcaccaacagctttccaaagaaagtccttatgactctctgctgagcgctttacttgtcctggcagcaaactcaaagcaccagagaattaatttctctggagcagacctcaaccaataacagacaggaattggttggttaatacccacatctgactcatgttctattctaatgctgtctagtagaaacataatgtgagcctcaaatgtgagcctaatgtataattttagattttctagtagccacattgaacaaagtgaaaggaagaacgtaagactaactttaacaatattttgtataacacaataatccaaaacattatcatttcaatgtataatcaatataaaaatagtcggatattttacattcttcttttttcatactaagactttgaaattggtgtgtgttttacatacacgttccagttcaaactagccacatttcaactacttgttggccatacgtggctagtggctacagtattggacaacactgtttggaggtccccgatagaactgagtcttggttgcccacagtggaatgtgctcatgaacacacccagtattggctgctttccttttcctgtctttcttccctactcctcttgtgatacttactaaaatcatctctcaaattaactgcttaaaactcaaacccttctatgtttacttctgagagaataagacctaagacaaggactttgcttgccttttataaaacatagagctcaaggtaaaatttaaattaaaatttccattcctatacccatgtagaatgtcttattgttaaaaagaaccatatgtttaaaaaagacttgaaattgtcactctgtcttgaattaactttcatgaagttaatcttaatgcttgccattctcatttatcctgctcacatgaaatgtccttggagtatcttttagctatgaggggtactgccctttcaagcacccggtataagggccttatctcgccatggatcatttgcctaagtgctgtaagtacacatttctaagcaaagagagttggcttctcaatgagatttagatagctatccaaaccactgaatgattttaaggaaatcattattaatgctaatgcagagtccccaagtttggagtcagcatttgaggttcagcggcattaattggatcaccatttctgattttagttccaccaggtttcctgggagttttgtcaccagcagctgcatgcagctgttcaagtcatattcaatggcccaaggatgctaagccacttgggcagaatgggcttgggagctactcccaatttcctatacctgagtgctgaaatcatggaggatttttgtgctgaatggttccagctggcctcaccagacattggtgtgcatgctggcttcattcagatctcacacttaagcatgtcagtctcgaagatgagtctaaaccagcctcccaaggcctttaactgctgcctttcccccgccctgcatcaattcttctcattcaaatagaaaagctggagggatttttacaaatgcaaccgacactaatgaagggctacttgagtgaatcaactggccaagacatgctagtgaatgatagtaaataacaacttgaatacctaaacccactggggtgcttgtaaattaactctctgggtaagaagagccccagtgtgaagagtttgcagatttctatggtataaacacaaataccatggtctttttcaagcttccaaagcatgaggtcaatgaataggagagctagggagagatggtacaattagctcgtgtgagctggctcaagtcagccgcagcacagctctgctgagccagactttaattgggcatgtactttgtgccaataacgtgacatgcatgaactcatttaataaacacagcaattctacaaggcaggaactgttattattgaggcttaaaagggattagttccttgcttaaatagcagagccagaatttgaacctgagtttgcctgaccccaaaattcatgtcctttacttttttgctcctgtctccagacttttatagtaagtagaggcaggagcatttcagatggtatcagacatggtcatctgcaaggggaggctctactcccatgggaggtagaagaagcagactggcctaaatgcctagaattccttgtaagtcctttaatcatcttccttaatccttaattccttaatggcaaatgttttcccatgtcctttcatttccatgactatgcactgttgaaattagccccagtctgagccagcagggacagaaaattatcaaccacctatggaaactcaaccacatcacagctggatgcacagttgagtccctcaggggacaaagccatgctcctggcaaatctccaggtttccaccctctgccagacacagggcaagctagaaaacatgatacattgtcaaggagaagcatgggggtgcttttgaagagaagcagaagcaactctcttcttcactccctcaggccaagagggaaagttgttcctcccaagccacaagtagaaacttgggcacagaggccatatgtatctgtgactttcatttgcatgccccaaaacacttcacctgtggtatcatgaaatgatacaatactgtttcacagaacatgtttcatgttcatattcaacatgtaagcatgcccactgacccaaggagtgctctacaactttttcaaaaataaaatattagtactttagggggtgcttagatatttcaaaatgtggcacatggaagtctttttaaatagtacccactccccaggaattcccattctggtggaaaatgaagacctagaaatgtaactcacaaaaatgcaaaaagtgatttggagaaatgctggtttggagttgaattttcagcattggaaactctcttcttgatcccagttgcagacgacacattgcagtgacatagaagggttagatttttctcccagtgaggttgcaaatgtccctttgcccattgtatgaatccctttgagcccagtatttgcactcggtgagctgctccaagcatctcatttctgtttttgctgaacccattccaagggtcaacatccatcttgcacctggtgacagaagtttgggggagttgctaatgtagtcattggcaaaatttttcaccctggctgtggtaataaccttagatgtgactgacttgcaaccacagaaaacctagcctagtgcccaaagctttgcagtttataatgccaaagtttttaatagcacatctatcaaatgtggggtttttttttgttctgttccttttttaataaatgggaaatgagaaatgagtcgccatagctctgtaatgtaattttagaatcctggcacgaaggcgacagctgctaagagagaattaggcagggtccccattatatcttggccttaaagaaagggctggggaagtgaaaataaaatagaatttgaaatgaaattctcaaggcactgctaggcaccagggatacaagagggattaggaaagacaagtgcccttttctcatggaatttatgttcttggggatgaggtgaggaaggagacatacaataaagggatacaccagagagtgagataatttcacatacaagtgatgtgtttgagagagatttcctttctggtgagcctttagattaggcagtcagggaagatcttctagggagttgaatttgatctgagattcaaagggtgagaagggagcagacatatgaatatgtgtgttggaggagtgggggtgagaacagcaggtgcaaaggttctgaggcaggaaccagcctagcagtgattgaggaacacaaagggaaaggaaactgacaaagctagagccaaacacaagagggaggtgaggctagtgtggtaagcggggccccaatgacatgctgtgctaggcctggaattggatttggatcttattctaagcaatggtttttaaacaggtgagcaatgtgatctggtttatgtttcaaaagctcacactggctgctgtgttgaggatagagtgtagagagtaaagagtagaagcagggagattagaaggctagagggttatgagatgctggtctgggctactgtggtgattccaaaggttgaacacagtagatgaatatgaaatctattttagaatggagctgatagggcttatgatagaacttacgattgcttcaactggaaaagtaaatgaagaaaaatattgagaatgacatctcagtttggagtttaaatttctgggtagatagtaataccattccttgagatgtgcaatactgtggaaagaacatgcttataaacatcaagtatatgattctgtctgatttcaaatttgaaatgcctgatgaggtcctttacaaaaaaattgaaagggcctgatgggagttgagtgcaggaaaggaaattattagtgctgtgaagtgtggggcatagttaagtaccagccctgaagggacaatgggaaggaggtggctacgggagccaagaaacttagagggccacatggagaaggccaactctaagatctgtaaccttcgattgagggatacaaccagctcatgaaaaccaccaggtgcctagaaagtaaatgccctgagctccccactggctacatgaaccagggagttcattcatgcaatccagaaaattcagcctcccagagcacagcaggggtggtgaaggtggagagtggatctagaggggcaaacagatatccattcctaaatcccagacaagatgccacgtaggctgttgaagatgtaagtcatgagctcaataggaagaccagggctaaatacataaattaacacctaatgaagtgttctatatccaaatgaaataaactcggagatgctttcctgacactgtcctcagactttaatttatttgcccccaaggatagacttagagggacattgaggaaaataggaagcacagtaatttaactgggacatacagaagttgtttagaatctggattactaaaaacagtttgttaaatagaagcagggtaatttctagccccattcctttctccattcctctagccctgcgttcaggactgagtaagatgaaattgcacaatgacaattgtcaattaatctatgaagattgaaatcgaacactcttggaggaaaaaatattaacagggttcccttatggagaatttctaaatttataaaagcacatgtgtaagattttacatttgtgtgaatcactaatgttatctacaaaaatgttttagcttaagccttaagtttaagtctatgtaggttggagaaccacaagtccttgccagaatttcgctcagccatgatgacagatgaaactgcaattaagattcagcgtgtgtgtaggtttactaagaagaaaacatttttaaatttcacataattttgaaccctactggtaaatatttaaatgagaatattaaatcttcgtgattccagaggggttagagccaaaaggcctctctccaccctacaaaaagagcaaagcaaagaagccagaatgttcgaaagactctagcgagggtaagtcctgtccctccttcctttagaaaattatgccatgaaaagaaacatatttaatttttaaattatgtgtacaaacacactcatgttcagatattcctaagggttaaaatatcacagagaaattcttttatccctttctaatatgtttgaagatgaagaatcagactcaagtttattttgttaaggtaaaacccaaattttaaaagtccattttgtcagtatgttgtattttccatgtctgcaaagcaaaaaattgtaggtagtgcttaccagttacatgttccaaaattgtgcaaaagtgaaggtcaagatttgcatgtgatgaccagctttgcagctattgtcttactggggaaattgtttttctgataaatacattctgagtctttccagattcggacctcaacaacagatgctggaaatggttcctgtctttagcattgtctttcattttctaagatcctacatacctttgcatttttgcattgaatgggcaggtcccactggactcagttttatgaataaatgacacggtctctcttttacacactagtacaacatacaattcattcaaattttcttttgaaatgttgatgagatgttcttttcatgtgaacctcaaacctaagagtagtacaaacttttacacttgatcttagcccaaagacccagaagcgatagagcagtacaaaattttaaagggagcatatttacgctttgtctttcttgcctggatccccacctcctccactgggaaatgaagagtgtaataatactgatggtgtcaggttgggtcttgagggaagaagatgccaagatggaagcagaagtgcaggataaaggtgagagaaatgggcaatggagcaggagcagctgaaaggagagaagaaaagaaggaggctcagctaggaagtgcctcagtctgcagtgcagtctggaagtctggaggagtcctgcactgggcaggaatagctgggctctagggtctcgctttcccatgctcagtcactggctgcaagtagtttggcaagaaagtggccggcctcagcaggaacatgatgccacaggggttctcaacagtgtggttgctgggtgctgtcagcttacttctctcctagcagcaggtctcacttgaaaagaactcttgagctgctcacatgcaggactgcacagtatccctgttgagtgccggggcttccggtgctaagtaatgacgctgctttttcaccttcctgggagttcagaaccaatcgagaagccaaagctgaaagaaaggtggaaatcaaagcattagcttgaatactaacatgatgaggccagagcatctggctgccctgctcctagacaggcttcctaaccctgaatttcagctctaaataggaaagctttaatcactgtcccctcacaggcgagtgcaggtgtcctcagcttcctagaccaagactgccctgatcagcttgttataggatgagcagaccaggaacacgccttctctgtaggcaggtgggtctgagagagacacaagatggaactgtttccttctcccaggcttactgtaagaaaggagaggtgcagaaaggcacagaaacagatgtgacccctcctctacacaaggagcaaaggaggaatatttcctactgacaatgaagagtagaaatagcatgtgtactggcctagcactggcctggccttctgtcagtgatggctgttgttatcaatatgatgatcatggccatcgtagattatgcactgccctaattcagtgaaatgtgcttgaaagtttaaaatcgttcagaggagaacacttagaaccaggaaaaaggccagctgcaataattcacccaagatgttaagctttgttactgcctggttgggagagtagctggggcttccaaatctcctgttgtagttcggtcattttctagaccatctcttaaggccacacttgggtaatgagctggggcaaagcaatactcacctttcccctagagaaactctacctcaccaaatgattcccatcacatccataacctatgtcaaaagttgttttccagaacctgagcctgttgtcatttctgagcctcatataacagctattaagctgtagcagttcttccgcctttaattaaagaagggaattcttccaagttactccttccaatgtgtgaaaacttcatttacttcctaaatcagttgctttgtttaggaacatcattcccgaatcctaatatgactcaataatacagcttcacctcctgtaattatgtggtctaacaatctgctctgaatcataaagatgaaaatgtggtaactggatttgctagcagggacattctgtctgtggtgaaatgtgaatgtgaggcactctccagaaacataggaattgttcatttgttcctaagagggcttcaaagacaaataaaaagtaaagatagctgggcaaggagtgagaaagggagcgccatccggcaggcagcggtggatgattccatgatatgctgttgtgctgaaaccctcccaactttagaggggatgacaccaggttcgagaggctgaagaagagccccagaatcactgaaagagacatggggttttcctgggggctttcatacaggagagagggcctggtggcggcagcctgggcaggaggaccacagccgcttataaaaaacatgcaatggcaacctttacttaccccaagacaaagggcctccatcccttgtacagcctgagttccacaggatgggccgggggctcagatgttccctgtagataaggaatcaatctccgggttgccactcctggattctagttgagaactttgaaccgcattgaggtgcatccaccacatggttcattctcaggatatggttaagtgattgctatcagctgggtttaccacacatacggcacttattacttatcagagtttctattttgacaaaataacctatgtctctgaattcatgcattgtactcttgcatgtgttccatttcctgttatgatacaaagagttacaatcattctttcctagtggatatgcaaatgaaatctggtatcactggaagagggacaaattttaatgctgatcattactctcctctctagatcttcttcccagcttagagttatcaatgtttttttagcttggtcatttcatatttttttagaaagagaagctcctggtatttttatttatagatctctcagcttaatgccccaacacttggccccatctctcttttctccttctttagggttccctggcccacttcccaccctcacaggtactactgatttccaccttttaactgataatgcacattttcagaaagggttgtagaaaacaaactcacctagattttccagcatatatagtcataataactgtatttagattcagaagaaaaatttcaagaacatatggtcaaattttctcattctacagaatttttttaaagtacagactgcaaatgcttctttaacttgcccaagtccacgcagtttgttaatgtcacaatcttttttttttttttctagaaaaaacacagcttctgtaatcttttctctttctctttcctggaaattagaacaaattttttgaaggaagaaatattgtcaacattataaccttgagtgaagcattattactttagtaaatatctcgctaagatactgaacatcaaaattaaaaatcaaacaacttctaaatgtatttatttgcatttttatgctgtgtacttttgaatatagtgattttattatttttagtaaaatttcatgaactgctgtgtactttggtttcacacactcaacaccataccaataatgaaattattagtaatttcaagttactaattgattggctgtcatgtgctataaatgataatgccatctgtgaaccagcaaggcatagacagaattgtttggaaaaaagcctgattagtaccagttgcattaattctaactccccataatttagacctttttttttcttacaaaaagttgaaagaatattattgtagaaaacttagcacctttaataaagcatacttttctcacacttcttcctttgtctttcagaagtaaattatctacaggttcctttagtgaaagtctctcaggccttatttgtctgaaaatggtattattttgcattattttcttaaagcagtattggtgggtaaaaatttgagattgatggttattttcttgcaacattttgaagttttcctgtagttgttaaggaatatttccgtttgttttttgcttcttttaagcttatctgtttttcctttctgtctgttttgacaatctactcattaccttttgtgttccatagtatcactatgatgtgcctaggtatagattcatttttatatatccttcttagaatttgctgtacttcttggatctcggaatgggcatctttcattagttctgaaaaattctcacgtatcactgcaccaaatataacttctaatctattactttctattctttctttctctgttcttcatgacttttaacccatatcgcattttgtcctctgtatctcttctctctctgatgccttccggttaatttttttcaagtctgtcatttaacttgctaattttctattcaactttatttaatctgatgtttaactcttcactgtatttctaatatagttttcttttttgataggttttatttggttccttttcaaatatacatggccattttttatttaattaacacataaaatacctttaataatctgcatcataaatttaatatctctagtctgtacaagtctgattctgcagtttattgattctgcaaacttctgcacttggttatttcctcgtgtattttgcctttttgatgatcatgttccttggatttttacttatggaagcttttttgatgttgctttaagagctcatttatttacacttggttttctaagatacctgaagatattaccttagcaataccttaaagtacatatttggcttagagttttgtttttattttgttggctaatggtccttaaacccatgttagtccatgtataagatgaggaaatctcaacagagacctttttttcccttttttctcacgaccaatgctaaaactgacataggcaaatctcccactatatttatgaccctagcatgggcccctccatgcctcacacgtgtggctcattcaaatccaagctctagctagtggttctcaaagagtgttcttgaatctgcatccatcagcttcacctggaagctcatgcctataatcccagcactttgggagcccgaggcgggtggatcacttgaggtcaggagttccagaccaacctggccaacatggtgaaacccccgtctctactaaaaatacaaaaattagctgggagtggtgacatgtgcctgtaatcccagttactaaggaggctgaggcatcagaattgcttgaacctgggaggcggaggttgcagtgagctgaaatcaagccactgcactccagcctgggccacagagcaagactcagtctaaaaaaaaaaaaaaaaaaaaacaaattctaggttcacgtcccagaccttctgaatcagaaacctgaagtggggtcctgtaatctgtgttctcaaaagctcttcatctgaagatgcacgctcaaacttgagaactgttgttcttgagtctaggttacctggggttggcagatgcctcaaagcaaatactgatttcagtgcctgcttagaactcttgatcctggcactttatcatttcggtttcaagaatttcccttacaaaagcaccagctcagccatgtattcaagaagtagatagatagatgcatacatatatatgtaaatatatatagatagcacatacctactatatatatatatgcacacacacatatagtatgtatatgtgtataccttatatgtatatatgtatacacatacctatatgtgtgtgtgcatatatatatgtgtgtaggtatgtgctatctattgtatgtatgtatatatatgtacacatgtatgtatatacatgcatatatgtgtgtgcacatatatatctgtaggtgtgtgctatctatatgtatgtatatatgtatgtatgcacatacaaatatatgggtgtatatatatctgtaggtatgtgctatgtatatgtatgtatgcatctatttacttatctaatcacacagacatatatgtatatatgtatatgtgtgtatatgtacacacgtgtatatatgtatctttacatacatacagatatatacacatatgtgtgtacatatatacatatatacatatacatgtatatctatacacatacatacatttctaatacatagcctggaaagatacatatcaagttgacctcagaaattatcttggaggagtgaagaaggagcacagttgggttttggagagtttaatattgcactttctaaatttatgtgtaattgaatatgcatacacacatataatgagttattttataaaacaaacacatattttcattaaacaagaactaaatggactatatgttgctaagttcagtagcatgtttcaaacagtaattttctacatacctgagtctccaaagccttcagtggcttttggtaacaaatggcactttccatcatatttttacagaaagcactagcactttgactcttgctccacaattgcctttacatagaatattcagtaggcatacgtgggatgctcattcatcaggaaactgaacccttgcaattctaaatcaagcaaacctatattgcactttaaaatattaatgatgtcttttgtcagatgaaattatatgtggaaacattttggaaactagaaagcactatgccagtttgagggatctaatgataatattaaagttattattattattattttactaaaataaatttttctgaatacatgaaccatttatggaacgtagcttgtatttcccgagaggcagaattttctctctgccccattattttctatgcatattaaagtatcgtgtgacatgctgttttgtgagtggctggacagaagggacattctatctttcagaatgccatgcagcagttcatgcattatattcataagcacgatttttaatttaatttttttgacaagtgcagtgaagggtaaaatcaggcagtcataatttttactttgccatcactcaaatgagcttagtgattgaccagcttttaacaaaataaggatccaggaaaagcagctttcccctgaagaaaagctttgttttatcctctagactttaaaatatcaagaatttaagcaaaatgtgtaaatttccatggtgaaaaatcagaatacaataaatgcctataccaccattttgctttaatcatatttttcttatattctgcttgattccaggccattctgaactatccaccaccacaaagtagtagaaggacccagtggtctattttcatttgtactggtgctccccatgcttacccattaaacagaccacagagtcctgtttcagagtcagctctaggactttaaatgggacttagagaatgtgagtattaaggcattttccattgtgagaagggctgaatctaccaaggcagagaaaccacaggttctgtttgactgggaacgatcccaatttatgcatgttgccattggcatttgttagcaatgttccctttcactcttggaggtaacccaagtttggtgataacatatatggaccctcatacccatagagaaacagttcagtatgagtatggacagaactctcaattgtccatgttctgcttcctacttgggcagtttttctaacctaagactcagtttcttcatacattaaatggacagaagggaaactgatcttgcaggactgcagggcaatttaaataagatgatttatggaaaacaccgggcacattgagtagacagaagagctggtcagtgagtatattgaatttgaaacaagaagagctccctcccaccaaagactcccctaccttgcttattaatgcttgaaattccttttaatgtgaacaaaatacttttgcaagcagagatacatttttaaatgcattgcttgcatcgcacatctagctgggtttgtctctctcctttttcccttaggttcactcagcacactctgcatgcctccccaccccagcccccagttgcactaattccagtcccaaagggactttcttccagtctgtcttcatcttcctgatctctattccccttatcttcaagtccagattcccaagaaactacagaaggtccaccatttacaatggtttgatttaggattttttgacttgatggtgtgaaagcaataggcattcagtagaaatctttggttttgaattttgatgttctcctggactctcgatgtgatagtctttcatgatgctgtgcagtgagccacagcccccagtcagccgcaccatcacgacggtaaacaactgataccgcactctagagtggcctgtgttgtcagcagtttttggatattgttttgtgttttcacatttcatcatgtctacaaaatgcccatctgtgcaagttaggtgtattaaatgcatttttgcttacagtattttcaacctacaatgggtttatcaggacatagccccatcttaagtcaaggagcatcagcagcctatctccaatatttacacaaccacacatctcaaccatttctcaatctctacttaactgtctctaaaactttaaggagggtaccagattaggtcaggggcatgaggaaagaggtggtctctagttatcggccctcagttcagagcttgccactgagacagtcattgtttggtcctcatggtcccttgagatctgttgactctcagctatttctgtaagattctgggaccaagaatctctcttctgaggctgggctattcttactgcctgtagtcttctttccctgataagtgtttctcaaaatatggccaatggaaccctgggggaggtcccccaaagcccttccagcgatccacaaggtcaaaattagttttgcatggagctgtgctcccagaagtctccactcacatggaattcagtgtgcatgaggtcctctatagttgtgcaaaatgatgctactgcagaaacatccactgcatcctccaaccacatcagcatagctgcccaccatccagtttctccaagcactcattccacatacttttgttaatgcctaccatttgacggtgtaggtattgttctaagccctgaacacaatataatatataatatatgtattaatatattataagcccctgctttcttggggcttatattctatatataaaatagaggcctctactctcttggggcttttattctagggtatgtggcattggggattggcagataaaaaatggatacaatgtttaataaattatttatctattgctgcctgaaaatttatcctaaagcttcaaccaacgataagcaattattatctcggagtttctgtcagtcaggaattggacagtagcatatcttgaggttctgggccaccatatctcatgctaatgtgtgacagtttaggtcacaaaagatggcttctaccttgcgccctctcggatcacttgctctggggtaaggcagccgccatgtatgaggaccccagctctgtgaaaaggttctcatggcaaggagctgaggccccctgctggcagccggcgccaagatataagtcatgtgagtgaaccgtcttggagtcagatcctccagtcccaagaaagcccccagatgactgcagacgtagctgacattgtgacaacaacttcatgggagacgtcatgccaagagccatggagaaaaatcaagcaggggaggagctaggaaatgcccaagtgtgtatgagtgtgggagtgagcctgtgtgtgtggtgggggaaattaggagacagctgggttgggttttaaaatatgttagatctctctgattattaagtttctatttgagaagaaacctgaaaagcataaaggggtaagccaggcagctctctgggaaaagagtgttccagtagaggaaacagtaagtgggccgggtgcggtgtctcacgcctgtattccaagccctttgagaggccgaggcgggcagatcactcgaggtcaggagttcgaggctaaaaatacaaatactagccagacgtagtggcgcacgcctgtaattccggctacttcagaggctgaggcaggagaatcgctggaacccgggagacggaggttgcagtgagccgagatcgtggcagagtgagactgtctcaaaaaaagaaacaacaacagcggaaacacaaaatgctaaagccccaatgatcgaggcgtctgacttaccctaataaaaagcaagaaggtccatgtgacagcagcaacagagagtgaaggggaggagagtaactggagaggtcactggaggcctatcctggagaggggtgggttccgcactagagtgtgcatgagaatcaccagagggtgtgtcaaacccagatttcagggtctcacccccaaagtctctgattcagtaggtttgggggtggggctgagaatcttcacgtccaataatcttccaggtgatgccctacgatggagattatatcttgagaatcactgccttgggcattgttggccactgtaagaactttgactgcttctctcagtgaaatgggaagagagcattttaagcagagataggacgtgctctaacttatattttaaaagaaatcttctggttattgtgttgagaatagactgggctaagggaagaaacaggaaagagtttattggagcaagggatactaatggcttgatccaagtagcagcgaaaggcaggaatgataattggtcacttttggacacgttaaaggtaaagccaacagaattcacagacatgttgaatgtggcatgtgagagaaagagaggaggcatagatgggtgttttcattctctccgccactactgaatccagaatagaagttgtaccctggttatgcttaattcaaacattgcaggaaaaacagttcttcactattcatacagtcttcttgtccatcatgtcttcttgctctcctcaccccgggaaggccatagtagcgcaccccgaggccaaagttccttgttttacatttttaatttgtgtttgtttgtttttttagagacagggtctcactatgttgctgaggctggtctcgaacttctgaactcaagcgaccctccagcctcggcctcccaaagtgctgggattacaggcgtgagcaaccgtgcccagcccaaattttccaattaagcaaaagcaaaattttcaggcacaaagaaaaatctcctaaatatcaaaaagagtaaaagcacaaaaatattgacaaacaagataaactgagtaaaaagattattttatgtgatttagatagtatgatttcactatgtttctccccataaaaggtgtttttttattgtttttgtcttgttgcttttcaataagaaacttcccagttaaggaatgatcatgtaattgctgtcatttatgattgccaagctcaagaagacagtaagaaagaaagaaagaggccaggcgcggtggctcacgcctgtaatcccagcactttgggaggccgaggtggccagatcacgaggtcaggagatcgagaccatcctggctaacctgtctctactaaaaattcaaaaaattagccgggcgtggtggctggtgcctgtagtcccagctactcgggaggctgaggcaggagaatgatgtgaagctgggaggcggagcttgcagtgagccacgatcgcagcactgcactccagcctgcgcgaaagagagagactctgtctcaaaaaaaaaaaaaaaaaaaaaaaagaaggaagaaagggaggaaagaggtgggggagagggagaaaaaggaaaatagttgcaagctaatggaaagacccctgaactaggaatcagatccctgaattctattttcatcccttaggtgtacgatcatattctttacctcatgtctctcaggtccatttagatatcaaattctgtaattctacaaaccatcatattcatgaaaattgattctttatgagctcttttcttcatgctcagtaaatatttccatccttaattcaaagcacagaatcatggcttttaatggccaagtgggcctctgagaacatctagggcaacactctcgtttcacagatgaggaaactttcttttaaaactcctctgaaattgtctagaggactcatgaaaggtgatactaagttcactattaaaaaactaaaggaaaagatcagtttatcagggcatagacagtggatctttttatagtaactttaaaggtacctttctttaaatgttatagatgtctgtgagtaatttagactatgtgtttaacaatttgtctattttgatttcctaaaccaaggatgaagaatgcatcagtcagatgtgtttgcctttgttttgttgaaaactcagtccccgggtttatagaactaaagcattagagtgattgttttcaatgttgacaccatgccaataggacatttgaggacttataatattaggtactaatttttcaacagagaaagggtttattttgtcgttaaggagaggtattgctatttgaacagtgttgaattttcatgttacgattttgtagttgtatttcaaaatttcagttttctaatgtaacaaagttgtgctttcctgctataccagagagagccttaaaactgtccacctacactagaatttcctggattcacgccacactctcctaatgccttgctcaagtgtgcctgttctctcctacctcttgtcactctggagccatcagagacagtcttaggaaatgatttcatctccagggatcaccatgcctgaggaatgacatgcagaaacccagggtactgtattctccgtagacagaaaatgctagcagaaccacttgaatcatttctcaattctccatcctgagaattccccactggcttctaacaatctttgctgctggcagaaggaaagtagatatggggtttgagaggaaaggggcagagggaaggggagactggctgtagaatgtggagcgaaagtggaatgtttttgctgagtgcttagtgaacagttgcaaactgccacccttgggagaacctctcattcagccacttatggtgtatccaaaaacgcagattcctgcacctagcccaacccttcaccaaatcagaaagctgcatgctaactagatgcaatgcatctttggagcaccatttcttttgcctttgtttcttattttaaacaatctcaaacttacagcaaatttgcaagtacagtaaaaataacctttttttcctgaaccatttgggaataagttgccaatctactgtttctatccccaaacatttaactgagcattttctacaaattgggcattcatcctgcatgagcacaataaaaagatcaaaattagaacatgaatatggatatatcactactatctaattttcagatctcatttaagtttcaccagttttccaatgatgctccttgtaacaaaaaaaaaaaacgctttcaaactcaaatttctcattttgctgccacatctctttattctcctccagtctggaacagtttcccaatcttaatttgactttactgcccttgacacttttgaagattgcaggtcagttatctactcgaatgtttccaatttggattggtctgatgttttctcatggctggattcaagtgatgcatctttgaagaactatcacagaagtgatactgtgttcttctcatggcaggctatgaagggcccattatctcaatttgtcccattattgacaatattcactcgctttgattacttgattaaggtggtgtctcagaggctcctcaactacacagctgctttttcctctgtttgtaattgatgagtaccccttgtgggaaggcacaatgaaactaggtaaatggcccattcctcattaaactttcaatttattcatttgtgtacttatttatatcctcgtggactcatcatttcccattctattcaatgggttgtaataacgccttagccttggtacccaccaattcttcaaggaggtttggtttcttttagtagagaagcgtatttggaaactagatctgagtattaagtgtgtggatcacaatttgagatatgttatttaaaacagaacgatcagattatcttgatggttcaatgtggggaaccagctcacaagatcagtcaatcacatcttcctgatgaattcatccaattgccagaatggttttcttatagaccttccattatagctgtggccaagagatcaaattgtccaactttggttaagtttggcagagtacagcccaatgaggatggggagagcatggaaatctgtttggtgtttagggtttctaaaagtgttaactcaatcctgttgtcaaattttgcttgtccattatataacaccaaatcaactaattagcaaagggttaatattacatatgtaggcatgcccttgaattgtttatgcacctttttttgttctctttttattgtaagtgttaaaatacacatgagacaaaggtcacatttctacgctgatgacacggtgtgccgtgagtgtggacagtcattttgctaattcttctcattggtggttccgctagatggatgatttccctgaattagccatcataactgccatctgttcctgtgcatagatacagagatctaaagagtagaggtcaggaagaattttaaaaagggctgtgtgctcagttgcctctgtttgtctctctagaacattctctagactgctttttgcctgagacctaaggggctgcattgactggactccctcaccctcaagctttgggttggttaactaatatttctcaattttattttcatgactacactccctaaggaggcttttttagacattctttttctaattgtctccacctgaccatgaaattttaataccataaatatattgcatatctatttatgaactgtatcttttggagggtacagaccattataatagctaagagttttttgctgtgttttttgtttttttcctttttgccctgccaagaacaaatgtttgcttcccattgagaaggcatgcgctagaccagtggaagtcatttaagggagattggagaatggggggaaaagtactaaggacaaaaagacatttattctctttgacccttgctgccagacagaaatgacttcacccaaggacacagcacttgcgggtggccttctccacctccagctattgcttggtttcaggtgaccactccctttctcttctcaggcctatgggtggtaacagctcccatccactgctagtcttagacatctttactttccttgattgattcccttgactctgcccacatcttttaaaatatcccatattaaactttttacacccctttgaatgtgtcctgcttcctgctgggaccatgactagtctcttctagttggaatccatatcaccttctgtgatgtagtctccaagtcaggcagtctcatttcaactacagtctttctttatgcttctctttttcctttctggactcttacctttcttttatttcttactcagcaacagtgtctgcccattaaaatgcacctttgcggtggtggtttggttttctttatctctcttatttcttcccttcctgttgcattttcactggcattgcatgggatttttgtttggatactaagccaagcatcttatacccttgcatgcttgacatttctcttgcttagctttccaaacacccaagtcaccctgacaggctcttgaatactttcttcccacaagttagtgatcttagctggcaagagcagacaatggcttgttccaggtactagggatgtataaaacttgttggcttaaaataatgacatttattttgctcacacatctgcaagcttggcagggctcgacagggatagttgtctctgctctactcagcattggctggggtggctcagaaattgggaggctgaaatatccagggcttctcttactcacttgtctgagccctaagcttagaagactcaaacaactgaaagctggaagaactggagctctttgggcatctctctagcttgatgaagtctctccatgtaatctaccagcatggggggcttagggcagtcttacttgttacacattgacccagagctcccatagtgattatgtcaagagaaagagcttgttattcagtgttatttttaccacattctattggttgaggttaacaagtccccaggattaaggggagagaacttagaccctgccttttgaaggagaatgtcaatgtcacattgtatatttttaaaaagtggaatgagatatgtataggtacagtcatttttggaaaaacaatctgatctgcttcagtatcatacacataagtacataatacaatttttttttttttttttttttttttttgagacggagtctctctctgtcgcccaggctggagtgcagtggcgggatctcggctcactgcaagctccgcctcccgggttcacaccattctcctgcctcagcctcccaagtagctgggactacaggcgcccgccactgcgcccggctaattttttgtatttttagtagagacggggtttcaccgttttagccgggatggtctcgatctcctgacctcgtgatccgcccgcctcagcctcccaaagtgctgggattataggcgtgagccaccgcgcccggccgtaatacaatttttgagaccttgtggaagtcctttggggttcagaagaaaatactggaaattactaatggaaaacaagcagagataggaagatgtcagtaaggaggtcttaatacctactttgtataataatggggctcaggatttctgagtgagaagatcaagagtaggtacagtcaaggaaataagaactctggattcctgtctatgcagattgagtcaagcaagtctctgatctctatcaaatgaagaattaatcttatgattttgatgttctttctcaaaacccctggttctgttacgccatcatcaactcacttttctgtttcctgtttaaagtcactttctctcaaaatttgctgactccaaattctgttgcttttgctgagaagacagtcacactgctgtctatgcagctccactaaatcaagtgtgagcttcaagtcctcagtggcaccaagcgttatttcaagagttattcttcctttgtgtatgaaaatttgcattttgaatgtgtgtcatcagagaagtaatgggaaattggggattgtgatgtggccaagtcagaggacatgtgtgtgtgtgtgtgtgtgtgtgtgtgtgtgtgtgtaactatcaccattctttttctctaaaagagagttttgatggtagatgaggacgtaggaccactagattcaaaagtggaggatgtaaaagaatttggaaatagattaaacacaattctggagttgtctatgaagctctctttataaagtatcttcatatgcaacagcacatgtagtaggcactttctgacgatggtcacaacagaacgcagaatggctgaagccctgaaatgatgcacactgtatatgaaattgaacacgtcggtccacgaatgtttttaaatctgtaatttaaaaaactcccaaggtgtcgccaatgtgaaaataagtgagaaccacaagcaacctaccacatggtttgtagaggccaagattctctcagattcaaggatagaaaagccactcaaaactgttttaagcaaacttgtatctgaaaagtctatttgatacttaattagctaatttaccagttgcatcagaactaggttcctctacccatctctgtgctctgcctccctctgtattggctctatttcatattctcacctctctgggacaaagatgaccactaactgctctctcatcaaccctggtataagtggcatacttctttctcaatagctcccatgaaagatctgaaattgtttcattgtctccgattggctagactctgatctagcatctgcccttgaaccaatcactgtggccatggacatgtactgccctgactaggtctaggacacatggcaactctgggaccgggaggtgcaggggtggagcaacatggttaactataattaaaactatggaccaagtaggagctgagtggttccccagaggaaaacaggggaagtatcaacagggaaaatagacggtatgccttctattctagttcgtcgtcagtaaatattatttgatcattgaattcttgtgtcttgttctttaaagacagacaataagagttaggaggacataatgtcatggctaacaatgttgctgtaaattcgttatcaatttttccctttccactctcactttattataaaagatcaaaggggattttcaggaaagcgttaacactacttaaaagccccacctcgaagactggaggtgtggagagaagctatatataaggtggacccagccaggataaatgtgaaggataggcaagaagcactggtaggtgaaggtgaatagtgcaagggtatggactgaaaatcagtgtggtgggagaagtgagaaaacaccaggggaggaaataaaagctaaacaaaagagagagtgccacctctgtatgttgttgctgggattatccataggaaacagacatgtggaaaaggatcctgtgactaagaatagggcgtacaggaagtaaatagtactgttagcctctggaaagcaatgtggaattcaacttttaaaatttgcatgttgggcgtgttggcatgtgcgtgtaatcctggctactcaggaggctgaggcaggagaatcgcttgaaccccggaggcagaggttgcagtgagccgagatcgtgccattgcactccagcccgggcaacaagaacaaaactccgactcaaaaaacaaaaaacaaaacaacaacaaaaataattgcatgtttgctttttaaaacattgttctgtgtttccaagctgttttgacagtgggtcaaaggaatgccaatagtacggattatgactggcttcattttaaatggcagccccaagcaaagttgaaatttgaacttctgtttacatttagaaattctctggattgtctggtaaccttgtctttagaagcctgatgtttatatattggcagccacagggaattatttccctttgggtgttcaattgctgtccaatttccttatctactgcccattaaattaggaaacgttgggtctcatcatctgcttcactttccaatcactttaccagcaataggcttcaataactagtgccttgcagtgttgttttgtaagccatggtgtcctcaggatgcattttaaaaaatagatacctgaagtaatgtgaagagccagtttataggtttaaaacctgattttgagattcagacatagttcttaggaggctgaaccctgaggtttttcttttcaacttactcactatacagtgtgttgtatttccaaatatgaatcttggtaaggacaggtttgaaacagtctagcttcattgaccacaaaagttggttatcggtgaaacatgatgaaaacatcacatttctcatttaccaaaaggtgccttcagtggaggttattggattgcaaagaggatgtttgttggaaccgagaataaaaaccaaataaggttataaaacaaaaggtagtgatgatttgacattgaatggtatgcccagaaacttaattaaattttaattaaaatgtaattctgcataaaatttaattatatgacaatgagtattctcatagagtaagttaggaaagttttctaaagtcagttggaaaggcaccatgcagtgtgtcataataaaaaggacagaggctacaaggccagccagatctgggtttgaatcccagctctaccactgactggttctaagcttcagttttctcatctgtaaaatgggaataaattcttactctgcttacttggcaaaaattagaagtcaaatgtattattaaaaaaaccattcataatgtttgacatttaaaaatatattaggcattcaaaaatggtagctattatcactattattattattatttcttctggagaatagatatccattgtccctcttctcttcatagaaaaaaaaaatccagaaaacaaatgcctttttaaataacctggttgtagaattcaaactggctctgtccaacaaaattatgtttaaggctggagagagttttgctagtttcccagaaaaagtattgtcaaattacttttttcttgttgtgtgtattttttccctaaattctttttttataacttttactttcatctgtgtggaaatattcttggccatctctctgttgctatcccttcagtaagtctgcaattattttttcaagaggtgccagcccaaagaatcataagcccttatgagctaacagtgaagtctcagccaagaaaagaaatttaaaaaaccagtttcctgaaaattgtaacatacataagtttggaatgtgcttgtttgtttgtgtctttcttttttagtttatagaatgctttgctctttatgttgaaaaactgtccattattactggctgttggccattttttcatctctagggtaatatatttctactataaaatttcaactctggtcaaagcagacagtgtgttataaaaaaatatactgagcacaaatgcagtcgtaaagtctcatatttatttacctctcaaagtgaaagtgcttatagtattttagggacacagcattttttaaatactaggcactcagtaaatatttgtgggtggccaagtgaatgaataaacgaataagcaaatgaacgatgggaatttaccatgactgcaaatcatttctcctaagtgaaatatactgtttgttttcctgtgtgtgcatggagggggcagtgaaattgagataaatctcattgtttaaagagttctttagggactaccagagtagtggacatggtaataaaacattgttctccaaagcagaatatggtagttacagttacaggaagactattaacccctttctttttctagaatggctgccctgtatgtaatttaggttttgaaatcttccttttcctggacagagaatcggtcccagaatatcagacctgtgtttattggaaaacagctctatctatcgcagagcaatttctgttgtccttattaacaaagatctttgggaggtgaaggtcatttcaggccagtgctgaacagcaatgaatttgttaagttgttttccgaatgctgaaaggagatggacgtcagaacctggacatgaacctaaggcagttgggccaggtttaaacctcgcatgatcagtgggaatttgtgtactttatttaatgggaagcctcaattgccttatataaaaagtgaggcaagtgtagcatacacctttcagtatttggggtgaggattacatgagataacacgtggaaagcatttaccataatgcgtaaggactaccactactatgatctgtttctactcataatacttctaacatcaaatatgtgttttttccctcacactaagcaattctctagttctccagacaccaattagttgttctacaatttaagtcaagccttacactatctagagtgagcatcaggtggcacagattaaggactcagtcccacaagactccccccacttcaagatacccatggcaagtccaggcaacctgtacttctgacagacaagctacaaagtcataaagttgaggggttcccatgactctttcttgggtttgataatttgctggaatgggtcacagagctcagggaaaacaatttacttactgctaccagttaattacaaaggatgttggaaaggttgtaaatgaacagccagatgaagcagtgcatagggtgagatctggaagggtcccaagcgcgggagcttctgtccctatggagttggggtgtgccaccgtcctagcatgtcagtgcattcatcaacatggcagttctcctactcctgttgtttaggttttctatggaggttccgtgacattggcatgattgatgaaatcattggccagtgatgactgactcaatccccagcacttctctcctctccataggtcaggaaatggggccaaaagctctagctctgtagtcgcaaggttgggtgccctggcaattagccccaccctgaagctatcgaggggcccaccaagaaccaccttattattaggcttaaactcaggtacgattacaagtgacttatgaaacaaaagatgctcttatcactcaggaaattacaagagttttagaagctctgtgccaggtactaggatgaagactaaatatatatttcttatttatatcacagtatcacactaaagcataggaagttctcaataaatggaaaataaatagtggtcaaacccacctttacatattttgatgccaagtgtcaagaaggattatttatgaaactcttctcacacaagtttccatttcttcctttgtacacatgagagggcctgatcaggtcagaagaaatcacatttcacacccatggttttttgagccaaaggcacaggggtgtgggggtgtagggaggcaggttgggatgcttcctgctggcagtggtgtctcaaagagcacaaggcagggaaaataggggatgggtggaagaggatagctagggtagaagcaaaggaaaataagtacagaggggaggcagagagaaagggagaagggagagtgccatggtgaagagtttgacttgccagagctaattctttgtaggcaatattagggtttcttggaaggaaatcccccgttatggacttggaaggtaaaaatcagtttccataaaagagggagtattagatacactaagctggatcatgaagaggtaaaatgtatgaagattaaaaagaggatgcagaaaagaaaaggacaaaaatatattaaaaattagttcaactcctgctgggttcttcacgctcacagctgattagaaggtgggatatatctgtgtaacatatttgtggagcctgcttagctggaagtcctcatataccccctaccccaccacccaccttcccacacacaccctacttttggggagcctggctctgggctttttctcactgattcttggccagagacagcactcccttgccatgggggctctctatagaggatgcgtgtcctcatgagatggcagctggcttccctgagagcaaggcacgggggagagggagagcatgtcctggcttgaagtggcagtcattttatagcctaatctcaaaaaggacatagcatcactttggctgtgttctgttcattagaactgagtccctaaaccctgcatacacgcaagaggaggagacttaaaacccatctcttgaagggaggaatctctatgaatttgtgggcatatttttaaaaccaccatcatcccaaacagcattctctttagtttcttgttccaagacttcctgcatcccgactatgtctctgtctctgcttttggattatttgagatctctttaaatattaaattccatttactgacttaagttcgaaagtcctttccaataccatctgaagtcttggaatcagtgaaaacatgtcagacacgggcactttgctgtcttgcagaaagtaatgactttggtggacaagaggcagttggaggttatcttaacagaggatcaagccaattcctacactacaagggtaatcactccgcaatgagttcaggtatgcggtttcctaggctgagtcatctcctgctatttcgtcaggtctccccaaaacaggggtcagtacacttctgtaaaggaccagatgggaaatatttttggctttgtgggccacatgtggcctctgccacatattttcttcatttttattacaaccctttgaacatataaaaaccattcttagctggcaggctgtaccgagacaagcctccaggatgtagtttgcagacccctgcgctaaaataatcatagagaggtgcttgtcgtgtccttggaaatattttagatatgcttttccataccacccagccatggtaagagtcttctttctgtgtctctcaaatttcctaaaagatccaatttatcttacttcagacaaagagctgggagtccttttatcaggttggatacattttacataggatttctctcattccttcagggagacagaaacaggttcaaaaattaagtcactaaaatgactaatgtggtactgtcagagaagaattatgaacctgcagggttatggtctcagaaaattcatattgcgtttctatgcctcacgtgaataacaataaccttctccaacaagcagagtgaaaaatgtgaggactgccagtaagtattccttactgctggctaaatgctggcaccacacaggctttctatggcaatgggaatttgtgtcagagttggcttttaatgtggaaaataatccagtttcatactttggcttttatgtctttgctgttttctagaacgtcagcatgcctcgtgaatgacattgaacactccacaaaccaaaccaaaacaaaagccttttctgtgtgtctttatcagcaagtgaaatcaaaattgttggatgagaattctcaaaaccaaaaaaatctacgttttatttttaccagggcattagtaagaaatgtattacttagcccatgagttgacaaaagaaaatgtattaacatgtatgtgtgattaatgaattcatactaaaagagggaaaaaaggaaaaaaaaaaaagctgaaggaagaaactaaaagctgttcatcatattaatgttttgtagccccagataagtagtgctgctttcttattttactcccatgcccaaacctgtagtactgcaaaattgctgactcgaggtcctacatgaaaactgtgcagagacttgaaaactcttgcaagagtggggagttctatgaataaataaattgtttaaagggtcaatgaatcaggtataaacctcgttttgtaatcataaaatctgtggtctcaagtctgtttaacgctcttaaggtttacctcataggactcactattagttgtaattaaaactgaccaaaaaatcataatttaattggcgttaataggacagactttgaagggtcatattttattttggatacataatgtttcttcctgaaattatttattcttgtaaattattctgatttaaaatttattagccagttgttgaagaaattatttacttgccatttatttgaatggttcaagtagtatatgcgtatatttaagtatttatcctaacattttcatgtgatcgggaaaacttttgctctaacttgacatgttttaattggcgttttatgtcacaagacagcatttgttacaataccattatttgggggttttcataagaaaacctattacagcctaaatgttaaaaactaagatcatttagacacttctagaagcaaaaatcttctgggttccataaaacagggaaattgggtttatcaagtccaagatcatctgacattagtaatgagatatgggagaactagaataatttattcttataagcaaactgctgagaagatagaaagacctgaaaacctttctcaagctgttgctgtaagattgttctcctgcagtctgccttacgggtagtgtgctctatcatccctccaccatcggactgtttctgtctactgctgcctgctacatccactgcctcctcatggggctccacctgtttagggaggaaggggctctgcatattaaatgactgatcctagaaccaatgaggggctctgcatgttaaataactgaccccagaaacaatgaggtgctctgcatattaaatgactgaccctggaaccaatgagagggatgaggcattagacagaccgattctcattttcaatgagtgcagtcacttgcagagatctctcttttcatagatcacaaggctgcctgatatattttttaccaaacatatttctgtggagaaaaggcagctggaattcctttacatttatccaaaaaaaagaacatttgataagggcaaacttctgcaaattgaccgatttggcagaaagaacaaagaacatgctagaatactccttagtgagggattcatgtgtcgttttatgtctgtaccattgtacatactggcaatgcataattgtctgtggcctactctgccaccaggagagaggaaacagatgttcctatctgtcttttgatgtggcttctgatacttacattgatttgtctaaaatagcatcagctaccctagaaaatttttttcctagtccttgagttggttggctaattgtttcaggtgactattaataatgtgggccaggcacggtggctcatgcctgtaatcccagccctttgggaggccgaggtgggcagatcatgaggtcaggagttccagatcagtctggccaacatagtgaaaccctgtttctactaaaaatacaagaaattagcgggtgtggtggtgtgtgcctgtaatcccagctactcgggaggccgaggcaggagaattgcatgaacctgggagacggaggttgcagtgagctgagatcgcgccactggactccagccaggatgacagtacgagactccatttgaaaaagaagaagggaaaaaaaaggaatgtgattatcatctcaagacgatccactgtcagcgggtattgccctgttacagggaaaagacagagaccattgggaagtggacttacagaaaaaaaaaatcacacagtattttatttattcaaagtggagtaagaccccagtaagactttttggaatagatctaatgaaaaattgagggtaaatttaaattcaacatcaggaggtcttagcactccctgctccatacagtaattatagaactgtggttataggtaggaagactagataattagagtgttatcagtagtcatgggagaagtgacaggttcattactaaataaaagtaatttaccctaaattgaaaatgacagctgatgccttctaaaagcacagcttgattagaaagaaaccatgaggatattggatatatgtaggagaagaaggaatggcaatagatctgaaatcacaaaatatatgcagaaaggagatgacgggggttagagttctccttttgcttaggctggtcccgagggcccacaataggctatattcttatttatgacataaggagaacagatattggaagcaactgtctcagaccatcagtcaaaatgtacaacgcagacaagatcacgaaaggaaaaaataagctaacagggggtatcaggaagtagcataactatattaaaattgactgttatatgcacattttacttaagaaaatcttatacaaaatttctagaagttattctagagggatttctactgggctaattttttttctcttcatctatttgacctcattttttattaaaagacctctgttgcatttctcatggtcactgtaagccagaatgtcccccttgttcccagactccacaacatgcagtttttccaggctgtcagctagggtggaatgcagggtggcatcaaagcgtggtgactgacagcttgcctttagccggcaaatgatgaaggctcaaatcgtaattctgctccctgctagctatgggtgctttggagaattgcagagactagaacaacatttctccacctaaaaaatagaatattcattatatctgtattattaagttgttaagaatgttcttcaggataattcagagcttttgcagtagaggtcgacaccattcctcattcttcgcacctccgtccaaccactcaccaaagccagttggttcaatctcttgaatctcttttcagtccatcctgttctctccctcctcacctgctgcccctttatctcaggcttctgctatctcttgtggagtatttcaatcaatttcaagtgggtctttcatgctattacatattcctaccccacaaaacagccaggtgagagagaacccacccatggctcccagctgcccccgtagacatgcctcactcccagcaaagggcacaaagccctttctaatgtgaccacggtcttcacctggcttcaatccttccccactccattcgttgtctgctccagccgtactaaattactgtgactccccaaatgtacatgcttcctctcacctctggggcttgctccccacccagtgaaacattccctctttcctcaactcatcctacttcatttgcgtgaatatttcccacttagatccatcgtgaagcaccggccatcggcactcccgccccataggcccctcgtaagtctttgaagatgccaaagcctttctcacataagagttcctggacgtgctcttcactccacctggagcgatcatccctctctctccttttaccccattcattcctactgattaattttgcttcacaagtgccttaggcttatcagctcaaatgccacttctacagggaagccctctccaatactcttgtttgttagaagccatcttagccacctacaacctacatttcccttcgttagcacgtatcatgactgaggatactatatttgcgtaattatttggtttaaaaatctctgagagcagatccctccaagcacatgctaagacaaagattcaagggccagcagttgatctggggagtgattcccaggaagggccagtagagaagcggtgaagtgagatagagaaggggaggaaacaaaaacaggtgcatgaacaagtagattgtcctgtgggcagctgagacttagtcctgcgggaggactccgggaaatagtgtggatgtgcctctgaggagtcccactccaggggcatggatgccagggtaggggtatttgttcgccccctcctgtccgtcattggttgagggctgcttctgggatattaactccccagcacctcagtattggcaggacaagcatcctgttgagaccagaaaaagccctcaggccgcatattcaagagaagaagcctctggtgcatgcagaaatcagaggtaagtgccagggacgatggccagggctttgacagctgtggctacaatatccatctgtcccactggactcagctccacagctcttttccccactagttatctctagagcagcactgttcaacagaaatatagcatgagttacaaatgcatatgttgttttacatttttcagaagccacatttataaaaaaggtgatattaattttaacactatattttacttaacccaatagatcaaagtagtatcatttcaacatacaaccaatatgaaaatcgttccttagatattttacattttttcacactacattcaaaatctgacatatatgtaacatttatagcacatctcaatgtggacttgcctcgtagtccgtggagtgcccatagccatgtgtggctagtggctatcacagtgggcaatacagctttaaaggacagagtctgggagagactgagacctcaaaaaatactcagtgacaaaagtctccgctggggcagtgcctcccctgagcaaatttcactgactgcctccaggactggaattaggtgcttaagagcacctgctgccctccctgcttcctccagcacaatgttagctgtacctaactgggtcttgtattcactcatctgtctccccagcatgcttctggagggggtgggcccccaacttgttcattcctgtgtctgcagcacctggtgcaatgtccagaacagagggagcttccccaaagttttgctcaatgatgaatccattttaagataaggtgattacattatcatctttagtgaaattttagtgaaaaggtaaattctatacattgattttatgaaaagtctatttttgtctacaaatattagtatagccatgagggattattcaactcatggctacagagattcagaatttggacaatgaacaatgcagtaataaagtgggcgttcatagccacatgtaattaacaaaaataaatcgcagcatactttctacttttacctgttaatactctagagcctagaccaattgtattagtctgttttcacgctgctgataaaaacatacccgaaactgggaacaaaaaaaggtttaatttgacttacagtttcacatggctggggaggcctcagactcatggcgggaagtgaaagactcttcttccatggcggtggcaagagaaaatgaggaagaagcaaaagcagaaacccctgataaacccatcagatctcatgagacttattcactatcatgagaatagcacaagaaagaccggcccccatgattcaattacctccctgggtccctcccacaacacatgggaattctgggagatacaattcaagttgagatttaggtggaggcacagccaaaccatatcaccaatcattctcaaagagtgtggccacactcatagcagcagcatcacccaggaattgattggaattgcagtgctcaggccctgtcccatctccgctgaaccagaacccagctatttgtgttttaacaagcccttcaagggcctctaatgcacagtgaagtttgaggaccagtactccagatagagtaatttccaagttactcctttagaaggaaagcaggagatcttagacaagagcttcctgtgcctaaaattccacacaaacaaaacatttggtttatctgcctaaaggtgtgtggtttctctacttgcaaattaatttcatatgaagtaaagagaatatgttgagatttattctggtacaatgtcaaatagcgattagcaaaacatttggctaaacaaagccattattggaaatctgtaatttttaaagagagattaaatacacatagaccaccctcttgtttttatacttgtcagtcagctttggggtggttgttgagttttatcatctatgggatcatactgagggcaagagcacatttttggaaaaagttcatacaaaatcatgggaaacccatatattgctttcatcctgaacttcaaaattccaaatcaacatctttaaagttttattcctactacttgaaatagcatgtctcaacacggaagaaacaagtattttaaaggaagaaagtggtagaaacacagaattggtttttgcttcccatgataatatggggctgcccacaacctcagatatatgtgtattgaattataccttggagagaaaataaattaggctattcagaaagcaggagactttccctttgtgagttgccccagacagacacttgcactcacacatctacatcttcaatcgttgacttcccaaagagccatttggacaatgccaagtggagaactgaagcagttactcctttcatccagcaaaaatacccaacatttattcatatctacatagaggaaacaacttttttttatttttctctggatgatcatctctagcctcagtttcactttgtgcaggcagacacatctcatgaaacctttccattcctctcccttctgtcaactcctaaagggaaaggcttttgtcttctgaatagcctaatttattctctctccagcatcttgaacgttgtaggtactcaacaaacattaattgatgacaaagctatataacagcttttgaatttattcatgggatgattcttctatttaaagaacatctttatatactttccattcttcagcaaaaaaaaagcaaagaaaaaaaatgtttcatcttgccagttctgtatttaacatctgcacagagcacagtgtgtgcctgttttaaacaaatgtgtaggctcactggttatctagattcaggaatgtaaaggacaatacagagaaatgtaatttttagaagaaaatttaaacttagggcttaatgaaaaaaatgcagttgctgttttatcagagagagtgagaaagggagagaacaaggaaatcccattgtaatgctattatgctaacctcattttggccatgattttcccagttatagagtggacaccaggttatgtgcatatctgagaactggcataatttatcatcaatttgcgagcacagaacaactagtagaataactgtgtcagtataagttgatttctaacctcagttgtaccatgaagtcattggaagactttgggaaagttacttaattctcatttgttagttacttttaaaaaacagccacatgaatatatttcttattattgtcattccttaatagttattgattgtgtacaggatgctttgtatctctgcaaggcactgcaacttccccagggaagcccacattaatgaatagtgtttataaagtacttggaaatccttggattaaaaactaacggtatcaaagtatttgtattaacatgccatatgggagaaccgtatgttatttattaagaggctatgtgtggtattgaaaatagctctctggtgcatcactttgtgctatttttatatcaagatatgccacggcaagttttggtacgcttgggtcataccttcaatgttgaaatgcctcaaaattcaatccttccacaggtatttgttgagctccttattgagcacttgactctctgcttaccattacacaacacatatggaaggcccagtggcacctacagtttcatgcatttcgtctctttgaacacgtgttattaaactgaagtccccgttaacagacacacgggcttaaaaaattacaggttccatttttcctcttccttctacatggacaatgctgttttgagacacaatgatagagatagggctgacacgattgtcttgtctgtcctaatggttgaagactaacccatgaagcttgcaccccttctgttaatggggcatggatgcagcactatttgagtttattttgggtagaactggcagccaggagagcactgcccagcatttccccaaactggctacacatgctgcaccaccttcccagaaggctgtaagtcattagtctggagaactatattgtaacgagttccatacaaaatctgcccccgcctggggaggcaattccttctcttagctagttgctctaataaggagacgatggcaatgggtgtattatcacaaggtcctgagatcttatgtcggggccagcatccttgaaaaattctgttctaaatgacatgtggaacctcatgcttcataagtaactgaaagatcctggaatagaagataatctacctctttttttcctgattcatttgtgaactatccagacaaggccaggtaaggcaagagcgtatttcattaactggagaatatttattgaacccctaccaggtacttaggaaacattgtttcacaaagcagacaaagacccttgcctccgtggagcttacattcaaggaggggcaggaacacataaacaatgaacatgatacctacctaaattagaggatatgatatattagaagatgatggacaattgaagaaccaaagagaaaaagttgatcaggataagaaggatggagtgtgtgagggtggggagatgatgcaattttaaatggaaggttcagtacagatctcattgaaaggggacatttaagcagtaacttgaaggagctggagagaaagcactccaggtggaggggtcaggcaatgcaaaggcctggggagaggagactccaatgtgctggaggaacagcacagaggccagcatggctgcagcgactgaaccagcaggataccaggagagaatgaatgaagacagagaaacaacgagggtctccaccacgcagggtcttgctgccatcagagcattcaagcaggggagtggtatgagctgcctcacactttaaaacaaaccagctagtaggctgagaagaggtgttgagaacaagaactgaagcagcaaaacacatcaggaagccattgccaccacccaggatagaggggatggaggatggccccagccggcactaaccattaactaactattaatacttgtgctccccacacttcaccatttgatttttgggaaccattagttgagatcaaagacacatgaaatgtttaaacaaatccacaatttaatgaagttcaagcagaagctgagatagatatcatacttcatctgcctagagaactgaaatacgattcaaggaaaaaataataatgctttgggggaaaatgaaatttccctcctaatcccttgacatgtgtttatggagcccttaacagataaggcactgtgctgggtgccaaggacaccacagaaaaaagagacatctctctgcagagggcttatggcttagctcttgcaggtgagcagaggtctcaggaatctgcaaggcaagaaagagagactccaggatttggcatgatctggacctgtgtttaagtctcagctctgccacgaactgtgtgacttcagggaagtgactttgatctcccacagccttgatttcttcatctgcaaaaatggagataaagtcgaatacgacggtatgacgttcatggttatgtgtgtgaggtgtgtgagcgtgtaaaggcctggtgcaaaggagacatctgtaggaagcggcagctatgactcctgctaggtggagactattcactgcacacctttttatctgcactaaaagatgcacatgaggctcttcattaaaacaatgaggcagccaacatggaaacttttctaagagtaagctattaaaatagatcaatcagctaatgacacctccagacaaaatttgtaaaggtttggaactaacattccctccctcctttccttccttctttcctttcttcctaaagccattaagcaggactgagaaaaataggtgtttgcattggagagaggatggtgctgaggggtcacagggtttggacagagtcggaagggcttctctgtcccagactactgtgaactaaagagacacaacaactgaatgctgtatgatcctagattgctattaggttattcttgaaaagtggcgaaacacagatgtgatctgtagcttagatagcaggaatgtcatctatgttaatcttttgatctggatggttgtattgtggttatgaaaaagaatgtccttgtttgtagaagatatatactaaagtattcaaggctgatgggcatgattaggacatgattatgtctgcaacttactctcaaatggttcaggaaaaaaaagttcttgtcctgttcttgcaacattctgttgcttaaaattattccagaataaaaatacctttagcaataaacacaaaactttagagttgtagcactgcactcacttgatatgagtgccagaggggtttgattctcaatatttgttgtgttcaatgttaattgagttaatccagatgagattatcatttcccacatttttgctgattcataatttacatatcttacccagacaataaatagttacatttctaagtaggcagtagtaggccccaacatcagctaaggctgggttgaaactgtcccctgctgccatcacttgctagctgtggaatcttaacacgcctgtgtctcagttgtctcatccatgaaatgcagataataaaacctgcctcatgcagtttttatgagaatgaagtttgataacctttgcaaagcatttagacactgagtggaacatatgcaatattcaataagtgttagctggtattagctaatattctgttgctcatagagctctatagttaaataaaccataaacatcattatattgatggcagtgcagactctttaagagcattcctctgttatatcagctaattttacttttcaaatatgtaccttctagagaattttggaacatatgagatgaaaatatagatggggaaatacaaaattaaagactagatttttttataaaagagtgctaattttttttaaagttaacttaaagccttcctgagctgacaaaaataaacatgtgtattaatcagctattgccataataatgctgtgcaataaatcaccccaaaatgcagtcccctacaacaaaaatatttattctcatgctcacaggtctgtaagatgactatggttcagctgatgtaggctgggctcagtggggtggttctactgcaagctgtgagttgcttgggcttggttccagactgtgacttgggttcaaacttgctccatgtatctctcatcctccttaagccaagagctacaggggcatcttcttgtcatggcaaatgtcaggaacacaagcaacaaatccttttatgcagtgcatgtaaatcctttgctcacattctctccactagcatttcattagctaaattaagtcccatggtcaagtccaacatcaatggcatggaaatattctctgctcacagtgggaggacactgattttatatatatatatatacacatatacacacaatcttattataggggactgaagaattaagaccaataatctaatctgcaaagcactggttttgaattgtccgtagtctgtctgtgcccagaaatctatagacctttagaagaaaagacagcagtataccagcaggaagtacacatcagattgtttccccagtatagcgatggatttatttagacttacgtcttgtttatcttcctgtcaccatgtagcgttcacaaaaggaactacaaatatcaggatagcaatccgtgatcatgttgttgagattttgcccttacaaaactctcccatgtagagtcaaacatggactgctttcttatcatagtcacgttgcagcaggagcctcttattttatttctataaaatttctgaaatgttcttgcaaacagtacacatttgataaatattggttgaaagagtaggaggcagagtactaatatgggagaaattagaaggacacaaccagtagaattctcacaggtttctgtgctttttcagcatgggaaagtaaagtgttatatcacactcgacatgaatgctatggaaatttatcatctgaaataaatatgtgatcttaaaggaatattaactgagaacatttagcttctatgtggcattatttaagctaacaaaatagcctcgcacttccctatatttcttcaccgttattgtaaggcttttaaaatcccttctggaaacctcaagtttacacatccctctacttaatttttcattgtttatgtgcttcctgtgacgatagctagacagacaaggctgataaaaaagaaagcttgtccttatcaaagacttacgggtaactgtgttaatgtgccttgctttttctaccagtggaagccccctatttcactaagaactcacccatttgcagcatttaaaatggatggaaagttataagccagccaaaatgtccttctaaaagaatgaaatgaatactaatctaattgcccaagaatgcatatgctgggcttggaaaataagccttctacattggttccccctgctggatttgaggatgcactgtcttggaaattgatgaaagcaatatacctggaccgttttatctgaggacatgttactggaatggcaaatccagcattcttctagaaagcatttgctctgtgataaatgtgccaagtgtttcttgagtttgcttccccagggcagaaatactgcaaatagaaaacagtgccgctgagactcaaagagaaaacaaaagcatgccactcagatgtctgttctagggaggggggtagcacacaaggaactaagggtaaaaacccagaagcagtagactaggtaaactgccagactggttgttactattagaaagctggatttcagggtctgaccatggatttccttcttatgcatttacaactattagaaccaattcctcacctttctgtaatttaactgctgtttttctttcccttcttatcttcctcacttcataagtaatctccctacccctactctgtagaagatgtggtaaccagagtactttcaaaggaagcttgtcacctgcaaacttcatggctattgtgaaatgtgttaaaaggtctgtcttttgagggagacagagaagctggcagatttttcctgcttgactcagagtccatttggtgggaggaaagggacagatattggctaagtttttggcacatgctcctgcaccaacttggccttgttaagacagcaagaacagcagaagtgactatttcctccctagagcaaaggccaatgctgtttccttcatggagaaccagaacagggaaaatatcagataatcatgtagtacttgtaaatatgccatttagaacactgaatttaagtggcatgcagagccaccccaggttctcatattatattcaggccaggtgtggtgtcttatgcctgtaatcccagcagtttgggaggctaaggtgggaggattgctttaggccaggagttcaaaaccagcctaggcaacaaagcaagaccctttctctccaaaaaaataaaaaatcagtcaggcttggtggcatgtgccttgtagaccctgctactcaggaggctgaggtgggaggatcgcttgagtccaggagttaaaggctgcagtgagctatgaacatgccactgcactccaggctggacaacacagcaaggctctgtgtctattaaaaaaaaaaaaagtagttatattgtgtccaccgtcacaaacggcacagggctaacccaacacagggggtcctgtacgtatatttattaactgcattcttcgccaacctcagagtatcattcttttttctttttttgtccttctattataaactttttttccccatttaggtcaaatctaaatgtttccccatctgaaactttcttcagtaggtcgttttccagagctgcaggtaaaatgcttccccactgcttctgaggcttttgtttcagctctgctactagtggcctcctcttgggaggattctcttgcctcggaattaagagttggtaggaggaggagatggcgggtcaaagcactcaagcaagacaacgttaagtgattcagtcctgcttgtgggtcaggaatttttaaagggctcagctggatgtctcttctgctccttgtgacactggctgaggtcaccgctcagctgcatttggttggcagctggcagggtggaaaggttcaagaaggcttggctcacaggtctggcccttcatgctccccacacatcttttctccctctctccatgtgtctccctccatttggcaggccagcttcaacttctttacagcatggggattggcttcccagggggagaaagtagaggctgccaggtcttgcagggtagcttgtaggtcccagaatatcacttccaccatatttcattggtctaaagaagtttcacagccagtcaggacttaaagagaaggaatgggctccactccttcagagacaaagcatttgtggccatctttaacccacatgaatataggttggtaacttctgcttctgttttctgtacttcactatatgttttatactttattcttatgtctttgtataaattcatcatttttatttgcttcattttccaaaccaaaagcaatttggagaccctcccagcaatgagttataaaaccatgcctatacttaaccttcaaaaagcttattatttctacagataaatccacagatatagtagctattttaagaaaaaagaaagtttcagatagttgctaatatacagccttcattgcacctgaccagttatttttcagatagctatatatgatagcataaactcaaccaacataatctgttcaagacaaaatattttatagcataggtatgttagactgccatatggaagttaagtgaaaattgaccttttttttgcagcatatatcatacagagaaataaagggcgagaaacttagccaaccttccttacacagtgcatgttacttaagtcaagggagaaaagtggactggagttgaagtttctattatattttgggaaatgccgagcaaggagagacttgttaccgggactgctgagtgaattttgtttactgcggttaaacatttcatctagcaaatcatgtgagaagggatgagtataaatgcacttatttatgtaggtaatttttctgtttcatgcctctgattcatctctctgcctggctttatggggagtcatgctacattggttacaattaatttcagtgctgcatattagccgtaaagagatatttcacaaattgacttgatgcattttttttcctctgtggttttcttgaaagatgagaacggtccagaggagaagcaaagtgtggaagaaatggaagagcagagccaagatgcaggtaggctcagatttcttttgagaagtcacctaggcctcatctgcagaggtgaacagtaacttcactcaatgctattgtctgaaaatgcttatacatttcaccagatgaactccagtgttcattcagggtctccctcaggaagccaccatctccgataactatgagttgagtgctttcaaacagagtggcacattctcacatctcattcaccaattcaattttctgccctgtaacagtttgcctggcaaagctctaagagggacgggcggaggttgaaagtgccaaggcagagcttggctgagttaggtcaagctcaaattagtacatttagcttgagggaaaaaatgaaataaaaactgatgaaaggaaatgaagaagaggcttggcctgcacagtgagtagaatgttctttagtgtattgcattaaattttgaagagctatgcttcaggttatttctctgcatattgcaggagatggtgtgatgggcctgactaccccacacacagagctcgaagtaagatctaaacccttcctgacatcccctctgttcactaaaggacagatgtgtccattgaaagtttatatattccacaccgtagattataaattgaacattttaaaataaaatagcacttaaggctcaaaagggattgaagtcacctgtgatttattatctcttcctatccatttttgtactcagtcatgctctcctttaaaagaatgataggcacaatcattcactcaccaacataaccagcaaaaaaataaaaataaaaatccctgttccctttagtttcccagttattctcccaactctaataagccccatggaggggcacttctgaagtagtgagccctactgtttgccaagcacatcctaggccatatgctgaactcttggaattaaaccaggtagtgtgataagtttttcactgtaaacttcttacattaaccttggagattttgctagggatctggaagcttttattattaacctggaagacggaactgaagaaggccaatcagagaaagcactgaagcaaggcagcaaggactttgtgtacctgtgactgggtcggccggcgtcctttgctgcaagatagtccttgcaatgaaatgaatttctgatgcagaaaactgttgttatccaaccctcccccacccccaacccacacattctgctccatagcagatgagtgaaaagctgtcactgtttttattgtttggggctgacaagtattagtcaacaaactgctgacagctgaggccattctgtgactgttgaggtttcaaaggttttattcactcactatcgtgtcccaaactgttttttttgtttgttttttgttttttgttttgttttgttttgtttttttgagatggagtcttgctctgtcacccaggctggagtgcagtggtgcaatctcggttcactgcaacctctgcctcctgtgttcaagagattttcgtgcctcagcctcccaagtagctgggactacaggcacgcaccaccatgcctggataatttttttatttttagtagagacagggtttcaccatgttggtctcgaattcctgatctcaagtgatctgcccgcctaagcctcccaaagtgctgtgattacaggcacgagccaccacacccaggcccaaagtgtccttatcgaaaaagattgtttccatccctgtacatacatgtacacacgcacactcacacacacgtatgcatgcactcacatacacatgtatgcatgcactcacatttgcctgtgtttgatttattcatcttttccctttaaccagttgagaacaagtagtttgtagatttgagatccttttgcctgtgaggagggagtggtagaatgtcagccctcttctccagcccttgaatctgatagcgttatcaccacaataggggcacttctcaatgtgaagaagggtcctaaatgcatccctgagtgactccccttacttttccaagtgagctcgccggccggcacagaggccaatggcagagtccacctataatcctggccagtgtcaacacacatagttacgttcacactgctcatttcttatcctccctaatcagagctcagagaaatcgaagatgtggttatgggtcgttaaagctcttttgacctgctggtatttttccaaaataaaagtatcttcttttcattcaatataatttccagcttcaattttgattatatagctctgcaggcctcttacacgtcatgaaaaaacacaatcttaaaacactgtaatccagcagttttgactgttgtcatgatcaaatcagatcaaagttgtagataatattcttccaaaaaatttaacaaatacatatcaagggttcattgtgtcataggcaccattccaggcactgaagaataaaccaacaaccaataaaaacaacatctctgtttctttgaaatttatattctggtgggggttccaaacaataaacaaataaaaatgataacatcaatagtgataaatgctttgctgagaaataaggaaacatagaaggaatgcccagaaggcaaatttccattgtctgggtttgggacggactctctgaggaagtgatagttaaaatgagatctaaatgatgagatagtgacagagaattctgttccaaaggacacctgacctgcaagtaatagtacatgcatcatggacaaaagataggctagaaaataagtgatttgtgatttgcttccaaatatgtgttagttttcatgcatatatgagttatctttagttccccgaccctgctactacataaaaaactatgaatatgtatgtgtgcatatgtactatatatatagtttatatgtataaatataccatatatgtataaatatactatatataaactatagagtccatgtagtatatatatgcatatgtaatgtgtgtgtatatatatacacacatatgtaatgtgtgtgtgtatatatatagtttttcatgtagtatcggaatatgtatatataactatgtacgtaactatatatcgctattatatataagtatatagctatacatattttctgctactatatgaaaaactatatatatactatatatgtatatgtatactatatatactctataatttatatatagtatatttatacatatgaactatatatatactctatatatacacatgtgcacactataaatacttttttctatagtaacagggtcatagaactaaagataactcatatatgcatgaaaactgacacacatttggaatcaaatcacaaatcacatattttctagcccatcttttgtccataatgtgtatatgtgtgtatatatatatatatattcattttccagttatcaggtattaaacattgcaaatgattttagtaatcctgcctgtctagatttactgtttgaatgggagggagtaggctagttagctgttatcgtggaggccaaacatgactagagtcactaggggctgatgacactgaggagagaaaggtctactctaatgtagttcattgttgctgtgaggggaacagagagttccatgtccttagtccccattttcccattctgttcttgggtgacatgaaagttcctggtggcttctggtgacctgtgccgaatgctccccttcttccaggcctctgtgctgacagccatcagagctgctccctgcagtttgacagcctggcataatggagcagaagtgctgtgctaagaaaaaaacaaactttagaaacatgcacataaaagcactttgtaggaacttgcaaggatatactttctttcacaatctgttatcaagaaaaataatataccatcctttgagggatgaggaagaaacaaaatgccaaaggatactactagcaacaagtggcattcttcactaagaaatagattgtagcccattggtctctgacttaactgaaggttcctgtttcactaattataaaagagagtcccaaaccactagccccttcaaagagcattcagtgtattcaagcatgcggcaggctcatgctttctttggtggagagtggagggaggtgcagggcaggaaagccacagctggacttccggaaggatgaactctgaggcagtgtttcttttctgctttatagatggtgtcaacactgtcactgtgcccggccctgcttcagaagaggcagttgaagactgtaaagatgaaggtatgaggctactaactatatctaataattgcagactcttaaaagagactgtttgggcttgtttacatggaaaaatgaagcagcaagtcaaatataactaggttttcttaagtgtctctgtttccaatataattgactacaccacctactctcttttattgcatacctagcctgtatagaaaatttatatatatatatatatatgtgtgtatatatgtatatataacatttacatttgttcctttggaaaataactgtttatgaaatgagagaatgatcagagaaattatgtttagagatgtttatttaaaacaccagaattaatcagttctgctctttacagccactcatcaggaaaaggtttgaaagagtggcatttgaggaccaccaaccagggagcaccatttttcaaaaaagaaatgtttgaaaggcatccttagaaatgaatctttggcaagagcatcattctccattctgtcagaagttactatgagaaaatgtttctgacccaagtatttccagaaaaagtaaaaaaaaaaaaacaatttacttttctaggagacagtttgaggaaggaagaagtagggagacattgatctggggatgctacaattaaaaaaatatatatctaaaggaaaacaaaatagtgctttttcttctctctctcctggttcattggcaagtccccagatggaaaagtaatataggcttaccttgttttcttgcccttcattttactgtgctttgaaaatattacattttttacaaattgaagttttgtgggaaccctgcatcaagcaagtctgtcggcaccatctttccaacagcatgtgctcatttcatgtccctgtgtcacactttgataattctcacaatatttcaaacctttttactattattctgtctgtaatggtgatcagtgatcagtgatctttggtgttactattataattgttttggggtgctatgtactgtgcccatataagatagtggacttatttagtaaatgtggttctgactactccactgacccactattcccctgtctgtccccttttctcgggcctccctatccctaaaacacaacaatattgaaattaggccaattaatagacctacaatggcctctatgtgttcatgtgataggaagagttgcatactaaatcacactttaaatcaaaagctagctatgtttaagcttaatgaggaaggtaggtatgttgaaatctgagataggctgaaatctaggcctcttgtgcctagttgtgaatgcaaaggaaatgttcttgaaggaaattaaaagtgctactccagtggacacatgaatgataagaaactgaaacagccttattgctgataaggagaaagttttaatggtctggacagaagatcaaaccagccataacattcccttaagccagagcctagtccagagcaaggtactagccctcttcaattctactaatgctgagagaagtgagaaagctgcaaaaggaaagttggacgttagcagaggctgattcatgaggtttaaggaaacaagctgtttccattacattaatgtgcaaggtgaagcagcaagtactgatgtaaaagctgcagcaagttatcaagaagatctagctaaaatcactgatcaaggtggctacactaagcaacagattttcaatgtagacaaaacagccttctattggatgatgaggccatttagcattttcatagctagagaggagaagtcaatgcctggcttcaaaggacaggctggctctcttgttaggggctaatgcagctggcaactttaagttgaagacaatgctcatttactattccaagaatcctagtgctcttaacaattaggcgaagtctaccccacctgtgctctgtaaatggcacaacaaagtctgtattatagcatgtctctttatagcattgtttactgaatattttaagcccactgttgagacctactgctcaaaaaaaatgattcaaaatattactgcatattgacaatgcacctggtcttccgagagttccgacaaagatgtacaaggaacataatgttgttttcatgcctgctaacacatctagtgtgcagccaatgtatcagggagtaattttgattttcaagtctttctatttaagaaatatattttctaagactgtaactgccatagatagtgatgtcatcctgtaatgaagctgggcaaaataaactgaaaatatggaaagggtttactattctagatgacattaagaatattcctgagagaaggccaaaatatcaacgttaacaagggtttgaaagaaggtgattccaaccctcatggatgactgtgagtggttcaagacttcactggaggaagtaactaaagatgtggtagaaatgtcaagagaactagaagtggagactgaagatgtaactgaactgtaatctcatgaggaacttgaacaaatgagaagttgcatcttatttattaagaaaaaaaagtggtttcttgagatggaatctgctcctggtgaagacagcaggtttgagagtattgagttcaattttttgtttgtttttgagatggagtttcactcttgttgcccaggctggagtgcaatggtgcgatcttggctcactgcaacctccgcctcccaggtgtaagcaattctgtctcagcctcccaggtagctcagattacatgcatgcaccaccacacctggctcttctttttttttttttttaagtagagacggggtttcaccatgttattcaggctggttgcgaaatcctgacctcaggtgatccacccgccttggcctcccaaagtgctgggattacaggcaagcaccactgcgcctggcctgagttcaattttaagataatttctactgtgggtaaaatgccatcaaacagcattgcatgccacagagaaatcttctgtgaaaggaagagacaattattgtggcaaacttcatcactgtcttattttaataaattaccacagctacctcaaccttgagcaaccaagtggtggccgtcaacattgaatggccagtagtggctatcaacattgaggcaagaccctaaccaggagaaagattacaagttgctgaaggctcagatgatgattagcatattttagtgaaaaagtatttttcagttagagtacattaactgttttttaagacatagtgtatctaaaaatataactgatgtcaaatacccacataggctctgataggaaaccctaggtcatcttagagagacaaataaatgtgatcaaatgtgatcagagcgaaaagacagaaagtggtgttcaccttaagcaaaaattttggacataccaatcatttagtttgtgataaaaattttaaagtgtcatgaagttgagtggcagagtttaagaaacatgaaagagggataatttaatttgaatgtgaccatgtttcaggctgggatttttcctgttgagttgtttaatttggagatatcacaccttcacagaagcacactgtttgtgatgtttcttgatgcttttaggaactcacaccattaattgcttatgccaggatccatgttttggaatacttttaggattttttttaacataaaacttttaatgatggtaactccatgaaggagttctgtcatgtatcacaaatgcagttcctatgtaagactaaatgtgaagttttatgagtattactgaaataagccattaatatctattaacctatttacttagggaaaatagaaatgttttgaaatccacactagtatgcaagcttctttcaattaaaaacagaatgcctagggtatgatttttgcctttttcttctgaaatagcatgtatagaaaaccactgtttttaattgattatcagttcagagcttagaccagcttagaacaagtgtctaatgcttatggaactatcatcttgactgatagatacctagcttagaaaaaaaaaatccgttgaaatccttcaagattgaggtcaagataaggttaaaaggcagtcatatgcgtggaggattcatttcaaacattctccattattagctttcatgcagaaatatctcttctcagtgacatctgggctattttagagctctgcagttataagattgcttatagaaatgctcattacactctccaatttaagtggcagaacatttttgctgatcaaatgtcctgaagaagcccttgctctcttgagttcgttttcagactttgatcctgaccaagcatcttcttgggctttagaatcactgatattatggacaggtctttttttctctttctaataaaactcccaaggattttgaggctcattcagttatttccagctttgcttgttagtgggctggctttacatttgttacaaccttggtttccacaggaaattagcatcttctagggtgaaagtattgaaaacaaacaaataaaaaataagatggctaatgtcactttggagaccagatatttaaaaaattcgaacagtcatgggaaagttgaagaatttcaaaaggaagtattgtagtgcaggtgtcctctttgccagcagttttgttttaatgttctagacatattttccactgggaaccaggaacccatgtttgctgcctgcttacccccatgtacttgctaactgtgccagctgccaacagaaggagatgcaactgactggctcatggatcaagagctagattgtgagctacacactgatgacacctgttcccaatgagccattaaagccatagggtgggcaggagttgagctgggagcatgagatactagcaggaagaatgctgatgaataattcatccggaatgcatgccaaagatttggcaaccaggattgaattgaaattaactccaaggtaaagctggcctgggaaaagatttgtgggttggtaggcattttgaggttatttgtgaaataggatgtgtacttatctattgaggacttctttctctactggttaaaaatactctgttgatttaatggtagtttgcactttaaatccttaaaaacaaatttaggagtacaagtattaaggctatttaagttaacaaatatacaagcaatcacattaaatgggcatataaacacaggaatgtcaagtactccagatgaaacttttacaaagttattattattactatttaagatatagtcaacctctttaagataaataatatgctctgttctagttttttcaacacttccaatagctcattttcacctagagccaaggctaaggcagctttctgggggaaaataaagtgctgtttaaactcgtcttaatccacctgccttattatttaatcagtacctaatttaaatttgaaggtcaactagaccaaatcatatgctcattaatattaaaaacaaaatcaattaatactcaggtgcatacccaggcttgtattcctttggaacaccatgtaagtcatacaattgctgtttttggtatttatgaaatgggatgtcacctggcaaaggatttattaactcttgatctagtttcagacctcttagaagtcaaaattgctgtaggaaaaggggaaagctagagccaagagtcagccttgccaaagtgaacaaaagagaaagactacatacaaggaagagaattcaggagtgtgcaagagatgagagcacaaattattccaaccactgagcactgtaggcttggccagtggtgtggactcaaaattgctctggaaaacggcattgtttctgttctttgcctgaactgttgaggagaaacaaaaccaaggccaccaatgaattcctctcgagactctccaggctaatttttctttgtcctattcccattcttggtgttcaccatcccccactaagcgtcctcaccccatcactcatcagagtgaggacaaggctgtcctgtgccctggatctgcattggtagagtgtctgaatatgcttgagtatctctgagttatccctcttggatattaggagccttaagtgtagaatgaaagtggctgtcctctgctagtatactgaaggggaaagaactaagatacattgagtgtctcctgtacacaatgctttacatttataacaatgtagtcttcatttctcaaaagggtcacctgagactcagagaaggagagaggaaaagggtgtgtgtgtgggaagtgaggataagaaaatgattttattatggttaaccgccgtacctaatacctacataagcttatacaatccctttaaaaggtagtatttatcatatttttaatataaaaattatttttgcttataagaataatatatctttattgtaaaatattttttaatgtgaaaaatatacaataaaagcatatagtcattttccctttaaggattaaactgtaggaaaataaaagtctttattctattgcttcatttaacaataatactgtgaatatttgcccatgtctttagaagttcctcaaaggcatggattttattggtgtcataatattttatcatctggttatcccacaatttacatagccagtgccctaatgttagataacttagttatttatagttttcttcctattacaaataatagaaaaatgcagtgcctacattttggataaatctttgtgcatatctatgatcagttcctcaggacaaattcctggattttattgatttacgagggaaaaggttaaaacatttgtattacttacatatattttcttattttaaaagtaatgtgtgtttattacacaaaaaaaataagcaaaagaaggaaggaaaaatatcactcataaccctggtgcccagaaataagcatatgtaatatactgatatataaactctcaatgtttttctaggcaacctcatacatatatggaaggggtttttttagggtattctgcaatgcataaaagtttgaacctgtctttcaaatataacagtacattgtaaaattcttccaacatcttttgatagtctatcatcatttaattgtgtattccagtaaataaatgtttatattcttatccagtctcaattttgaattgtttctgtggtttcagttttaaattccatactgaccagaaacatccttttaactttgtaaaatgatcatgatcatttctgtaagaaaattctagtaaatgtgaatgcatgcaaatttgtgtgttttctacaatgaatagttttttaatttttttggttgtttaattagtatatttattgtataaaattcaaataatggaagagaataaaaaatattacatataatcacatcacccagagacaactaccattctcattttggagactatctatcatgcatctctttctgaatatatgaacatacacagctttatgtgaaacgtatgattgtaatgcaatttttctctttttgttgcttatgtactcctcaccattcaatcactcagagagtaaaatacatggactaagagtctaatctcttcttccaactacttgggcccagattccaaccctaccctgactaagctgtgtgatctttcgcaaattatttagtctttctactcctcaacttgagtttcctcatacataaaataagaacactaatagcacctacctaaaaaatatttagcattaaaatcattcagtccatttaaacattttcaaggtgttcctggtacacagtaggaggctcaatttttttagtcattattaaatatatatatgtttattttacaaatattgtattatattccacataccttgctaaatcttgctctgctacaggcagccaaacttggtggaagtctctgccagtcagtttgcaaagatctaattaatccattttaaagctcacatgataatccatagtttggctgtaccataatttattcaaccattctcctatgataaacaagcactttttttccactctattgccacatagactatgctgcaatagacatctttgcacacatatccttatatgctgatgcttttatttgtatggaaagattccagaaatgtgagttctgctttcagcagtatgtgtttttaatagatgttgccaaattgctttcccaataggctatagcaattcatatttctatcagcaactgttatttttgttctttctgatttttgacagttcaatggatgtaaagcaatctctcattattacttttaaaaagtcatcagtgttattatcccaattttgcagataactgaggctcagaaagtttgaatagctggatcagtttcccaaaagctagaaccagaatttggaagccaaatctgtctgaacccaaagcccatgcattttctatccaccatgctgcctcccgtatcatgaatttggagcagaggactttctttgcctgagtgggtaggatgcaggtgtgtctagagaaggcagagggtgtcatgggaaccctgcaacctgtgcaaggtgagcagggattggaaccacggcaacagggagggcagtttggagctagctgcttggtccacctcatgaccttgaccctaacctaggaactacaatgaaatgagtacacagaaacctccagtcatgcccctgactagatgtaaaacccaaagcactttgtattatattcctggtccttttgtgcttccttagaccctgcacgtgccttacgctatagcccaactcagttatttgtcctttcccaaatgccactggtctaaagcattctgccctcacgctgtcacatccattttgttctttattctgtatatgaaaatcctgatcatttttcagagtcactctcaatatctttcttgccctaactagaacctttactccatccttccctccctcccatccttccttcttccatcacaaattatctgagcaaacattacattgacagaaattataacagataatacaggtgaggggggtggtgcatgcatattttcacctttcttgatttctgttctcttcattacaattcaccccatagagtagtaactatcctgcttctcataaattcgtttataaaccttaaatgttatcatgaactatattgtatcaatattagttatatacttatctaactcagtagaatgtagacctcttaagagtaggtacaaaatctcattcatttttatgttctccacaaagctcaatgcagggggccagcccctccacacctgtgggtatttcttgtcaggtgggatgagagactgagaaaacaaataagacacagagacaaagtatagagaaagaaaagtgggcccaggggaccagcactcagcacacggaggacctgcacaggcaccggtctctgagttccctcagtatttattaattactatttccaccatctcagcaagaggaatgcggcaggagagcagggtgatagtggggagaaggtcagcaagaaaacacgtgagcaaagaaatctgtgtcacaaataagtttaagggaaggtactatgcctggatgtgcacataggccagatttatgcttttctctacccaaacatctcagtggagtaaaaaataataaagcagcattgctgccaacgtgtctcgactcccgccacagggcggtttttctcctatctcagaattgaacaaatgtacaatcgggttttataccgagacattcagttcccaggggcaggcaggagatagaggccttcctcaatctcaactgcaagaggctttcctcttttactaatcctcctcagcacagacccttcacaggtgtcgggctgggggatggtcaggtctttcccatcccacaaggccatacttcagactatcacatggggaaaaaccttggacaatacccagctttccagggcagaggtccctgcggctttccacagtgcattgtgcccctggtttattgagactggagaatggcaatgacttttaccaagcatacagcctgtaaacattatgttaacaaggcatattctgcacatccctagatcccttaaaccttgattccatacaacacatgtttctgtgagctcaaggttggggcaaagttacagattaacagcatcccagggcaaagcagttgttcagggtacaggtcaaaatggagtttcttatgtcttccctttctacatagacacagtaacagtctgatcgctctttcttttccctacactcaacacagtggcttgcacatagtaggtcctcatatttgtttaatcaaaaggaataaaatggtgtgtacataacagtttctataatgctgttgatgatttaacagtttcttggagaatttaattgagagccttgcataaaattagagacttcacatgactctagaaagtatgaatgggaaattatctggaattttttccacaagaattaactagagaattggagatagaacctatcatagaaaatgggccactttttgctggtgcatccaatgttgatgacatcgaaggcacccctcctgaggaaatctcaactgcatgacccctactatgccccaattcagcaggaagcagttagagcggtcattggccaacctccccaacagcacttgggttttcctgttgagaggggggactgagagacaggactagctggatttcctaggccgactaagaatccctaagcctagctgggaaggtgactgcatccacctttaagcatggggcttgcaacttagctcacacccaaccagtgaggtagtaaagagagcttactaaaatgctaattaggctaaaacaggaggtaaagaaatagacaatcatctatcacctgagagcacagtgggagggacaatgatcggcatataaacccaggcattcgagccagcaacagcaaccccctttgggagctctgttttcactctattaaatcttgcaactgcaaaaaaaaaaaaaaaaaaaaaaaaaaaaaaggaaaaagaaaagaaaagaaaatgggccacttttaattctaatattatagccactttcccaaatttgttttttactatgattaagattcctaataaaagaaattccctttcagaattctcttgtttcagaagtaaattttcccaaaactttcacactgcagaaatataaaagtacattcaagcccaagacttttcctatttgttcactttcagactttgatattcttcccctctaagagaataaaataaacttcttttaaggaagtacatgtttatctactatttaatatagtttaaaatattcctaagtggcaattggaaggtaagtggtagttcctttccaaatacactttaatatgcatatattacttttccttactaattaagtatggctataataatatatttgtaacagtcaattccattacatgctctcttgggacatatttctaaagatcttgtgaataagacttgtaaacaaaatcatcctagactaggacatggagattatttgaatgggtttacaattcctttgtccaacatagtgttttggacctgaatttacatccaaataggtccaaatttatatgagcatccttgtgataattttcaaatttagtggccttgtttttgaattccttgggccaagccatgaagtctttatgagtctcaatttatttcaaattcacatcaccattgctgtgtggccttaggtaatgtttttagcttgtgcctccgttttctgatgtgtaaaaaatggaattgtaatagtatttatatcacagggttgctaaaactgaaagagttaatatatttaaagtgcttacagcagcttctcaaacatagtaaactttgagttggcagcattattgttttttacaattattgttattacatttatttgctggctttaaaatcctaactaccccaggtggcacagtgatatgtcattgaatcatcaccaaatcaagaaatctattgatatgctaacgcaggttagagaggttcagtaacaggtaacattcaaaatatttaacaacagatgttgcccagcccctgaccatcaagatgagcattctccagtacaccatagggcgtgcaccagttgagtattgaaaagcaaccagagtaaactatgccagcaagcagaaacacctaagaaatctctacctagcccccattccccagtggagatttgttaactgggtatcttcgcttgaataccagacattccattggtgccttccatagatttttctgcctgctttgtgttttattctcttatagataagacctagaatggaaggtgcctagtccatattttgaaatgcttttgtgggcatcacctaataaaagtaatcatagatcttcaaaaccagcacaatttttagagtgattcgcactctactctaccagaataattataccagaattgacctgattcactaggactagagaaacccaagatgtatacttacccaaccaaaaatgcatgaagtcttttctgtctacaaattaaaatcataatatctctgactcatatttttaaatgtttaactttgactcccaaaagtgtactatttttaagagtatgtatttttctgaccctgtcatttcttgttaattagtataaaaaataatatttggagtaactctttagagtatttccacaaaaggtggtgtgtctagccaatctgagtaaacacaaaacatttactagttaagtgtagtctatttttctataaaatatcatttagactagctcagtggttctcaaactttaatgtgcattggactcaaatacacattaatatttgaatttaaaaataaatactgtaatttaagagtttttaaaagtatttccagagttaattttgaaggtatgtatttttgacactaaatagataggactgtactcagggcaggtggattctgacagcagcaggactctcatagcaggatgaggaaggagggtgtgttaacctaacaggagtggcctctgcccaggagtctccacaaggccacagaaagcccaaagatccatgtgtcaccaactgatcattgtaaataaagtggacctgcttctttaaccctgtcaaaaaagacaaaaacaaaaactaaacaaagaggtggctctactgaaaaacagaaatcatgacaatagttcatgtagaatggcacgtcattgtattttgactgggcaaaaatgctggaaaacggcacttcctttgaagtgaattcagatctataagcaacacggtggggctcttgctcagatattcccatgtttaaaattttatagcatctttgatgatattaataattgttctttgataaatgagttcagcagtcaaaacattttggaaactacgaaattaggcaaagttaagtggtttttctgtaatacagaactcagagccttcagcatgctaacatgaattgaaatgctcaggggagatggaagtatggggcgtttcccacgttaattaactaaatgtgattttgtgaaattttgtttgcttgctcgccccttttttgttggtagaactttctaaaagtcatacaaaacacagtttgggaaaccattccacatcccatctggaagaactcaagaacgcagtttaaagttttgattttaagaaatcatacccattgttataatacaaaataggcaatggtaaattaccttttaaaaatggagtctggccttcttgaatttatggttatggagtggtatcggaaaaacattctctcaagtttcagaaagggatgtagcctatcttagtttttgacaatagattttcacaagcaggaatgttttgctctgactcttttctaatgacatttgttgtcagctattctgccactgttcctaggaggatatatttatctagacacacacacacacacacacacacacacacacacacacacacacaaagagagagagagagagaaagagcacaggggaagatgtctcaactgctgcattctttaataagaagaaaggaataattggctggctagtggcaagactggaacattttttaatcaagtaaaaagacaaggtttaagcattgatggcatttaatgagaagattgttttcctatttcattttgaaattagccctgttattttgcaccagatgtgtcaaattagaatggaaaggcaaaaattgattattttcctcaggcacaaggggcaatgacactcacataaacatatatgtgtactcaaaacaacatgcaagcgcatgcatgcacacacaccctgttttgagaacaaacacaaatatgtgcaaggcgatatttctcccagcctgactcatacataaaggtctcataaagatctatggttttcaaaaagcatgtaaacccattacactgtttcaatttacgtaaatcacccgtaaatgttatctatgccaaccacacctatcttaaacacggaatgaggcagaatcagttactaaatattcactgaattctatcctaaacgtgttatgtgatatggtttggctatgtccccacccatatctcatcttacattaccacatgtagtgggagggacccggtgggaggtaaatgaatcatgggggcaggtgtttcccatgctgttctggcgatagtgagtaagtctcacaagatctgatggtattatatgggggagtttccctgcataagctctctctttgcctgccaccatccatgtaagatgtcacttgctcctccttgccttctgccatgattgtgaggcttccccagccatatggaactgtaagtccattaaacctgtttttcttcccggtcttgagtatgtctttatcagtagcatgaaaacagactaatacataatgagacaaatatttctgtcaacctcttcctcagggtggatggttaaagccttgagaccactccaagtaccaggcactgggtttccctgaatcttccttcatggtttcaggaaaatcagaaaccattttttttttttatcagtactgcatctttctgcatcctgcttctggcttccagcttcttgcttcctgcagctttctgcctaccagaatcctagtgtagaccactctagacttggatatccaaccacctgatttatcatctaatactgacatataccagcatcagcaggaggaaaagcaggtaaacaccaccaagcatccagctcaagcttaccctttcgcacgtacatctccctcttctccacagtattgtccatggtcaaagcccctcccagattctttcctgggggcttctctcaagttggagccaacagagcacaccagactttaggggaacacattagttgaagagctgccctgtatcttccagagatggatgatattgtttgtatttccctaattttctctaattttatccaaccaatacttaggttgggtaacatgcctgaagccacacaagttgaaggctgaataatagatttgcatctaccaccatgccaccctgaatgcacctgatctagtctgatctcaaaagaatagttttgagaagagacttttcgaaaactctcccatttctgtgggggtttcttttccttatgagtctgctcatgataaacatacacaatggaatattatttagccataaaaaaagaaagcctgtcattcgtggcaacatggatagaactggagaacatgatgttaagggaaatgagtcaggaaaagaaagttaaacaccgcatgttttcactcataggcagaagccaagaaaggttggtctcatagaagtaaaaagtagttcaggatactagaggctggaaaggggagggggaagtggcagggatagaaagagatgtgttaaaggatacaaaattataactagatcgaagaaataaattctagcattctatagcattataggatgaatatagttaacaataatatacattatagtttccaatagccagaaggagtatattgaatgttcccaaaacaaagaaatgataaatgttccagatgatggatatgctaattaccccaatctgatcactctatattatacgtattgaaacatcaccatgtaccctatgaatatgaacaattattttgtcaatttaaaaatgaaataaatttatttcatgtaaaaatttagctaaaaaaggaaacacgcatacacataagttaaggcttttttgaatctcagctaattcagcaaggaaaaaatgagtgataaatacttgattttgtaaaaacgtttctgttttcaaggaaaatagtatgtttcaggttgtctgctgtttttaaagtcagtgatgcctagaactaaatgatagtatgttttgatttctgcctgctctgtgttttacagcagactcactctataatttttattacattttcattatttacatccttattccaaaatcatatttgaagtcgttccctcaaaactgacacctgttatgaagcaacagggtctttacataaattaataaatgagaatgtcacaatggaggttcagatagaaccctgattcatgaatttgctcactgttttttcttgtggcagaaaactaattatatttttgatcttggagttcacacatgcatgtgttaaacagatagctggctttaatgagcccaagattaagtgtttatgtttgaaccctatataaatgagcaaacctttatataagtcaaagttcagggtcatattaatatattgcacttgaagataatttcatttcataaattgggtaaaaagtctatcaccattaccagacaaagcaaagtaaacagatcccagcacactccttcttgaatgcccataataccctcaggtttccctccaagtaaaatgcaaatagctcactatagcctgttaggtgcacctttccattgcagactttccctgtctctccagtctcatctcgcacctctcccactcctctcattgtgcttctgcctcaacacagctttctctggtcatctttttggtaaagccacctccactaaacctccatctcagcctcctatgtgttgctttataacactcactgccatctctaactatgtaaatctttttctgttgttgtttgcatgctttcctcctatccatctcccactactataatttaggtttcatgagtggaaagacagtatttatgttgtccaccattttatccctgtgattagtacacagtatggcctacagaggtaccaattaaaatttattgacatctcttatggccatcaacagatatttattgggtcttaacttttttaagacattatgcaatattaaaaagaaaatacagttcctgcctttcaaggaatttacaatctagatggaaatatgagatatacaagcatgtgctacatagctaatatcagcaacaataatatcagcagctaatatttatcaaatccttattatacatcagtttctattctaagaactgcacatgttttcatgcctactgctctcatctatgatatgaatacaattaccatcccactttacaaatgaggaaagtgaagctcacagagcaataacatagctggcctgaggccacataactaggttgcagggcagcaaagaaagtcagacagatcatggtaagtgttaaaaaaggattacattgaaacatactaaggagcttagggttgaggagcatctctgcttggggttgtctgtgaaatgtgggtagagaatatgagatttgggctgggatgtgaagggtgtgcaaatggaaggtattctagttgggaaaaagagcatctttgaaagattggaagaaggacatcagaagacctattttaggtacaatgaataaacccaattgacttaaatgatggatccatgacccactcattaattcgttgctgacacacagtcctgattatggaggactctgaatatcagactaagaaatttaggtccaatcaacataaagcaaaaattttcaaccattgggtattgttcaggtgtaaggtggtttgggtagctgttacaaatgtaccattctctttcatcctccaattccttctcagaacattctctagttaggtcttcttcccagccatttctgtcaccatttgcagatgcttctctataagccaaattagatttcctagtttctaatggatgatcctttggcaagctataattttccatcttcctaattctgcccttcaaataaacacgtatttaagtatttgtataaatcaggctaatgctaaattatctagaacagcactgtccagtagaaataaatgtgaaccacaaatgagaactacatattagtagttttaaattttcaaaaaggcacactaagaaaaaaaaggaaaataattttaattatacattttatttaaccattatatccaaatagaatatttgcaaaatgtagtcaacataaaaattattgatacatgcatcaggaagaatagctaatggatactgggcttaataccagggtaataggctgatctgtgcagcaaaccaccatggcatatgtttacctatgtaacaaacctgcacatcctgcacatgtaccccaggacttataataaaagttgaaggaaaaaaaaactaaaaataaattattgatacaatattttacattctttgtatgtgtatgagctaagtctgtgaaacttggtgtgtattttatacttacagcatatgtcattcggactcaccacgtcacaaatactcactagccacatgtggctggctggtggctaatggattggacagtgtctggatttagattgatgagaatgtgttgtaggaattgtctattacttttagtctttaagctttgttcttaaggagttcttgcctgcagagtttgatgcaatcagtaatgatatgacctgagcctttcttgattccacagattagtttgttgttcttcttcttcttatgaatgcatgccaaccaaagagtttcagatttttaacagtaagacccactaaatctaatgtgaaggagagatgctttgaaaatatctcttatatcttcacatattgatggggagctcccagattctgtcactcagagagctgtgcatccctcctcatcacatgttagaggctgctctctctgtagtggaaaatctgtgggcagtccacgtgaggatacttatccaaaagtcctactttaaatgaaagatgtcttagacacaaaaacgaaatgcatacagatagatacaaattcagtatatgctaaggcaatggctctcaaagagtgttccctggaacagcagcagcggtgtcatctgggaacttgttagacatgcaaattctcagtccctaccccagaccttcaggatctgaagctctggggttggggccccacagtctgtatgctagcaagcccttccagggatcctactcctaatgtacactaacatttaagagtggctgtagtaacaaaataataagttggagacagagtataggagagcggtgaatgttttatgtttgaaaaagaaaaaaatactattcttactcttcaaaaaagatttaccgtagaatctgctgatgtggccagccttcagagtgcaattaaaattcactttcacatgcaaaaatatgaatgaatttcacaaacgtaatgttgtgcaaaagcaagaagacacagaaaaggacaggttatgtgtcattcaatttacgtcaagtccccaaacaggcacaacttatagatgctgttgagagttagagtggtgatgattagagtgagggtagtggctggaaaggaggataatgggtagaaaggaggaaaatggtagacatgttctactgcttgagctggtcctggttatgcaggagtattcattttgtgataattcatcaagctgcacacttaagaattttgtactttaggtatgtttatattcaacatacagttaagaatttgaattttttacaaaaattatgaatgcaacttttgggaaattttttagtaatgtgaaaaacatgcactttaatttggcagtctcacagttgtttctcctaaataacaaatagaggtttacctttaaagtgacccacttcatacgtctctaggttggagcataaacatacataaccttgatgctctctcatgacctctgtttaattaagatccttccctccctcttggtccctgctcaatgccatcctctcctgttctcagctgactttggactaatctttagcaactagttattaagtcattactccaaatgtcacaagtgggatccttccaaggagctctgcattttaaaaagtctcaaaaggcattctgcccaaagaaggaagtctcctctgggaagtgtgaggggtcagggcgggtacttaggaacagatggccttatctggcccccttatatctcccaacacggtggccatcagcttcacctaccaacgaggctggcctgatctgattgcatgagttttcctctccagtgatgtagggagcagtggggtggtgtgggtgtgccaagaggcaggggatgtgctgctggcctaaagagatgtggtgttccacacagaaggactaacccaaagtttttgctggttctatttgcaatggtgctttatcagataaggaccacaaaataagaggttatcacaaatatgtttgaggattattcagtccttagattatagactcttagggaaagctacttcttattcttttcatcaatatgagaacatcagagacttacagttaatgaaatactctcattactttttggaaaatttatcaatatatttctctattatacacagaactgatattccgccagtacactctaatcctgctgcaagcatttttaaaatactgaaacatttacatagtgtccggcaaacaaagattaatgcctctcctttcaagtgacccttcccaccacctccctgccatcctaggacaccagcagggctccacggccttgccccacagctgtggacatgtgcattctgattagccaacaccctaccagttattaagtgttttgaatatctctttggattccctcatgactactttatccgtgctatacaaacactgacaatgtggtgtattttaaggatcaaatgaaaatgtgatgccagagaactgaaatggagaaagagaaccttggacttgggtaaaatcccatttccaaatctattctgaggccttcttctgatgtgcagcaggtatactaatttgaatggctgacattcaaagggaaataaaccatccaagtatccatgtgcacaaatgcatatgtcagtgctgtggacttcgtgtttgtcccctccacccccaacaaattcatatgttgaagccctaacctccaacgtgatggtatttggggataggacctttggggaagtaattgaggctagatgaggttatgagggttggtccccacgatagaattagtgtccttataaaaagcaggcacacacactgaggaaaggctatgcaggaacgtgaccagaaggcggccatctgcaagctggcaagagagccttcgctggaaaatgaactggccagcaccttgatcttagatttccaacctccagaactgtgaggaataaatgttggttaagccacccagtctatggtattttgttgtgtcaggccaagctgacaatatagtcattgcgttaggaaaatctattataataatttctagaactcatagttaagcctactctaataaaataatagcagattaaaacaaaatccttctataattgaaaataacacttttaatttaatcttaagtattcttcttaaggttcttgtaagttttttacagcattttgttttaacacgtttttctcagtttatgaggcaaaacattgttcacattatacaaatacctctgtacaccctatttcctgtaataccagatgtcccctgatttttttctaccatcagggtgatatttgaaaatgaaatttactgaacctgttttactttgtatgaccaggctgtttcgtctttaattttctgtaagttaattggcataatgcctttcagcccatgtataagtttcgtgagtactgtacagtttgaaatgactaaaaaggtgagtggtttttacaaatggatctagaataatgccaaacttcttaaagtaatatttgttttttgtttgtttgtttgtttttgagacagactcgcactgtgtcaacccaggctggagtgcagtggcacgatattggctcaccgcaacctccgcctcctgggttcaagcgattctcctgtctcagcctcccaagtagctgggactacaggcacccttcaccacacctggctaacgtttttttatatttttagtagaagcggggtttcactatgttgaccagtctggtcttgaactcctgacctcgtgatctgccctcctcagcctcccaaagtgctgggattacaagcatgagccaccatgcccggcccaaacttcttaaagtactatttgtaaaaaaaaacactttagaaatgtttaaagtacatatacacattaaagttaaataatgaacttgcaagaaccacaaagtgagttagactatttcaggttatacaaaagtgatacacactgaggttgcttggttggcaggaaagtcagagaatgaggaaaccatttcagcagccccatgaactggatcacccaggaggcaacagccattccatcagttcctctagagactcaacaactgttctagtagccatccactcaaagagctgatcaattcctttcacagttaagtgaatattaattctctcctggtatgtggagctctcatgtcaggccaccttagtgtctgttggtcaagcaagaggtgtctgcttagggcctattactcaccagtcatctgtgacccagctactagggtcatacagtgcaaaacacggtaaccctttttcccaacttgccctaattaggtggcagaaactttccctaacactccataattaaagacagcatggtgtgagagagcagcaggctagaagtcaggagaataggatgagcattctcatatttgctactaagtggtaggagccagatgaaggactatcttggttttctaagtttcggatccacaaaagcaaatcggggacaagattgtgggtgcaaaaggtgaacccactttttatttgggaggtgttctcaggaagcacaggtgaggtgtgaggaagtgggacagggaagggaggacagcccctaggggatattaatgatcaagttactgctgagggaaactgagactccgttcccctaagagatgtatagagtgcattcagaaacatctccctgaagggtgaggaagctggggtatttatctcccaaatccttgggggtccagagctgggcattaattcctggttacttctggcccatccaggacaagagtgccctctgtactggcaccatcggctccaacctcagggatagtccacagggaggtgggtggggcacgttggctacaaggcttagcttgcatgggctgtttttgttctcactactctagctctagaaagatctagcctctctagatgtcagaggtggagatagttgggaaggagtaacagaaggagaagagtgaatccagcctttgaacctttactacaacaatttataattttttagaaagtccccaaattggatttaattagaatgtccagaaatagaaacgattgtaaaatagcatgcggtagagccacacgatgagccactctgcagccacccatattttaaaattatattcaatggcatggagaaaattgaagaaagaaaaaaacagaaaaagtaagcacatgggggaatgggggcccatgatttcgcctcagttctttctcactcaggtgagtttgtggatccttctaggtgtcaggaataaattgatgttcgggagaagtcatacaggtctttgaagctcaacatagtatctcccacaaaggacccaaatgcttgtctcactctccaaacaggtgcctttacatttggaaaaaaaacccaagttctgagccaacaaggtaggttatatcttagtccttgaaattcttggatctcagcagcaacactcagccacactttccaagtgtctggctaaaagcaatctgagcccagcagttgctgcatttatgaatctggagagaaattctgtctcctgcctcaacttctccgtaaaataaaataactcagaagcagtgacccgatgccaggctgtcggttcagagctaaggccacaaaagcctttatcatttttcctaagaaggttctttcagtaatacagtcaccatgacctttcattatcagatcaaattaagccaagctgtaaataaaacacttgtactctcccagatttatagatgaacattttaacagaattccaagccctttacattcagaaccatagatacttctcacacccatggcctggtaagattttattttttaatgttatcaagagagcctgtggtgtgaggcttagtaagagagagggaggcaagatgagaaagaaatcagaaggatggaggtcaaggatactgaaataaccaagtcacagacaactgaaaataagagcagatttgcctttgtttacattgccaaatgggaaaaattaacttgattgaaagggtaattaagcatttctttttccatcatggtccaaaccagcttcatattccagctgttccgttttacattatgatgattctttgttgagtcgctgacttaaagacagccagtgtggcactggtgcacaccttactgcttctcccactatcaacctttattttgtaagtacacagttaaaatctcagtgagaacggtccaactcaggtaggcggatgatgaaggaagagtgggaacatttacaaagaagtgttgctggaacaaagagataatttgagcaaatcagattagctttgtaaggtatcttagagagattatccagctcaacagctgtagttcctaggtgcagaaactgagattatgtaaagtgcctgaatttccctagagttatgaagcttgtagctctaaattctgaatcacaaccctatgactgcatctctcatttgctagtattttcaataacaacttgcagaagaatatcaccttcaatgtaagaatgagctatttcacaccagtttattgtttgaaatttgtgttttctaatagaaatcaaattaattgtgcattatggtagttttcccagccatgtctcaaagactgttagcacacagggtgatgatccctaatttgaaaatccaaaatctgaagcccttctgggcccaagcatttcagataaggaacatcaacctgtccctgaattccatatctctgggaatgattggccatcttttaatggaggttaatgagaccgtaatgaagacaaatgaccaactatagctcatttgggtctcctgatgccctgagcaatgtcctgtctgtgggccctgttacctttcaggtaaatatagttcagccttatttatccagcttcactgggaccaagcacagttcagatcatcagcatcagaatagtctgggaatgtgttgcaggatacttttttcctatataaaagagtagccgctgcaaagtttcagtaagaacattatctgctggagagactctagtttatttagataagcacctggttcagatggaggaaaaattactttgtcctaattgctccacataataagccagagattctatagagcaggccaggataaatgttttgcatagtataatcaaatcagttaacgagaatcaaagaaaatccaggtgatggtgtttctgtgcaatttttgcatcaagctctggtactcatgtgtagacatttacgcattacagagaaagactattttatgtgtaggtttttgtgtatagcagtttttttttggttcagacccattagaagttctacgccaaaatgacctgctgtcatcactctgaataatagtcaggggcttcctctcttactcggtgcgttttttagaccacctagcttgaatagttatcttcaaagacagtgaatcatgcagttagttttatactttatattcacctctaattttggtgcaacatggttttttgccagttggattgtccctctcatttatttaacacatctctatatttgctggctatttcctcaaatcaaatctaccttaagaattcaagatttgccatcactgattaattcatggagcaggaatcaagctcagtagctaattcctcaaaactggtctggaaaatcttttgtaaaatggcaatgtcatctttcaccacagcttaaatccatacatgtaatattctgtgtagatacgtgtaattgactgcattaaaagtgacctactttttggaatttctgttttatgaagtttttcattttattttaatctattttaaatattcctttaaaccttttcaactttctgagtgagggctttttcttttttaatttatgaaagtgtttcttttttattcttgttaatcttaaaagcacatctatctacagccctttggcttgaatatttgatttaatatttgcatttgaaaaaattctttaaatatgacattgaccttaaagattttgaaagtcagaagctacatataaatttaattccagttctctgttattaaaataacattgactgaatctcagaattaggtgataactgttttacatgtttttgaacattaccaaatgataatttttagaattaagtaaaatgcaaatccaaggtgctgcaagagttgtatatgcaactacatttttcagggtagtttatagaacttacatggaaataataagttattttagtgaccatatacactggtgtcttcgtccaggctcctacaacaaaataccattaactgggtggcttataagcaaaagcaatttatttctcacagttctgggggctgggaaatcaaagatcaaggcaccagcagattcggtatctggtgagaactcactttctggttccttctaactgtgtcctcatttggtggaaagggtaaggggactctctgggacctttttaaatctttttataagggtactaatctcattcatgaagcctccacctttatgatccgatcaccttcctaaggccccaccccctagtgccatcaccttagcagttagactttcagcttaggaattttagggggacacaaatattcagaccatgaatatatgcattttctttctccatcattatgagtaaggatttcacgtacatattcaatgcagctttcatcaccccctaagcagaaaagctgcactgccacttcaaacctacaactaaatataatgtaatgagatccatgattgaaaacatacagaatcaaatctaggcctgctaaaggttatgagactagaaattcagagagccctattaataaagtaactttcgtggaaaccatcttccataggtacctgcttatttgtgaatattgtcatgaggttatatagtacttttccttctactttattgatgtgtgtggaggtagaaccatttctggagcaaagtttcacatacgtgacagtgaacttgtgggtttggtggtgggtcgtgctgatatgacatccttgtcatcacataaagacatgtatatttgtgtgcacacatcgaatatactgcaatggcatgtttctaagatgcacattctttcatatattttatttctaaagtcaggacatgtcttagaattgataatgtgttatagtgcatctggcagcattttcttctaatactacataaaataatagtgcaaagaacaactgatggtatcttggacgcaatgaaatgcattatgtagaaacatatcagaaggtgcattaataatgttaaagcaactccccaagaatattgaaattacaaagataacttatttgctaaagacacagattttggtgataaaacagatacagtctggtgagtaatttttcaaatgcttttcgcccatcttatgtgactcattagatcataaacttgtaaactcgatgtaaatcaccattgaggagacgtttcttatgtaatatttgggcagaatcataatgtttatgtaacattatgattaacaacagtgaattattattcagtgtaaatgaataaattttaactaaacataaaatcttggataattctataacattaatgttgagagaaattaatgtggtacaagactaaatatcaaataatataatttttaataaataactaaatctaaaacactttcaaatttaaaatttagcctgatctatatacctttttaaatcattgtatatttttagtgttaatgtgagaaaaatattcaaaatttttttttcaattgacatcttagctccaaaattaaaagagcatattttaatgggagctggtttaaaacaatttgacataagttagataacagtttggcaaatgtgtctgtgctcagttttgcttccaaatttggacttttagacttattgtcagcctcagaaagaaataagaagctgtgcagataattaaacatttgccttgggggaattatttgtagttaattaaaaccacacacttcgggtatatattgatacttgcttcactggttattaaatttgaatcatatgttaactacccaggtttctcacttgtccatcaaatgttgcttgtggcaggttcaagaaacaaactttctcataatattccaagccatattgtttaaagctatctcctaattttgagaggaaatgaatggagagaaacagagggagaaatgaaaaggaaacaaacaaagaatagtttattttagactccatctgattcagctctgttggggagttaaaactcaaccaagtgacacaaattcagtagagaacacatttgtaagtaatcaaggtgttgctgtaccacccccagctttctccatggtcacacgcttacaagattagcttatgacttttagatatctttggattgctttcctttcagcagcatgaaaaatatctactagactataagctccatgagggcagagatttggtgttttgtttcctgttggctccccaacatcaagtacagtgtctgggcaggtgtgatggctcacacctataatcccagcactttgggggtatgaggcaggaggatcctttgaggccaggagttcaagaccagtttgggcataattacaaaatcctgcctatacaaaaaattagaaaactaagtgggcatggtggcctgtgcctatggtcctagctactacagaggccagaacaggaggatcgcttgagcccaggagtttgaggttgcagcgagctacggttgcagcactgcatccagcctgggtaacagagcgagaatctgtctaaaaaagtgtctggcatatacttggccattattaaatgtttggaaaatgaatgagacctacttgctgtcttcctgttgatccattcacaggatcattccagtactttttaaagagcctccagggaggcctaaacatttagcaaggagccctttgtagttttgcaatagcccatagtcacagaatccttttagccatgttaaacatggatatgtttaaccatatcctataacaaaaaaagataagtgtacaacgattccatgtttaaatgtgctaagcgagggagggaatgaccttgcagagaccagaaggtctgcattccctctatgctattgttctactgttatggttcccgaggaagatgaacttaattaccactggatttcaaggttctgtatctgactttttcaaggactcaagactcccatatgtgagcaaccacagtaatggaagcattaagaacattaaaattagatagtcctttaatcttcttcattttgccttccttttatgtcctttcccatagttctaagactttccctgatgcaaaaagcctgcttttattttcttatttgttgcaaaaagacatcccagctagctacatctctacctttgtaagctttgagcagatatctcacatagtatggggggaaaaaaagcgcctatttattggcaaacatatgtatttgagtggttatttttaaaacgaataaattctatttttcctcaaacataaatctatcatgttagtgctgaaagctgctctgtttccaagttaaaaatgctgaccaaaggttttgcttgtttgttgttagattttgcaaaggatgaaaatattacaaaaggcggtgaagtgacagatcattctgtgcgtgaccaagatcatcccgatggtaggttgtgaaatcctttattagattttcttttcttctgctgggaaacagaaaaaaaaaaaaaaaaaaaacccacagacttgaatttttctggaaaaatattgaattccaataacactttattagcactgaataccagttgatcagtagctgccatctttagatgacacttttgctttccagaatcctcatcactcattacttttgtgccaggctggcttcatttattttgtttattgttacttgtctgaattctataagcactgggtttgcaaacactgagatgaatgtgttataacaatgagaataaatattttcattgaaaaacatggagaataaatgcaggggattaaatccacatagtcttgggatatcaagaagggagtacataacaaacagaaatgaaacaatctttagaaaaataacagaaaataatttcctaatgtaaaccagttcttccacccaaaacatgacagtacacattatatttataggcaaaggaaaaactcagaacagacatctgcatagcttcatggaatttctgaagataaatgataaagaaaggcttttcaagtgtagtcaaaatcaggtagtgattaaaaccaccagagtcagattagccttaaccttcttcttccacaaccctaaaagctagaagaaaatggagtcacagtttccagagctcaaaagggcacagtttccatagttaatgaagttattatttatacatgaaatcagagcaatattttctcaggaatacaaagattaagaaaacatgccacccaggtaccctttctgaataaactaacagaaggcctgagcaaaaacaataatatagaaaggaaggcaaaactcaagactgaggaaggcacattcgaaagggactatatggtaagagactaattaaatgtacaaaaatgttgaaataattgttctatcaaataattttgaaataacccttcataattaggatgaaaatgtcttacctaaatatatgtctttaactttgaaatttatagtatgtgttgtttgaaaatgagaaaaaagacagactagctttcaataatgaaagtctaaataatttagatcatttctactaccgaagacaactagacaaaaaatacatatatttatatattataaacatataatattatatattatgcgtatatatatatatatatatatatatatatatatatatatatacacacatatacatatggagagagagagagagactgtttaaaggcatcagtgagctaataagatactgaagaactgtaaagctgagctctgggaggcaatgaatctccagatatgtgagcccagaatttgaagctctttttaccttagggcatttgctgattctacagaaggtgtctggagctccattgctgaaaaaggcaatgaccccgataaactctctgttttggggttgaaaccccaaagatacgtaacctagcaggaagaatgaacgagcagtagattggcggtggactgcttcccagcttcaaatcatctcaatcctcacattaggttaagaccagtccagattgctagtcccctcaggcatctaagaaaagcaaatgtaaaatatttactaggagtgaaaaagagtgttacaggcttcaaatcatttatataaataatttgcaaaatataatgtccagcacacacataaaaaataccccaaaaaatgagggaaaaaaggtaacatgaaaaacaaaacaataaggcaagagaagttcatatgagctgaaaatattagttatgaacacaaagtattagataaatatgttgagtatgtataaggagataaagataagattggaaattttagccgagaactagaagttcaaaaccaattttacaatgaaagagtctagaagtaaatgatgctataactgaaattaagaattcaatgaatgaatttatgactgaacatcatattagacacagccgaaagaagatttgtgaactagaagttaggtcagaatatatccaaaattacagatagtaggggaagaaaggaaggcacacactgaagaaagaggaaaagatattaaggatcttatgataaagtctatcacaagtacagttggagtcccagaaaggaaggagagagacaattgggcagaagcaatagttgaagaaatgtggtgagaaatttcccacactgatgaaggacatcatgttccaaaagccctttgaactctaagcagaataaatataaataaataaataaatccacaaccaggcccatcatagtaaataaataaataatagaaataaatataaatattataaataatataaataaatccacaacatgacccatcatagtaaaattcctgaaaaccaaagataaacaaaacatctaaaaagctatcttcaagcacttggactgagagctgacttttcaatatgtataatgaaaataagaagataatacaacaaaatagctgtgaaccaagaattctaaacccagggggaaaagtatgtttcaagaattcaaggttaattaaggacattttagaccaaaaagaaaggcacagttcatcaccagagaattctggtgttctgcaagtagaaagctattaatcccagatagaaggccaaagataaaggaaggaattaagggcaaggtaaatggtagttactggataagtctagataaatattgatggtataaatcaatactgacaatgatgtcttgtggagttaagatatgcataacattaaaatataccacaataatggcatttattggaatgaggtaaattaattttaagtgttctaatgtttttccattaagatgaagagtaaaagtaccaattagtgttgaaactttgtaagtctcagtggcccctgagagtcaggaaatgaggtgagccctgtgattgcccagctggctgcctggagagtttccaggctgtggtacagagaggaggaacccagggagagcccagcaaactctccacgttgaggagacagaggtgagagtcctgggaggccaaggtagctaacgtttgcaaggtagcattctacagagaagagagctccacaaacggaatgctcagaggtctacagaaggaactcctcagtcttcaactgggtaggaacactagaaaagatctgagagagtgataactggagcttacatagggctagaagaagtgcctgttcccaccagcaagactggaaagcctcaacattcataaagaactctgaaggtttttgccttagtagcagagcaaaacaggcaatagactaaatgctcctcatgtcctccccagtagagcttaaaagtgagacttgaaaggatcagaatatttctgagtaacttaactgcattttagaatgaagctcaaaaatatttataaaaattataaatatatctcatacccaacaaagtaaaatcaacaaaattaccaggcatgcaaagaattattgcaagacaactctccatgcatctttcatatttctgcatgttttgtgagcagaggcactgcttgtatctttgaaaaggatcatgtttctcttcaaattaaagagcatacatacttattgtgcattttaaaaggttcagagaatcttgagattctctgatatggtttggctgtgtccccacccaaatctcatcttgaattgtagctcccataatccccacgtgttgtgggagggaccctgtaggaggtaattgaatcacaggggtgggcgttcccatgctgttctcatgatagtgaagaagtctcatgagatctgatcgttttataaaggggagtttccctgcacacactctcttgcctgccaccatgtaagacatgcggttgcacctcccttgccttctgctgtgattatgaggcctccctagccatgtggaactgtgagtccattaaacctctttttctttataaattacctagtcttgggtatttcttcatagcagcatgaaaatagactaatacattctctaagttcaagattcctcctctatgatatcacccactgagtgtgcaggaatcagctggtccacctatggcaccatgtgggaatcaggactcagagaacagacactaatactctggttactgtgatttctctgaataataaactgtcctttatctttgacccagaagtctttgtcttctgtcagcatccatggaactgtggctcaagcagggtaaaatctcagagtcttcatagttcttgacaggaagcaggaaagtatgatgcacaggaaaagaaaagttgataaatggaactcaacccataaatgatgcagatgatagaattaatatgaaagggcatgttaaaagttgttataactctgttccacatatttacaaaattaaaattaggactgaccatgttaattcgagacaaagaagttatagaaagacccaaattgaatttcaaggaattcaaaacacagtgcctgaattaaaaattatacttgatgagaacagtggcagattagatactatagaagaaaagattaatgaacttgaagatgaagcaatagaagctatccaaatgaaaacagaataagtgactgaggggaaaaaaaaagagcatccatgagctatgagacatcttgaagggtggttctaattacaatataaatgaatgtgaatctctgagggtgaatgtgggagaaagggacagaaaaaatatttgaagtaaaagtgattaaaatgtttcaatgtgatgaaattatcaacccacatatgcaagaagttctatgaccccaaagcataagaaacataatgaaaattacacctaagtacatcataatcaatttattcaacaccagcaataaagagaaaaatcacaaaaacaagcagaggaaaatgacaagttacatatagaagacaaagataaagataaatcaggccaggcacagtggcttacgccagtaatcccagcactttggaaggctgagttgggcagatcacttgaggtcaggagttcgagaccagcctggccaacatggtgaaaccccatctctactaaaaatacaaaaattagcaaggcacggtggtgggcacctgtaatcccagctacttgggaggctgagtcaggagaatcacttgaatccaggaggcagaggttgcaatgagcctcctgagctgagacagcaccattgcactccagcctgagtgacagagcaagactctgtcaaaaaagaaaaaaaaaagataaataaaaggtcccaatggaaactagaaactacaatgacatgcaaaaacatgatgaatctcacaaatgtaatattagagaaggtatgaaagcatatattatttattatataatctcatatatcaagttcaaaaagcaggaaaaaaattaacatttagaaaggcttgtttaggtgataaaatgataaagaagacctaggtactgatcactgtgacagtcagggttttgattaaactttggtgattggagaggagatactgccgggagggggccatgagagggctgcctggctggatggttatcataaaaatatatagtttctgtatttgcatttggttatttaattgatatctctatattttgtctgtgtttctatatatttgtcgcaattttataaaattgtctaaaagaggaagaaagaaaaagaggaaatgaggaagggaatgaagaaaggaggaaagaaaagaagcatcagtggcagaggttgtaaaactagattatagctagaagaaggaagagttgcacattagcctgactccataaataccactcaaaaactaaaaatcccagtgttatggattctgacaatatgttacctttcagaatatctctgaaaaattgtacaataatcacaaatagaattaaataataataaaattaaaagaagataccttactttctaaatttcccaaagagatcacatgacagtatactcagcaatgcaaataataacaataactagcagtgtaacaaaagcctcatgtatcaaataagatgacagaaacacaagcaaatgcttataacagtaagtgtaattaggttactttaataagtgtaaaagccactcagattgacttaaactcaataaaaaggtaaagctttaaaagtataaagttagaaaaatgtatatttgagaaaggagcatcaaaagaaaacatgaagaactacttctatttgaaccaatctattcggttagaagtctagcaaaaaaatctccagtgacaaagagttggttatttgatattgataacaatttaaattcctgatgaaatataatagtgatggggctttttgtgtcagatgatatggcaagatacaatacaaataaaaacctgttgaaaatgcaatgaggagttcccagatacaatattattagtcaatgacagaacaaatagactacggatgacatggactgtttgaaaaatgtacttagcagggtagtccttgctataggaatagacaggctgatcaatgaaacagatgaaagagttcagaaacagacccaagtagatctgggatttcagtacatattctggccgacatttcaaagacagatgactcaatcaatggcattaaaacaactagttggccatttgggaaaataaactgaatcccaacctcattcctttcaccaacataaattccagaaggagcagagatgaaacatagaaatgaaactataaaaatactagagtaaaagaaccaaaggttattattcagcactaaaaagaaatgagctatcaaaccatgaaaagacatgtaggaaacttaaatgcatattactaagtgcaaaaagccaatgtgaaaaggctacatattgtatgaatccaattatatgacattctggaaaggcaaaaccatggacacaatgaaaagatcagtggtggccaggagttgtgggggtggggagggatgaataggaggagtacagaggatctttagggcattgaaaatactctgtataatgcagtaatggtagatacatttcattatacattgccaaaacccatagaatgtacagttccaagagtgaaccttaatggaagttatagacttcagtaggagttacatgggatatctctgtaccatcctctcaattttgctgtaaacctaaaaccactctacaaaaatagtatttttaaaaaacaacaaaataaaacaattacaggctgtttttttaactgtgagcacatacttgcagacacaggatggtatgcatatgttatgaaatgcaggcatacacatatctgtaatgtgtgtgcatatgtcagtatattgcataaaagaggaaaataacaaaattgtaatagataaatgttgacataatgagtaaaggttatagtgaaattaaaaatgaaaactagtgggaaaatattctcacccaaatgacaacaaaagagctaatttttttatttgaaaaaaaagtgtgtgtgaaccagtaagaaaaaacataaacaatctaagagcaaaacggacaaaagactccattataattcacaaaagaagatatacagtcattataaatatgaagagatgccctatctctttattatataaataaatgcaaataaaatagtatcttctctttttgaactagataagattaagtggagttgaaagtacacaaaattagtggaaatagggtttccaaacacgctcgcataatattcgtgggagactgaaaggcataacctcctcatcagcaattttgggaaaacctaataaaaggtagaatgttcatactttgatggaaaaattatgcctcagagatttatcctaaactaacacccacccagagtatggagatatttatttactgaaatgttcattgcaatatgatgtttaatggcaaaaaaaaagtgtaaacacctgaaagctcacccataacgtggaatattatgtatcttttaaaaacaagatttccaaattaattgtaatgacagaggatgatgcttactaaaatatgaaataaaaaagcaggactcaaagtgtaaatatgttttgatcccaggatatatttacatatttttgcatatgtctgcatctgtgtgtgtatacacacatacaagagaaatatgacaactcacaatattaaaactggctatcccttagttataaaattatccacaattctcaatgcttatatgcatttttagcgtatccataaggaaattgcatttcttttgtaactacaaggcaaaaaataatttttaaaaataacttacaataggaaagtaagttttattggctctaagagaaaaccaaggatgtctagaagataatcaaattcacactaatctaggcttaacttttgttcttaatctgggatatttttagaaatttttataaaagtacagttttgaatattagcagcaatcaactttcaagtttaacaaaaagacacaatttacatgatttcttcaacacaagcatcaaagaaacagtctttgttcttaagaaaacttgagcatctaataatctgcaagcaataaaattatattgttgttgctattgttcagaaacagtccatttacaaagtgagttcaggtttatcccctagaaatgcttcattctagactgatgtccccagaccaatttttatgcaaattaattaaagctaaagcattagcttgagccaaacttaattaccaaggctccaagaaacaatcatgtgatctatttctaaagaaaagcgaatggatttttggattatctgttctaatggtcccctcccataagtatggctgattgagttcactgtatgaaaaatatatacataaactgtggaattctttgtgttcttttgtttcctcagccaggagggattagggcagaggacagtggggagaattcaactagtccgaatgtgaagagggaaacataaagcttgcccccatggggccaagaaagcaggatggaatgtgaaaggtctgcatgcactgaggagaaaggcagatgggctggaagccctgggaggagtcattaacacacagcaggcctgggtgcggtgcaaggcagtcaggcataccttgtctttgtgcaatacgccaaagcctgcctcgttttcaaagctggacaccttgttttgtttcttcccccatttttaattaactttatttaagaaaaatgagaaaaaaaattctatttcaagaaaagattgtcaaaatatgtaaagcacacaggtgaaacagatcaagagtagagacaggtttagagggcaaggaagagaaatattccaagagatatttgaaatagcactttatcctcaaagtgaagggtcaagccttacaagtcacagaaactccctggtgttcatcaacagactcaggttgccacctcaagcaggcccaccttttcagcagtgccccaggctctattaaatggggacctgctcattcttgattgaattcctctgaaaatttatcaagtggagcactgggaccaggggacacacaggaatacagattttggccttttcccctctctggatgctctactctttcccttcatgatatagacgaagccagatcacaaatagtacgttaaaggtccttgcaatgacctggtgcgatgattaggttcaatggccagttccctatagcaacagtgatagagaatgaagctcactcagtaaacaaacagtgaaggttccctctcagtatcatccacccaataaacaaacgtcaatgtgactggaaacttcatctgaagacatagctatgaacctaggagattatctcgttccacagccttttttcttttcaatagatgatgaaattaaaggtcaaagaggttgtgatttgcctaaaacatccagttatctttattcccattccagggttctctgcaacaaatataatgtgtggagtgcttagtagcatacaagactttaccttgttgttaaaggatgcaagagaaagtaagttatagtccttaataactatttacagaccttgatgagtactctaatacaggtccaattaaatagacattgattgatgacttcttattaaatgggtgctgggcaggaaaatatgaataaaacaaaatttctctcttaatctggtaagagagacaaagacagacacaactacatcacggtgtgatcaggatctggatggtaattaggaaaattcatgtgtatatatctaaagagtcataaagatatacacttaaggtttgtacattttactatatgcaagtagatctcaattttaaaagctaaaaagcaaaataaagacatttccaggcaaaacaaaaagaaaagagggattgtagtcaggtagagctggttatgattcttgaaagcagaactgagatcacagcacttactttccagaggtaatgtgatgattagagattacgtgtgaagtatctagggacagtctggcatttttatgggatcaataatttgcagattcacttacatcttctaggccagtgcttctcaaggtttaacttgcatgcaaatcacatggacatcttgttatacaatgcaggctctgattctgtaggtctgtgatgaggcctgaaattctgcatttttgaaaagctcccaggtaattccagtgttgcttgtccatggaccatacttttgttagggacaagctgccccaggaccacccccctccccaaaaacaatgcagctgacccttactccgaatattctgcagctgcattcctggacccttatctaggcactacagcaaggtcgccagacttgcttacagccctccgggtggcatgggggaggtcatgagaaacgtggataaacctaagttacaccctcttgtaaattcctatattgtaagctggtcacgagatgatatgtggtaaagttaaccgacaaagaaccccagggtctctctccaccatataaacccctcattttgtaagttcagggctgcctccgctgactgtggtggagcagcccagcaggctaataaacttactcgcctgaccttgggtctctctctctctctctctctctctctctctctcgttctttctctcagctaaccttacaactttgagtggcaatggggaagaatgaggatgaatgggttttttcaaaagtggaaaggtcttgatcaagttcaaattttaaaaggcctttctgctatcaaatcacaaaatagaatataggagaagaaaatgaaagatccaagagacagatgatatatccctaaatgaggaaagaaggcaggagactagaaagtgggaaaaccgaaatattttgcagaaccataaagatggcatttcattaaacgtcaggagtgatggaagaaaataatcaaaaacagcttgaggtttttatattcaatgatcaaatagataaacatgctttagttttaattattttattggatccttttgattaaaattgagctcaggaggagtggatatcacacaaaaaacataatttttcccttatccaggtcatgctagcagagaatgaatcaaggggaagtagtatcatgggcagtttaaaaataattgtatcagagaggaaactgtaagatgaggggttatataagtcagctttgctgcagtaacaaataaccccaacagtttcactgggggctcaacaacaaaggctggttgtgtctctacttagcccgggttggctgtgttccacatgctttccattcaggatctagacgaaggaacatggtttattaggagcaaaagagctgcaggcaacatacaatggatcttaaggcttctgcttggttgcagtacacatgatgtctgttccagtgccatttctaaacaagtcacatgaacaggcctgtgtcaatgtggtgggaacatacacttgtcccacaagggctgctgcgtgtcacattgtcacagacagggaaatataatcctcttttaggacgaagtagagacaagttgaaaccataatgccaccacagggatggactcaggcaaagagtccaagctcctctgaatctgctttgcacctataaccaaccctagctctagaatgttttttaaaaaattccatagttaagtatcctcagcacaaaatctttcattagcccgaggcaaaatggccagatttcaatttcctctcttaatgagcacttaaatgttttaaatgctacaggggagggtaggaggagaagccaaggggtgtggaagaaaaaccattactagataatcaacctaaaagtaatcaagagttggctgaattctctcctgacctttgctgtatttagtatgtgtcctaagagaatggttgagctgtagcaggacgagccgcagacaaaacttctcagacaccaagttgtagaaggaagggctttattcagctgggagcatcgacaagctactgccttaaaatccgagctccccgaatgcacaatttctgtcccttttaagggctcacaacactaaagatttcacatgaaagggtcgtgattgatttgagcaagcagggggtacgtggcaggggctgcatgcaccggtggtcagagtgaaacagaacagggcagagagtttcacaatagtcttctatacaatgtctggaatctatgaataacatcggtttctaagttatgagttgatttttaactactgggtttaggccaggcaggcccaggcctggtttcgggcctggtgcagggctgcctgtctttgattttacttccttgtttttttcttaaaacaggtactgagtataaaacaatataaagcgatatgggagggtctctctcttccctcatttcccccttttgagactctcactttttcttagtgggagttctcactcttatttttgctacttattttttttgttcaatagattgatagtgattcatatagtacacttgtgctgaagcattttggtgaactaaggtagcgatgaagattttttatcatttaaagaagcacaggtagcaaacaagggagcagtaagcaggtttttattactattataactcctattataagagttttaagtcctcttagtgctgggaaccaccttctaaacatggctttagggttgaatctgtgctacacttgtacaggcacatgtgtcagttttgtcatatttttaactatgtctttaactacttgcctttgattatctatgtgtagacagtaattagtaaggttaaatttcttatagacttctcttttagctgctagcaagtacttgagagctaatccattttgatagatagcatttcttatctgagttttttgccgggccagaatagtaaaggcttgaccggttttattagtgatgatttctaaaacagcttgcaaccgtatgactctgttgagcaggtaaatgggggtccagtattcctatgagccatcttgtgtctaagtggcaggcctatagtattgtataattttgtttttagtgggccatttatcatctttttaattacttatggctatgcttcgttttccgcaggaagcatagacagggaatgcctaggagttcgcctgtttttatgggcagtaaaaagaaagatggtttaatggtgccaataacacaactacctgtccactggtcaggcagcttagcgtaggctctatgtctacatatccagtataacctggtagggtcaggctagtcctggtggaattctgggtgggcctagacagtctgcaaccttggaaatttactgaatagatctctttctgtgtaattggaactccaccatgtaactgttttttgcggtatcgttatacagtttttgctttagacaactaagtcatcttacagaatgagtgaattcttttcctgtttttgttgttgttgttgttgttgtttagctatgcaataattgagacttttagaacttagaaatgatcagggtgattcttttgggctgagaatccatcaggaactgggtctgtaggcactaattctcgggcttcttatggccattgatctcttattacagtttttctacaaacataacatgaagtgatatttagagactgggttacatgcccagctaattgcaaaaaacaaatttttagtctttcctggaatcttaggtactggcacatttagttcatcctagaaagtctgaaatactggttctggagagcgtctttgaacctcctttcttattaggctgtttatgctagggtctagtctttttctatcaatgcctaatgatacatattgtttttttaattttattttgggtctgaggggtttgtgatgactaattctaaagggttacagttctcactcgtgcaggaggggctgacttttcttttttgaagcctaacaggatctttttaatcttctgttcaagtagcctaaatgacacaagaccagtattgacacattttacataaatatgattcttgacagacatactttttttttttgctgtgtaattttttttccctcatcagagaaccgcatcttattctatgctgcttactatcaatagcagcacaagcgtcaaattttaaggttacatttttggggacctctctttcttctgttctagctattactttacttgtgtcacctagaaaaggactagtccttaatcttactttaaagactgtgatcatggggggttcagaggggtcatagcacacatcgggcaggtcacttcctggattacatactttgtgctgagtgttattgtacaaacaagttctttttggagttcctaggcatttataataactataaaataataggactgtagcaatcttttgtctcacttcagtgatttgatgtatatactgggaacagttctcagtctgaggaaggtcagttgaagtctttactgtacaagtctaaattttaaggaaaatgagtcctgcaatgagtttcttcatgcttcggccatgtgtggaccagtcagcttctgagtgtgactggagcggggcttgtcgtctttttcagagtcactttgcaggggtgggtgaagctgctcctatccacgtacagctcctagtctactgatgtttaagggtggtcttggaggttgggcctactagagtaaactgagtctaacacctctacacagtttatgttaaactgggctctctgataccaggagtaaggtggcggggttagggtgttgcaaacttcaatggttatgtagggatttttacagagcaagatttggtatctagttagtctagcattcattagctaatggtgtcctttggtatttattaaaatcaccacagcatggcaggactttatgtttaggttttgcctaagagttagcttatctgcttcttgtgctaacagggccgttgctaccagggcgcttggacgtgggggccatttggaaacctcgtctagttgttttgagagataggccactggccttggccagggccttacagtctgggttaaaacttcaactgccattttttctctttctgacatatagagtgtaaagagttttgtcaggtcaggtagcctcagggctggggccaacatgagtttttctttttaactcatgaaaagctcgttgctgttggttgtaatagatgtagtttatctaatctacatttttattgactgtcatctactaaaatattgacttaaatcctgtaactatttgatttcaagctttaaattgatctggtattccttgtggggctccaattgcatctaaatagatgtgagagttgaaagacctataaggggcttctctggctttacgatgtcttattttttgtttttcctctggttgatgaaatgccagggtgaaagggatagccaaatggactaaagcacaagtgccactctagttattcagcagagtgcccagtaaaggtccaccacaataccaccacacatctgcttggggatgaacaacggctgactgattgataagctcttgaaaattcttaagcttactgcatcccttcaggtctccaaggaatgctaagtctcctccttgctgtgagagacacaaagtgaacttagtgttgggagacagaagctggatggacctcaggtgctgatctgcagggactttgggatatagcagagagagcttggcatgatttattactccaggctgtagaatctcagaaaagagctaccacgcagcctacgcctggtcgactggaggaccaccttagtggaagggggacaattagggcctctggcctgccatgtgcacaatcataacaattgcttttgtttaatgtgcagatggaatatttgatccatttcaaccaggcatttgcattcttggtatgctgtcttaattgccaaagtttgttttaagtctttaacttctatgatcctttagtaaaatgaatgtttcctttaacacctatttttattagtttttagactaaagaaagctaaatactattttatatttaataatgtttcttgtatgatttttatagtagataagttaaattttacttttatattagtgtgttattaatgttaaacttaattttaataaaaccttgtagacatatttatctaattttttatgtttgaccataaggtaagattttatagactttttttaactttttataatttttgttaaagagcaggttgatgctttaagaaaaacctgttgcatttttactttaatgtccagttcacagaaaaactgggtgatatctttttaactttagctaatatgtttacacacagaattttctttacaattaacgttttaaaacttgcttaaatttttaaaacaataatttttttaacttttaatgtaggtaaaaatccacatttttatgtccctttataatttttttactaaaggtatattttacttttcttatacaccttgcacataaactgtttctttaatggtactcaggaggccttattacttttaaattatacaacattttttgcataaatttttttataacattttttctttcacgacttttgcagacaatttttcaacatgtcttaactttttgacttattacatttttttctttaaacaactagttaatttatttcaggacaagaatttactatataacactctttttacataaattttgcctcccccccccgcccttctcttttttaaagcgaactttctttatgtctttggactagactgtctaaggccacaagattagaagttactataatacatgttacactgttaacttttagcaaacttcacttttgttgaaaaccttgtaagtttgggatttcaattatcctttgctattaataagatcttgtttagtctgaattaacttagaattggtatagatggcctctttttctctctgctggtctttccttgcctctgccagccacttatgctgctgttctcttaactgctgttggggggaagggggtctaaaactagctgtaactgtctatgtacggaaactggcctgggtgccttggcttacaggttaccttgtgccatacttttgaaacaagggacctgtccaggcttccttctgatggccaacctacctctaatgctggccagtctatttcacacaaagttctaagttttcctggtgtcacagtaacaccgtaatctcctttaaattctttcttgaaattttttaacatagttcctagtagggtgggcttacttacaccggacctgtttttgtttttgttttttctcctgagacaaaataccatgctcacaccacacacactcaccacaagacaaagaacgggtatggagggcacacacacacttttaccatttatagtaagccaaaatcacgaaattcaaaatccgagttccaaaagattcaagacaagtcaaaaccaaaaccaaagtatctagcaattcaagtcaagtcaaaaccagaacaaaagtgccaatgcaggcacactgtgggtgatcaggccactcttccactcagatggagtggggcaagttccaaagactagtcttaccaagtttcagatgtccggactccaagtgccagttccttcccagtgttcagccactgtgttaatcctccacgggggcctgctatgcgctgctctggcaaggcgttccactggggcaatttcctacccgggagtgctctttggatcctgtcactcaggctggccggagtcccccgcaggatgctccacagggcaggcctaagccgcctaaggggctgcctcggctgtccatcagttacctcgtttccccgtcagggaaccaagaaacgtagcaggattagccgcagacaaaacttctcagacaccgagttgtagaaggaagggctttattcagctgggagcatcggcaagctactgccttaaaatccgagctccccaaatgcacaatttctgtcccttttaagggctcacagcactaaagatttcacatgaaagggtcgtgattgatttgagcaagcagggggtacgtgacaggggctgcatgcgccggtggtcagagtgaaacagaacagggcagagagtttcacaatagtcttctatacaatgtctggaatctatgaataacatcggtttctaagttatgagttgatttttaactactgggtttaggccaggcaggcccaggcctggtttcggggctggtgccgggctgcctgtctttggttttacttccttgtttttctctcaaaacaggtaccgagtataaaacaatataaagcgatacgggagggtctctctcttccctcagagctgttatccccccagttcccttgtgcccacattactcaagttttttatgctctgttgatggaaaaatgaaagtgcaagtagtgttttcattttctaggaatcctcactatgggaaatatttgtatcttaaaaggaaattaaatgtagttaacccatacagcccagaaattattgtaaaatttgaaaatttccaggttgtgtcctctatccatatcctgtgcattcataagctaagtaagtatgccaattttgcatcagtttccaaaaaaaagatttttttcctaaattatcaggatatttctcagaaaataattgatataaatctgatgattagaaaaattgtatctttgccctttggtttcaaaactgttctctatctctccatgcatgattaaagcacggtttctgaaggtcaggaataaagctacggtcatgcatatcacatttcttttatttttcaatcactgttttgaacaggacaagagaatgattcaacgaagaatgaaataaaaattgaaacagaatcgcagagctcatatatggaaacagaaggtactgaaaccaaaatatattgttatcagagaatgagatgaaactgtgaatcatgacttctatatatacctgtgtgtgtgcgtggtgtgtgtgtgtgttttaggcaatgattactggaggatagcaatagtgttcaacttggtgtacctattgaaacttgaagggggaaaaaagaactctaactttctataccatagtcacagtattctctcaatgattccaactaaaacaaccctgagtgtccatctgtctcattctatttagaactttcatcaaaccaagaagatgccgtgattgtggagcaaccagaagtgattccattaacagaggaccaagaagaaaaagaaggtgaaaaaggtaggactgctcttaaattaacccatcaagaatggagagtttctttggattcctgcctagaattcaaccatcaaagttattctcatgcaattacagtttgtaaagggggaaaacgaacatttccttaaccccaaatctccgtttgaaagtagagtaaaatctagaagtagcaaaagaaaatactcggaagacttatagcaattacatatagcataaagatgtttttgttattcatttagattcaatttaaatttttaaaattacagtattgagaaagcctataagaaatcaaaactatggactagagggataaagttcatacaaaatctgaaatggctttagagcaaatagactggcctttttgtattgatttcatctgtcttccttagtatagtagtgatgaaagaaacaatttatgtaaaatatgcatgttatatgaacctaaattgcaatcttgcttgctaatattaggatgcaatcatattgaatactgttttaaaaaaagtgagcattataatgatttctgaaaactcaagaggaatgaacactccttaaatattaaagcagcatttggggcaaaaagccaatgtattggagtgaagatagaaatatttttaaaaatgtgtttaaaaaaactattctggttaatttagtgttaactgaagaacttaaagaattcaatttttaaatataaagcaatctcttaaaagaagctaataaaataatttttgttacagtatatcataaatcatactgctcttaaataaatatgtatttgcaaagcagttgcagagtaataacttgacaggccttgtttatagaacacagtgatcaattttgtttccaaattaaaactcagacatgatctcaattgtaaaatcaggtcaatagcaactacagcttccaaattatgaactcttcttggcaggggcattgacagtttaattgctaaaccatgttagagattttgacacttttaaaatgttgactgcatttacagtacaatattcttccatgtctatgcctctaataagcttttcgctattgcaaatcctagttcagactcacgactccactttcctgttaagtcaaataaagggtatattcaaagttatttcatgtctaatattgataactgagaattgaaacaacccttactcagaatcagatatatggtattgctctcctcaattgtagtttaaaaatgtgaaatagacaatgctgtgcgtgttagcttaatttctctgtagcagaaattgttggctctgtttattgcatttcaagaaatgcaaatggtaaagaggaaaatcaaacagctgtacgttttcctcttttgacttgacctataagaaaaaagctggcattcggcacattgacatgtttcccttctcccagagccttcccaagcattgaacactactctgatgactgaagaattaaatatccacctttcctctcttccttgtaaatatgccaatctttttctgataatggtggaatagcatgtgggaaaaaagcaaggtgaaattctgctacttgcttttagcaacgatgaggttgaatttctttattaaaatttgacttttcactgtaagatgactaatgctggtagtcttgaattaaccacattttctcttcccatctttatcatagatatttcacttggtcctgccttgaatatttctggtgtttaaatttgaaataattttaagtgcatcacatttgtcatcttatactttgcatccaagtgaaaagtactcataggaaaaggaggcaatgtagattcatggtgctctgcagtagctctgctccaccattgacaagctgggtgactttggacaagttacttaacctatctgcttcaggttcttcatctgtaagatgatgatggcaaaagtacctgtcacatatagttatggtgcaaatttaataagtaaaacgtgcaaagcaattaaaacaatgcatgacacatagaatgcactccataagtatttagtatttatcataatttgatacattgatgacaaagtcaagaaaatccacatgtgatttccccaagtccatttatcattcttcttcactattttgaatctgtagaaagtcacatattttacattatccttcaacaacaacaactggttctatccatttggttggcagcaccatctcaggccagcagttttgatatggtctaaactctttacattgctgcgtattttattctaaagagataaaacaactaatagaaggaagccaggtggaaggcatttctctccattcataaacacttccttgtttgtcagtatctcaatcttccatttgagaaataaacacaaccataacttctatttttttaaaaaagaaaccattgagctgttgatagatccacaaaagaaaactagtaaataaattcaaagtagcaattttttttactttctttttatttagttattaaaaagtcttgtttgaaaacatttcgaggctatagctccagattttgtattcacaaaatagtgtcttaatggaaagttgtacatatgtattaggaattatctgtaaacaaaacaaatgagtattttattacatttgtaaagatattctttatagctttagaagtattccttctcttttattttaagactccttttaaggaggcagaaagtgattcctttaaaaaaaaaaaaatccagaccaggaaaaatatataacctttttctctcttttttgtagcattttataagattagaaaatgtagataatcttcaggatacatcttctatggctcccaggtatatgggcacagatgttgcaacattaagttttgaagttagttctattaaaatatggattttgaaaagaaggaaaaatattcagcagaagttcatgctgataaaattacacaatagcacagtggacatgtccctgggagacctgaaatacaaaaatttcaacaggcagaaagtgaggtttcacatatggcagcttttctgatatagccacgttgcctcttcctaaatgagcccagttttatgatttcccagcaggacctgcaacacatatgaaatccagtcgaataacgtcatttaggttaataaccaaataggaaagtaatattatagaagatctcctctgaaaaggatctcatgttttagtataaaatataaagtcagcattaaaacatctttcttacatttgttatttgggcaaatttagaaatatttgacataaaatcttaactatatcaacatcgagttattatttcacaaaattttcatatatgttttattatgatatatattggatatttttttctctaagtgttaaacagaatgaatacatttggtcccaataatttttcatatcaattaataagtgtagtgtggaatagtaatcctttgtctgtttacctaagattgagcaaaatgttgacagagacttaaagtatactatggtttaatgttttcttagaaaaagatgcatatgggcaggcatgcaagtaaagagttaagtgcaagccagtgacaagtgtaaagtatcatgcccttaggttcatgttttgaaccaagcatggtctgaccagcatgaccttgagacatagtgtacagacagccatggcttctagccctgcctgtgtgattcctggcaatccttaaacttcgaagaatcccagtctctagggtaataatgaggggcatgaactcaaaattgcaattataaggttctccagttttataaattttcttagaaggccaactctgaagaaccacattcttggtgaaacaagagcgatggcatgggagccaatggtcagccatgctgaaagctgaaatcataggttttcctcagttttagttattgtaccctattgataaaaatatagaggtgccctaggccaggcaaaaaaaaatcagccaaatatattaggacttaccaatgattggacagctaattattccctaaagatactttaaagggggaggggaatgccttttagctcaaggtgggtttacacagaaactctgctcagaaccaagctggatttccatcaccatctttcttagtccatgtgggaaacatctttttttgcaactcctctggctacgatttcatcttttagtgaacacatagcaagtgagggactttctcttctgcttctaccaatcaaatccattagaggtttatctcatctacaaagcacccctgtatagcccttggtgttttccatttctcataggattcttacatcactggcagagccctttcttctctccttgaaaagcagagcttgcactagcagtgttgccatacacagaatacctgtgtattacacaatagcacagtggacatgtccctgggaatagaatacctaacacttgggccatcatatacagactgtgttcttggctataaagaatcattgctcaggcatatttttgattcatgcaaaatactatatacacttgcatgttgagtaacaaacttactggaacattctaccttcagaaagtctttgtatctcttttcaaatgaagtcaagtttagtaatactatattattcatattagcagcacaatcatttagttttctagggcagttttaccatttgttttcttcttttttaataatattttgaatctgaaattcaacaaccaaaattatgttttaggatatcagttaaattaaaaatgctggtctctgtttgggttttatgaatattttagtatctaatgaaattcctcatattggttaagtaccttgaacataaaaattataaagttttaagctaaattgtttaggttttctacatgtctctatgtatgcaatgtaaacatatagaaccagttcattcaaattatgctgcataactgacctataattttaaagttaaaaaacatagaagaataaaaggtatattcactgcactttgtcttgcactttgatttcttgctacaataatgatgttggtgtggatagcatatatgcatgtgtatatgcgtaaagttagattatacgtgtataaagttcacatgtatctacccagtaagaaagttatgcaggcctcttgagtttgttcaaatcctctagcttgctgcaatcatcttgtctttaaagatttagaaaaaaattgccctgaaactccatttttcatgttaggagaaatctatcattccttccaatatctctgagaattctttggtgtcaggtttatttcttctaatctcaggctccaagctcctgcctctggttctcacttcagcctttgccattccttttttcgtaagctgtctctagttctcactatggctcccactcagacaccaccaccacctctcatcccttcactccgtgcagtaccacaaactcaaggatgtgtgtaggtttaagtgaatgttagggtcaatacttgtaattaacttgtgcttgcccatctggggaattttaagagaccatctcttctaagtctccagcatccggctacatcctgtatcgccctttgtcttctttgatttcttgcacttcctaacactccagtttcatttacagtttaactttgtatcatgcctgtgtccttctggtcttgccctgaggtgtatgattctacaaccatgtggcttatcaaaccacgtggtttatcaaaataatttgcagaaacaaaagatgactcacataagtggaattctgtctttaaatattgagctttttactcctctctgccgaattagagttctacaactcaactctctgtgcataaagtacctgaatttttttcacaactaataaaaagattaatgtgtaccttcatctaaacataatattgttttacatatatgatcctgaaatacttcagaaaattaaccttctctaaagatagtgagtataattattaacatttgttccttatatttaacttccttccaaagacattatataatgctaaattgaaattttcagaaagataaaattatggctgtcatacaactataaaatcaatacaagtaaaatattttatttaaatgattaactagtaagggaatcattaagatgttaaaactggttcaaaggagaatttgaagagtgtgtgtgtgtgtgtgtgtgtgtgtgtgtgtgtgtataaaatccatctatcatctatacagtgacattttagtcaacaacagatcgtatatgtcccggtggtcccataagattatgatgctacatttttactgtaccttttctatgtttagttatgttttgacatacaaatacttaccattgtattataattatctacagtcttcagcacagtaacatgctgtatgggtttataacctaagagcaatagactacaccatataaccttggtatgtagtaggctataccatcgaggtttgtgtaagtacactctatgatgtttgcatcatgaaatcacctagcaacatatttctcagaatgtatcttcaccttaagcaatacatcactgtatattgattaggaattatggctatatggatatacacatggatccataatacacacacattcagaaacactgaatatatccatacaatcacacacaattcaggagcactgaaaatttccaaactggctaatatcatacaggacaatacaacatatcctttccttctatcagacaaaattcgttttcactgatatgaacaaatctcattttcattactacaagttttctacatgttaccttctacctgtacagatgtgtaaaatagtctagtgaatagaaagctggtcaaaggaatacaccctcatagaaccagataatcccacagagggattatctggagggtgacacccaaccttccaccccagtgacacccagggatctcttttatccattgtcaagtcttagacaatttttcttgacagtatactgaaggcaaaactgccctttttttaacctgtttaccacctcacttatttgttattgttcactatttgatacatttgatagacagtgataaaatactagggtagtatcagagtagggcagtagcttccaacttcatctgaggttgtagtttacttgctattgttttatggcaagtactgctattctacattttatatagttgtacacacactgtagatgaagttgtacttctaagatgcctcagttgtgagatgtgccattattttacatattattaataaattttctaaaatctggcttattaaagtaagacacaataattttgtatcatttaggatttttattttatgtgtttaaaaaaactcttcgaacaagatgtagaacgttttcatatatcactcttgagaatacataaaaagaaaatgttaggctaaaggaattagttatgatactgctaaaacttcatcaggttcagggtcctacttctaaatcactttcagtcaaagtcatcaatatctgtttttattacacaatattgtcctctgccaatgtctttgatggttcagaacttaagagaattcataaagaatttaaaactcattggcttgtaagtctcttaagacttaagtctgtcttgctatcatatagagagttagcctattttttcttttttgcttctacttagaggcagttaaaacactcctgactcaccacctccctccatatttattatttttcagagattttcacctaagtcattgaaactcattctgcaagtttgagtacttttggttttgatgctaatgcatatatgggtatgataaattgtatcatcgtgtcctgaccaacaaaaattttgtaacaattcactgtttcaaagatgttaagatgtgaaagcagtgtactttatattaggaaatatagtattatttatttcacagtgaaaactactacactgagactagaaaatggaaacttgattacaagtgatataattgagtatatttgatatactcaattgatatataattgagttattttttttctactaactctaatgactagcagtgggatccttactagcacatcagtgcaccctactgcacattgtataactaagaaagtcataaatggttttattcatacattccacaaatgcttttaatgcacatgtaatatgtgccagaaattatatagacactatcactgaaactgaggaaaacagacaaagccactgctgggctcatcccaagcatagagctcaggatgtaagtctttttttttttttaactttttattttattattattattttttttggagatggagtctcgctctgtcacccaggctggagtgcagtggcgcgatctgggctcactgcaagctccgcctcccaggttcacgccattctcctgcctcagcctcctgagtagctgggactacaggcgcccgccaccgtgcccggctaatttttttgtatttttagtagagacagggtttcaccgtgttagccaggatggtctcgatctcctgacctcatgatctgcctgcctcggcctcccaaagtgctgggattacaggcatgagccactatgcccggccttttttttttttttttttttaactttttaagattcctcatataaatgagatcacacagtgtttgtctgtgtcttatttcactcagcataatgccctcaagtttcatccatgttgtcacaaatggcaggatttccttctttttatggctgagtaatattccattatacatatatattccattgtatacatattatgtatacaaatgtgaggtgtgtgtgtgtgtgtgtgtatgtgtgtgtcacatttttctctatttatgcatctatgggcacttaggttgtttctgtgtcctggatattatgaataatgctgcaatgaacacgagagtgcagacatcaagctactgatttctcttccttcagatatgtaaccagaagtgggatggctggatcatttggtaattctatttttaattttttgtggaatctcatactattttccataatgctgtactaatttacatttccattaacagtgtaaaaggttcccttttttccacaccctcaccaacacttgttagttctttcttgcctttttaatgaaactctccctaacaagtgtaaggtcatatctcattgtgattttgatttccaattccctgatgattagtaatgttcagcaccttatctcatatctattgcccatttataagtcttctttggaaaaatgtctactgaggtctcggtatcaacataatgctggccccataaaatgaatttggaagtcttcccttctcttcagtttttttgaaagagtttgagtaagattgtcattaattcttctttaaatgtttggtataattcaccagtgaattaacctggtcctgggcttttctttgttgagaggtttttgattactgactcaaactcttcattgatttttggtttaatcagattttcttttttaaatcaggtaatctgttttattataattcttatatgtttaggatactaaccccttatcatataaatggtttacaaatattttctcccattttatatgttgccttttcaccttgttgattatttccttttctgtttagaagctttttagtttaatgaatatctgtttatttatttttgcttttttcacttgtgcttttgatgtcatgtccaaaaaatcattaccaagaccaacattgagaagttttttcctatgtcttttatgtgagttttatggtttcaggtcttacatttaagtttttaatctatttcaagttaatttctgtgagtggtataagacagaagtataattttattcttttctatgtgggtatccagttttcccagcatcagttatgaaagagactatcctttcactgttgtgtgttcttgacatccttgtcaagtattaattgactttatatgcatgggtttatttccgggattctcaattctgttctattggtctgtgtgtctgttgttgtgccagtaccatactgttttgattactatagctttgaaatgtagtttgaaatcagtaagtgtgatgtctctggcttttttcctctttctcaagattgctttgactatttgggatattttgtgtttccatatgagtgttaggattgttttctttttttatgtgaaaaatgcccttgaaattgtgatagggattacgttgaatgtatagatcgatttaggtatttgggcattttaacaacattaattcttttgattcataagtatggaatatctttacatttatttgtgtcttattcaattttcccatcaatattttacagttttcagtgtacagatttttcactgccttggttatatatattcctaagtattttattatttctgatgctactataaatggatagttttctttatttgattttcagatattcattgctagtgtatagaaatgcacctgatttttctgttgatttcgaattcggcaagtttaatgaatttattagttttaacagttttttgttggtgtctgtaaggtttttaataagactatgtcatctataaacagagaaaatcataattcttcctttctgatttgaatggcttttatttctttttcttgcttaattgctttgtttaggacttctagttctatgttgcatagaagtggtgagtaggggcatctttgtcttgttcttgaccttagaggaaaagccttcagctttttaccattgagtatgatgacagctgtgggcttgtcatatatggcctttattatgttggagtacattcctcttacactcaaattgttgagtgttttttttcctaatcatgaaagaatggttaattttgtcagatgctttttctgcatatattcagatgatcataagattttcatccttcattttgttaatgtggtatatcagatttattgatttccatatgttgaaccatccttgaattccaggtgtaaatccctccatccttctaaactgctgttgaatttgctagtaatttgttgaaatgttttctatctattttcatcaagggtattggcctttaatttttatttcttgtagtgtttctatctagctttggtatcaaggtaatgctggcctcataaaatgaatttggaaatgttcccttctcttcaatttgtttggaagagtttaggtaaaattggcattaattcttctttaaatgtttggtagaattcaccaatgaagtaatctggttgtgggcttttctttattgggaggttttcgattactattttgatctctttactcattactagtctattcagatattctgtttcttcgtgattcagccatgttagattgtatgcttctagcaatttattcatttcttttatgttatcccatttgttggcatataattgttcatagcagtctcttatgaacccttgtatttctttggcatcacttgtgacatcactgtttcatttatagttttatttatttgagttctctcttttttttttttttttttgagacggagtcttgctctgtcccccaggctggagtgcagtggtgtgatcttggctcactgcaagctccgcctcctgggttcatgccattctcctgcctcagcctcccaagtggctgggactacaggcacccgccaccaagcctggctaattttttgtatttttagtacagatagggtttcaccgtgttagccaggatggtctcaacctcctgatctcgtgatctgcccgtctcggcctcccaaagtgctgggattacaggcatgagccaccacacccagctgagtcctcttttttctttagtcagctaaaagtttgtaaattttgttaattttttttaaaaacctcatttttgttcatcctttttattgtttttctattctctatttcattagagatcagagatttcatgagagattagagatttcagtcctaaatttttaccatttttttcttctactaatttgggctttatttcttttttagttccttaaagtgtaaagttaggctatttgatatctttttttcttaatgtaggcattcataactataaactttctttttagaactgcttttgctgcatcttgtaagttttgttatatggtgtttccatttttgtttgtctcaagattctttcaattttgtgatttcttttttgacctattggttgttcaggactgtgttatttaatttccatatatttgtgaattttccaaaattcttcctgttattgttttttagttttatatgtttgtgatgagaaaaaatacttgacatgatttcaatgaacttaagatttgctttatggcctaacatatgatctatcctagggaatgttctgtgtgcgcttgaaaagaatatgtattttgcagttattgaatggaatgttaggtgtctgttaggttcattcactctataatgttgttcaaatctgttgtttctttattgattttctttctgggtgacctatctatcattgaagtggagtattaaagtcccctactattattgtattgctatttatttctcctctcaattctattagtatttgctttatatatttagatgctctgatgtttggtggataaatacatacaattgtacatcttcttgataaattgattcctttattattacaatgaccttttctagtctcttgtgactattttttagttaaggtctattttgtctagtgtaagtatagccaccttgctctcttctggcagcccaagctgtcaataaaagctagaatggtggtgcagaattattaaagtagaagtgatagggtgaaaacccagggttagaatgagagcatgcatagcctttctggccatgccacggagtgtggagactcactgccaactagaatgcagacaaatgatttgattcatcattgattcctttgttttccacgtcattttacagactaaagtcagtaagaacccaaaattattacagttatcgcactctgtcagcctttggtattgaattcatatgggattatatgaaataaataaagttttcttagaacatgcaaaaaatctagaacatttactacctggccctttatagaaaaatactgctgagccccagtctatttatataaagcccaatgttaccctgaatgtgaactccctcatttcatacaataactctcaaattatgaatctttgtcaacacacacagacatatacgcatccacttgagatgtttccatggaaacatggatttattctcacaatgccatgcccttctgtaagcatagtctttgctgtgtttgcatccctccccaacctgatagattggaagaaaatggtgccctctgatgtcagcctcccttaaaggggccccaaggtagcatgtcttgggcctcaagtatttcaggccataagtggaatggagtaatccctacaaccctgtactcagaagcctattaccttactttgacttggctttatctggtcagtctcattttgtttggctctttctctcttagaataatagtttaagtttcctttaagtacagttttctgccactgtacgtagagttcataaagtaaagaaggttctacctactttcccgcgaactgatctttgccttctcttagtatactacaagtcagacttgcattatgactgtgaactaaagatcctaatcataaacattcagacagaaagaccatttcagtgacagaacaagtgcaagtctaatctataatgtatgtggagtagatagtgattgtaataatatggatgtttatgtatacattttttgtaaaaaccaaaatattgtcaacccaaaatttaatttgtacatttatacagtggttggaatagaggctcaacatttacataaaaggctttattttagtaaacgaatggccacaaactattatgtgataggttttggatgacatacttactgcatttggatttagactcaaccacttcacatcaggtgcaagaacttccagatcctactgattgtgcaaaagatatatccattttgatttggatttcaaatgtaagtgctgcttttctctctgcttcagaaggaaactcaatttcttttcattgctctttatacatcaggtgccttcatttcagcacagtatgtaaaaagcaggtggtataaggagtactttgaatgttaattatttttttcatcgatttcaccatgaggatttacctttcaatgtgtttttataatcaagatggaaacaattagggaacttgctgtttgaatgtttcactacatttattttatgacatctgctgcaatgattaagaaaaaagagaaaaagggaggcaagcatttgaacaatagcaaggggtttggattgattgtatgtgattgctttatttcattgtgaaacttcaaaggaaatgttgtcgagatgaatcagtcacgtttctaaccaataatatcatcccattgtttgaatttacattttttacatagaagcacatgagttcatttttcagagatgttgtcatagtttattagccttcattttaaattgaacctaattttataaactgcagagaaatggggaaaaagggaaaaatagatatttcttctgaaagaaaaatttcaaaggagaattttttttccatttgtcatatttggtttgttcctcaaactttaaacataatttacttcatctgttcttttgtttcatatacttacaaacatagttcataaagtaaaaatattcaggattaagaggttcatttttcgtaacgtattaagatatggtcatataatttcaatgtaagggagtacttttcaaaattaatatagtcaatattttacactttgttacattactcttatttttccattaacaaaatattataggaaaccttatgcaatgagaaactaaaacttgcgtaacatctagtaattagataggataaatactagacaagataaatatagttatataatataatgtgtcttatatatatatatatacatgtgtgtatatacataaatatgtatatttcatatctccaaagtctacctgtttaagagatactcaataagtagatctcaaagttatctctgacaatacaggaacatatccagaagatatcttactattttatcacctatagtaaggaataaaaattttagtccagtcaccaaataaaatgtggggttgaagagaacattaagggttactgtttttaattgcctggagtagacagaacaatggtcccccaaaggtgtcctcatcctaatcccaggaacctttccatgtgttacattacacaggaaaagagacgatgctgatgtaattaagttggggggcttgaaaagagaagaatgtcctggagtgtccaggtgagcccagtgtaatcacaagtatatctataagcaaatagggaagcaggagagtcagtgagagggaaggagatgcgttggtagaggcagaggagagaccacaagagagcgattgagatttgaacatgctatgctgctggctttgaagatggaggaaggaggcgatgaaacaaggaatacaggtggcctctagaaaccgtagtaggtaatcaaacagatttttccccagagcctcaagaaggaacatagctcagctgacaccttgacgctagcctcataagacccatttcagacatctggcctccagaactgtaagaaaatcagtttgcattgtgtgaagccactaagtaatttactgcagcaagtagaaactagtacattacctctaccgctactctagtatttcgcatccaaatttagaacactccttttgaaaatcctagactttcccactgtcttcttttgggtggtgatgaggcaaagatgattgacagatgggtaggcaaacagagtaccctccttctgagtctcctcagttgcactttcaatgatgtttattaatttaaaaactatccagcatgaatatgtacaaggcactgggctcggggctggggcacaaacaaaaacaaaatagaaaacccacccacccacccacacacacacacacacacacacacacacacacacacacaaacaatctctaccctcaaggggaagctaagccctcagtagtgaaaacagattcatctggatggaagttcttaaaatgtgttccttggaccagtagcttcagcatcatctaggaacttgctaaaagtgcaaattcctgagctccccttcgagtatatttcttatacaataattgctgtggtttggtttctctattagaatattaggactttatgaaagtttgaaccctgtgtgtgtgtgtgtgtgtgcatctcttgtgttatatgtaggaattcacatttatatatcctagagacaagacagtgaaaacaatagaaagcaaataagcagagtttggaggctcatggtccagacttcctggcaacaggctgcgtaacactgcttagtctgccagtaaccctagctccagcaggtgtagcccaaagtgagggcagaggctttccaagttgaatgtgcatgaaatcacctgaagcctttgttaaagcatggctttcagtgccctatccctcaagtttctggtttagtagatctggagatggcaggagtcaaaatgttgctttttcttttagagacagagtctcactctgtcgcccaggctggagtgcagtggcgtgatctcagctcactgcaaactccacctcccaggttcaagcgattctcctgcctcagcctcctgagtagctgggattacaggcaagcaccaccacgcccggctaatttttgtatttttagcagagacagggtttcaccatgttggccaggctggtctcaaacacctgacctcctggtctgcccgcctcggcctccaaaagtgctgggattacgggcttgagccaccgtgcccggccaaaattttgcatttttaatgagttcccaggtgatggtggtactgctggtccagggaccacagcttgagaaccactggcaaagccctcattatccaaaccagctggctcacaactgccactgtgggagaagatgcttctttagcgtcactgtggacccccagtacctgcagctgagacacagggcattacctgtggtaaggatgaggacctcttcccgactccaacccacagtatgtcggagatcagccacttataagcctctcttcccgcatatgccctctttgtggtcattgcacaacacatttctcccacagtggcaggtgatatggacaagggaacacagagaccgcgtgcctaggttagaagagtacagaaccaaggactgtgtttgtttattggaaagcagccctgtggtacgcaaaatgcatcctgagcagcatatattggagttgtgtatacaaaatcatgtatgctactaaagggtccttgttatgccagggccacgactactccaaatgtcatgctcggggtcaggttccagccccagctgaggtctgatgggagtgggtggatgggcagatggcaggtgaaaggtagttttatttagcagctctcttatcagcagctctctcacactagctctcttatactctctgcctttatctcggctgtttgctccggctctgcggcccctgtcagcagccaactcccacacacagccgcaggaccagcctgcaaggccagctctcccttacagtgttagcagcttaactctttctctctctgggcacgagtgcgagccatggctcccttctctccgtcttgcagtactctctctctttctcttggccccagcacaagagcgcctgtctggcatcagcggggcagttatactttttacagacagtagtgactcagagccaagtgtgaacttaaacagattatataaaaagtggagtatacacctgcaccctaaactcactaagtcatgctggcctggatgtccgccttggcctattcttgagcaaagcacatccatacaccttacagtcattctttccttattttgatgaacaggatatatggggggaaaatgaagataaaaattccccatcattttcatagttctacttgtctttagacatagaaacaagaaggagtcatgtgaaagaagatggcattctctctacaagggttgaaaaaagagcaaaaataggatcgggggcataactcttgctcaacttgcggaagttccccacacaaagtaaaaataaaccctgctttagcagcccttatctgatttaagtcagtttgtcttccaagatctaacatttcctccgttgaatttgaggggcttattttaataagaaaagaaaaaaggagaagctgaacagggcctttagagcaacacacataagctgtttgccatattgaatcaacacctggggcattgatctgaaagctaaacgcaggctgttcacctggattgccaagtataacagaagcaactggctcactgacatcagagagagcgtacttcaccagggctccatctgcaattgcctttgaggaccagagataatcagaaaaaaagtacagaggttgttctgaaacctaattccaacttaggagcatttatttctcctttccgtaaactacctgtgatttctaatcaaaaatgcttttctaaacccagctgacctaattctccttttctccctcacagcgtgtctttttgttgttgtcgatctttggcttcgcttattcaccaagcacagttgttgttgcctagctctctaagcttgtgtgtcctgcctttcccaacattccaaggagtaatggtctcattaacccagtaattaaagaaatcctgtacctttccactctggctagctgccctcttccttttcccctattgttctctcagtaacaccaccagcagatggtttgagattttcaccctttcaaaagctttatgtttttcccatctcatcaagcatatctcagccaagtgtaattagcttaaggcttttgaatccttaagggagatcagttaaagacttgagcaatttcaatgaagagcttgaaaagccaatcctggaaggctaagggtaaccacaggagagccactattatttagaagcaaagaccctctcctccgcccatccctccttctttaggcactttaaattctcagaatattcatgaggcctccagggctttgggactctatttggaccattattgagtaggtgggatatttaagctcttactcatcatcgggtcagttggttccttttaattgatttcaatcaaggggccatttttggggagccttaagttactctcaaatggccaacagtttgtttgctaagtctcttagccttttcattcctttctttatcctttggttgttggaaactagctttctttgtagttcaagcagttcatatgaagtctaaattaattaactgcaacacagatttgcaccctacctttgagtgatggtgaacccccttgattcctgaatagccacatgtattgtggtagttgatcccacagcccaagccctttttccccatacttgggaaaaagcaagttgttttgagaccaaattaaactctatttttattgaaatggagtggagtagtgcttaagtgtgtgaagcacagattgttggtgggatgttaagagaggggcccaggctctccctcgaattgggtgatgtgtattttccccatgctttcaagtgggaggctcggaggctcaggtgttgggtaataggatgattaagtgtgttctcatgtctagtttctcattaccaagacttgggtaaaaggagaattacttttgtaaatctactaccatctttttcaaataaaaggaaccaatgccaaaacatttgattagaacgacctctttttgtctcaagtacactaatcagcttctgtttgaacagtgatgcataggtatggagatgtgcctgtattaaatattatacatctactgtaccattagaggacactacaatcacaacttagaggaaaattccttgtaaaacatgggatgtgtgttctgagccgtggtatgacatggaattggcttgcaaagcagactccaaatacttatgaattaatttattgctgtctgaaaaatatgacataatgtttgaagtacaaattggcttacaaaaagatataagcagggtgaacatttttggtaggtaagacagaaatgtagctgcattttataaatgtttgttttgcataggagagtgataaattacagtagagtttcactattattgctttgaatacggtaggcctaaagaaactagactatcccagccaacgtggcagttctgaaccacagaaaccagttgcattggtgcagagtaggtaagacttagaagaaagaaactgctgacaacaccttcactttataacaacatacagtgaggcagaggactattagcaaacctgataccacagtgtccagaaaatgtgcagaggtcatcttctataaggtttcttatacaacagtttcaccacggccatggtgctatgggcaggaaagcttttgtttattccatttttcaaataactgatgcttaaaaaatttttaggcacagtcaaaataatatttaaaaattttttcaaaacagcggtatctacttttcttcaaactgaaattacaggaattaagggtatgaggagtaaaatatacctgaccagggtcacacattcagtaggtggagcaaggccctgacatttattatctaacttgtgacccagcatcctttccaccctacccttttcccctctgagctgctctgaggggctgtggctaacagagtatgacactcgagagggtatgtacctaattgtaacttacccaactttatataagttgggtatagatatataaaatcacccaactttatataagtttcacagttggaacctggaggtcaccttgttcaacctcctgctgtgatgcagaaagccttgatgatttccttcccagctgatgctgtggcctctgtcaagggacatgcacgatggggagctcactatctttcgcaggagttcttttatcctcaaagattgagtgtttataaatgaactggattttcctgacgtttctgctgactcatcccagctttgctctgcagagggaactgaaatgaacctggcctgtatggcaagagtctcctaagtctttgaaggcaaagccttcctatagcgccccctatactgtcttctggttagtcgtttatctcgcctattccaaacgtctctcacgttacatggtttccaaacctttcatcatttgactatgtacttctaagcaagtcagatttgccaacttctctctcaaaccgtggatatagattgcacacagtgatccataccttcatttgtctgattcaaagctaaagatttatttttaatagaaattgcttcagcccctggcaactcagtacatgaacttctccctgggtgaggtgaagaagtatcctggcagtgaggctaacagccagcccaattctgaagccagactacctcagtttgcagacaggttgttctctaatgagccatgaacaggtcatttaacttggtttccgcatctgtaaatggggatcataatagcacctacctcagcaggttgtttatagggatgatatgatttaacatgtgtaaagttctggcagtagtgccaggcatatagtaaactctcaatcaatattaattattgtggttatcattgttctgagtaaaaggctatactccaaaccaagggaaaacctctcatttgtttgtgatgaacggtgagaaacctaagaactacaggaacactggatgaaacgttacctcctgccatataattactttgctaatctcctcccttagtctagcacaatgtggaaccatgagagacattcaagttactttcatcctctaagtgcgcccaagctagaagtccagtagttttcctgttgctgccaacatctttgatcaaaagagacctcattgaagagatgcagctgatcaagaaaaattccctccaggctttggtgtctggcagatgtgctgtgtcatgagagtgcatctgtcagagctggctctgtccccatgaagaattgacagggccatgcaaacaaccccgaaatctggcaaaaatgaacctgctaacttagggaagaaaacacgaatggaggtggatcgatgtgcacccactgcctttattcctagtcaggtaccaaagagtaaatgttgcagcatgtaccataggacagtgacagtcacagttgacatttgtatagaagcctgacaaaacagggacacaggagcatggaaacagctacccctacccctcagcttaaggatttaaagtttcgagatttatcattaattttatccccttactcatgttccctgtcttggggttttctttttactagaacttcttccagttgtttctgctgagatcaaagcataagaggggccaggcacggtggctcatgcctgtaatcccagcacttcgggaggccgaggcgggcagatcacctgaggtcaggagttcgagaccaacatggccaacatgttgaaaccctgtctctactaaaaatacaaaaattagccaagcatggtggcgggcacctgtaatcccagctactcgagaggctgaggcaggagaatcacttgaacctgggaggtggaggttgcagtaagctgagatcttgccactgcactccagcctgcgcgataagagcaagactctgtctcaaaaaaaaaaaattataaaagcataatatggagcaggagacagaaacaccgcctcctgccttgctctgtaacattctttctgccgcccatcctattgaaaaactcaacatccccaaaggagccacattctccgagagaagcagtggactaaggaaaaacagaaatttagattctggcaaatcagtaactagaagaaattgctgggagagacagtggtatgtctttataatccttgtaggtcattcctgatgtgctcaaccttagatgataatggcagaagtccaatttttctcttactgtacttgattttaaatgccagggtgagggtcttgcttcatataagcttcattataattaaagtcttaatcatttaaattattacgaaaatcacacttcagaaaaaaagaagagagaggagagggagagcatgtgagtgagtgggtcagttgggctagtggcgcatgtcctggtgcatgtgggttacctgtacagcactacacagcctaattgcaggagtgaccttcaaaggcccttggctgcagggctcccacaggaccagcatcttgtgacattttgctctgtgtacaaaatcccacaggcgctcatctcttatctctgcatatgccagtgatcacagccacagaaaccagaggacagagtataaaaggatagtactttgtctcctaccattttatcttattgtccctctagaatttatattttgtaccagacatattgtaacaataaagtcagttctaagaataggaaaaaaaataacactatgataccacaaccttattacatcaaactgctttgggctttatcctctttaaagtgtgctcaggtgttcagccacgaggtttctgacagccctcataagacctccaaggtgtggtgtgctgattctggcttccagtctttgggatccttcagagcttagagtctgtttgggagacagcatcccctccatcccttctggggaaagatttagaagcccctggcaatcactttgtaccaagcacatttcaagccctgtgaatctcgattatttaggatttggattctggcaaatcagtaactggagtaccctctcaacacagcacataatcatatatggtctattccaaaccaagacctttctccccaaacgtggtgttctccttttagaaaccaagccagtgcttttcacatggtgaaaatacatttcaaatgtgtgacaggctgtgaggaaaggctttcctgggcagactaaatgtataacacttgggacagagtatcttttcccaaatgggaaacaagatgatttgggtcaacctgtgctgagactgtgttggtgatgcagggatgttgggtgtcatagatggctttgtgagctgggaatctgaagaagcatgttctaatcgagtttctggcagtcctctccctgttgaacaatgaaattgtgagaccaaatgttgaccacgcggcacttctttgttaaagctgtcagcactcactgacgggataaaatggcaccagctgcacatggtcagagtctgtgaggccaaaacaaagccactgttctagaatgagccaattaaccacaccgtttggctgaaagtggcttctgcctgacatctctgaggtagatgcaaagtcccagttgtccagagttgaaccagtggtaaaaatgttaggccccagtggttctgagcggtgcaaattgttctaaggtgcagagtgtcagtccaagtcctgccaggagcagatgctaagatgggatttatttgggggaatgcaaggagtttattaaaggaaatgcctgtgtgagaggaaagaaagagggtgctggagttgactgggagagccatcagccccagctcaagcgcaagcccgagtaaaggagacagggaaggcagcttgtgaggtgtgcagtgtagggaagttttagcaaagcatccagatgcccttgaggcaaattaggccaagaacagccctgtcttagtatccctgctgtgatcagtccttgactgggagctgcctgtcaggggctccggccttggagcaaatgcagtgatggattccagagggtgattcgtcttgcacttttcagctccatgatcaaggctccacatctcaaaactccaggcggcacagtttattatcagtgatgcccccagtgatgtgccttgcatgggctgcacagctccacacgatggtcctgcttagggtcacttgctccccaccatggtgactgctcaggcagacccaccagtcagcaccatcagctactttccaggtcccccattcagggaatgtgggaacatgaagagattctcggagccaggcctaatgatgctgagacgccagcttctctgagcctattggcagctggggaggggtcactctcctagcacacatgttccaaatcccaaatgagaagtgggcacaaagccccttctcagtttttgacttcaccccaccttgccccacttatctacaaacctccttcctctgggtctttggccttttccccacattagagaggacacaccgtgaggtagactttccatttgcttttcctttctgaatagagctgcttctacattggtggttctcagctttgattgtaaatggaaattacctgggagtgttcaaaattccacttaggccatactcccgaccaattaagtctgacatttttgggaagggaagcagtcatcagcattttaaaaatctccctgagtgactccaatgtgtagccaagatggataaatccttctctacagtcctcttctttctcaggatgacgttggcctttcccgcttctcaatgactacaatggtaatctgttgcttaggaaatgtgatgtgtagtgtagaagaatgaagccgaagcagaataatatttctaatatattatctgattacagtttttatcatacaaatgcttagttttaacatttaggataagttattttggtttactatggttatagagcagaatgtcaatgttaccattcctgaccatgggagagcacgtgtgacagaaggcaggaagtgtaacaagagaaggaaagctagagggaaagtgtggagaacttgtaccctctaggagcattaattaaagatttacagataaccaatagaagagctagaaagttggctgggcgcagtgactcacgcctgtaatcccagcactttgggaggctgaagcggatggatcacgaggtcaagagatcgagaccatcctggccaacatggtgaaaccccatctctactaaaaatacaaaacttagctgggcatggtggcgtgtgcctgtagtcccagctacttgggaggctgaggcaagagaatcacttgaacccaggaggcagaggttgcagtgagccaggatcacgtgactgcactccaacctggtgacagagcaagactctgtctaaaaaaaaaagagagctagaaagttacgttagttatcaaaatctaggaagagaagagggtggcataagtaatatatatcaccattggttattgcaagagtcaacagctacaacctaaggcagattgaacaaaaatagcaacccaattccatgtggtgtaaatgtaagatgatgaagaacctaaaatagaaattgtaaagacttgactcgtaggggtggacctgggatagggaagatgtctgtactttaccttgtacctgtatctaaaaaaaataacaaattaaaaaatagatttgagattctatacctcagtgcatatcaaggggtagtttgggagaacacctccagtcaaggccatgttttctacaacaactgctgcatatgagaatgctgcaccctgaacccttgcctgcagcactgttaaatgcccaggtgacagtgctctgactctccatggccacgttcttccattttagtaagtaaatggcctaccacagtgttgctatatttattgtcttttaaatgttgtatcatacccaggagagagacagagaaagtaacattcatggagaatacacagagtgacattgcaatttaccacctcgcagattcctctgaccatagctgtaagtaatggcatcctattactgccagaaggtttagcagatggttttggtctatgtgccaggtgcctttaggtgttctgagaatatctgttgagataggccctgtgtaaatggagcactgtattgaatagaggaactgtgatgtcccatcctggctatatctaccatcaactggttccacatttttaactgcgacatttaacttctgtaggatcggcaaaatgaagggatccactgactcaaattaacatccagccttaacactttgcacatcaagggtttcttttagaatagaaagtgtcagtgttggactctagtctttgctaaattttttcctatcacctctattcagctttaaaatataggtctgcctgttatgcaagtgagcaacatgccttgtcttcaaatagactaggtgaaaattccagttctatcactttttggctggatgaacttggacatgttacttaacttcttcaagcctcagcttctcacctacaaagttgggattgggtgtttactattgttatgaggatttgaagctgcagtgtatattctccggttctaaaagattctcgataaatagcaacttttgttacactaaggaagaagttagaagaataccatgctcccaagattggaagacccaagatcataaatccacagggaaaagtcctatgtggatttgcagattactaggtcagatttttcccatttctctcatttgtaaagcaaccagccttctgttccactacagagtctgtgtgctagggaagactctgatcaccatctgggttcaacagaagccaagaaaaataacaggacagcaaattaaatatccacgggccatgtccccttcctgtccctggctccccagcctaagcatctgctgtggtttcaatacacctgaccttccttccatgcatgtcctttggtgagggttcctgtcagggcaagtattcctttggccaagtaaagaccccgctctcacctcccaaggtaactgattttcatcctttgaagttccttgacttgtgcaccttctctctgggttggggttagagctctcttataatccattaaatcaagtcctatattctcatcttctatctataggaaaatgagagggaggcagaagagtcaagaaaggaaggctatatcctaatggcaagtttattttgctgttggacatcacttactcttcagtttcctcttttttttaatagaagcaatatttattcagtcctgcaaaagagactttattattttagccttgtgactgtatattgtttgcccttaaagactaagaaggaatcacctgtttatatgtatagaaacctggtcatttgtttttaatttaacaatattgttataaagtaacttactgttgatttaattattaaaactaagcagacaatttaaatgtaatttaaataccatgtgttaagtatacaccaaactgaaacactacagcactcttcccagaagtaacatcctgagtagtgtaatttttttttctattttttccatctctgtagaaaataaaacagcactgatctggggaattggaggtccccacccaattgtcgttattaaactatctcacctagtcctgattcagaggctgcagctctgtttatccactttaaacaaaaggagctatctgttgaataggctctcttacagaatttccctggatatgtcaaatgtttatttttccatgtaaattttataattggtttgtcttgttctaccaaaaaaagaaatcacaatggatattttattgggattaattaagttaaatttaggccatccttacaatgagtctttcttcccaaagtagcctttgtgattaatcttttatagaatttacatttttcatttatataaacttttaatatttttgttgcgtttactgttgactaaacttttttgttatttttcctattgtatagttagcttttggtaatttaataacattatcgaagctgagtgccagaactattgtggttattcactgctatttttaacttttctttggagaattgtatgttaatattctttgtatttctagcagttattcatctttgttcttattgatttataagagtatttttaaatatattatgacttttttatctttggtttggaggtgtgagggtgtgagggaacttatagattatcctgtcctgcccatttttcctactaattaagaaactgaagtgagatgacttttccattgtcacacagaaacttagtcctgattatccaatcaggactaaaaataggtcttttgggtccttattttgaggtttttctctcaagtacttgcctccttgtctacagttttatctttttcctcttaaattgacactatcaggttacttgatttgattagaagtaacaagttggttttctacctctacaaatgaatcaccaagaactgattcatttcttggaagttattgacaataactcccaaatcttgtcagtgttggactgtgggctttgctaaattttttcctatcacttctatttggctttaaaatataggtctgcctgttatgcaagtgagcaatatgccatgtcttcaaatagactagaagaaaattccagttctatcactttttggctattgccaaaaagttgatatctcctttgaactctagatttttctaagacatctctccagttggatgtctcattgacattttcaacttaaccttttcaaaaatgaggggtttttttgtttgtttttggtttactcttgttgcccaggctggagcacagtggcgcgatctcggctaactgcaacctctgcctcccgggttcaagcgatgctcctgcctcagcctcccgagtagctgggattacaggcacctactaccacgcctggataatttttgtatttttggtagagacggggtttcaccatgttggccatgctggtctcgaacgaaactgagcttttaatatccgcttcctcatctgcaattcttagtctccttcatctgagcaatggcaattccattgttcttaatggtcagattcaaaattgtgcagtctttgactattccctttatcccaaacatccaattcatcctgaaattctattggcctattttcaaaatattgccagatatgttcacttctcccatctcctccaccctcaacctaatcaaaactacctttcacatcaatgattgtcatcactttgtatttggttcccttgctttatctgtaacttcttgtattttattgtcttaccacagctggagcaagccttttacaaaataagaatataacaatcttgaaccactgccctctttcctccaagtttctttttgttttctgatatcaatttccttaattcactcatgcctttgtttgtcttcaaacagtataagcgtactcttgcctcaggacctttgtacttactactactcctttccctgaaatgccaacctccacacatactcaaatataagcacattggctgcaaggatattttctgctttgtggcttctgtatcctcaggacctagacagtatctgacactcagcaggtacacagtatatgattgcagaatgattgattgaaccatacttactagcaatcatttttggtggtgttgtgaaggatattttgaggcatcatgtggtctttgcagaactggttgaatttctagaactaagatgatactgctcacttactgatttatttgctttagaatgaaattcaaattcctggccttgtcagtttccctcctttctctccctccttctccactctccaatcacaatggtctcttttcacctccttgaataagccaagcctttgagccattttgctggaggtgccccctaaggagaaacatctgtttctgcatcttcacatagttgactcctcagagtacatatatcaacagcaaataacttacctatcacttctaccacatattgccagaggctcacatttcatgacacatagtgggtacttacaaaatatttggagaatgaataaatgtcattagcctagcttctaaagatcatgagatgcatgcccccatgacagcaccagccacatggtgctgaaatgatatatttgtgagtctgtctcccacagagtctgggagaacctctgagacagatataatgtttaattcatagtcactgccccaccgtctcctacacctagtggcatctagtggtattccatagatgtttgctgaactaacatgaagctacagaaaggcctttagccctcttcatcaaattcatttcacttgagagatggggaatatggagcacagaaggtaaaatattaaaaaatgaatattatgagatggctcaggaaggccttatgaggaagaggacaacgcagagcaaaggtgtagagaaattaagtgcctagaattagctcccatagggagaagaaatgcagcagtgagatcatcggtttaggtactcatttcagaacaatgccaaccttctggtgctagaaatttacaaggcctttttttttcaaggctaaaaaatgatgttactgatgtgctatatgtaatggttcctgtgagtaagtcatccttttgactaccaaagcatactctttatagtagctgtttcaatgttccccattctctctctctcttttttgcttttcttctccaaaccccttttccttgcagatggtcttatctcctactttgctgagaaaatcaaggtcattaaaggggaaatctcctaaccttccatcttccccaccaaaattatctttaaccggatatatgtcccctcctcatcctcttctgtcttggcatcatagccttccaatattgaccctaatattacatctggattcctttctttttttctttaatcatctgacatactgtatcctcaattatttccagttttccagcattatacaaatcttttttttccactgattccttctcttggaccttcaaacatacacaagtctttcttgtcttgcaaggaaataattgttgccccccttcaagccaccatattttcctttgtggctaggtgtcttatatgccttcatgacttaactctctctattctttcaccatatagtccttcactatcatggaatcctcatgtttcaggtctcagctctgttaacatgagacatcccagaggcttctcttcttttatttaaaaagtcttctttaagagtttttctactctccccaataaaacaataaatctatttccaggatcactgagcacattctgagggccagacactgtttgggcatcattcatcaaacatttgaatgagtcatagaaataggacactggactagatggataaacattgaggcaaacataaatatgtttttccaggggtacaaagagaaccaaaatttgaaaaactttaaaaagaacaaaccaacttagaataaaaggtataaaatggtaccatacatatgtacacatttttttatatactgtagagggtggtagatggacaactagccgggtttgcatctgaggagccacactggtggaaataagggccatgctgggacctgcagtgtgagtagggttagctaccttaggatgggggtgggttggatgttgcaaggaaaaggaggagtacagtcaagcattataggaaaaaatgtggcacagtgtggcgcttgccatcatgcacccacattcactggagactttccttgcttgcttcatattccatgggagttctgagttggagggaggtgtgtgagggactactccacacagttattcaggaacccaggattattccttcttgtgcatcttgtaactctgtattgtttagggcttcagtaaccacaatgtggttcctggcccagcagcaacagcatcacctggtaatttgttagaaatgcagattcttaggcccaccacaaactggctgaatgacaggctgtgagaggatccagaaacaaatgttctaccaaactgtccaggtggttctaatgctcagtcacatttaacaactcctgcccaaggcccggcagaggagggtagggcacatagagatcacacaggagagttttcaggtgtcagccccagcagtagcacatgttgcttctgtccacagttgttggttgctgctcagtcctgaagccctgactgactatccaagaagctgagaaatagcccagctctgtgcccaggaagaaagggctcacctcccaactgttcttcccactgccagtctgttccccttaaattcattcacctcagctaatcatgcaaatctgtgatgaccctggctgactgaaacttccacgggtcccatggccttctgaatgacatttcttagtcccacaaaggctggttcctgttgcctctctggcttcatggtttgccatcccaccctgaccctgaactctaaactccagccgtcttaaactattacaaaaacacctggctgatctttacccagccctgtgccttctgctctgggcttttgcaccttctgctcttcccatggtcctttgctcctggccattcccattcatccttcagggctcagccggatgtaactttgtctggaaatatctccctgaagccactctctacctcccctccacccaagacagggttagatggtctctactaattcagaataatccttaattactttggcttgtaatcacatcagtctgtggaaggaagactgtttcttatatatagttgcttctttgttgcctgtaaagagcttggcacatggtagatgctcagcgaatgtctgctacgtaacgaaagcaaagtggcctactagatgtttagtgggtgcttatcgatgaggacattgattgtctatctcatactttggctaaaatttattattaacgaattcactcttccttaattaggtactgcatcttcattgcagccaagaacttcaccactgactaaaagcatgcagccacgtacaagtgggatggggggaaggaaatccatccccatggacagaaagttaactcaaagcctcgctcggctctggtcacagtcagcccatctttttcacagacaaaaatctgcatgtcttcatcttacattaatttacatatgtaatttacctaataggaaaataaggaagcacagtgtttgaagtgtaatcaaattacattgtttagaaaacagagaaaaataaagcttcctggtgctggcgggtcaacaaagatctctcagtagcttactcatccaccaactgaatcagtcccctgttcctgtcaatgcttctgccatgactcattctggtgggcaaatttttaatagaaaatgataaactcagggatattcaccttaaaaatatgacaacacttcccagggacatgaaaataagtagtattattctccaaaagttaaaataatacctgtactcagaacgtgagtagcaaccactgtcttccccttgcccacagcctccatgactcatgaccgcattctctcctggacattgcctcatcagtgactgccatctctccctctctaactgatttttgtgttggatcctccaataaggagacacctagttggagttaggagagcacagggctcactgaggaataagacatgcggaagttgaatgaagcagcagagttgtgcagggagagacagaggtggcatcgcctgtccagggtgcgcagctagtaactggaaaagccaggatcaaaaccaggcaaagcgagctccagaaaccagtggcctgaacactgccttgtactgtctgtgtcttcccctgcccagatggatagtgcattttattcatactgaaataatagctgttcataattggttattatgagcctaacactccactaagtgctttattaaatgcattacctatctatgaggtaggcgtgggttttctgacttttacctattaggaacctgaatcgcaatgaggttaaataacatgcccagaatcactcggccaataagtcggagaatcagaattcacatctcaaatttatgttctccactctgactccagggtcttttataccgctatttcttttgagttatttctattcatctttgtagttacacaatccaacaaaatataagcattgaataagagtttcctgaattaataaatgaatgaatgaatgaataaagtgcttttccagaaattctgtccagaattatgggtattgtggtcatttagcaaaaagtaggtcattttagtaagcaaatactgctcccaaagtttcagtttctttttttttttttttttttttgagacagcgtctcactctgttgcccaggctggagtgcagtggcgcgatcttggctcactgcaagctctgcctcccgggttcatgccattctcctgcctcagcctcctgcgtagcagggactacaggcgcccactaccatacccggctaagtttttgtagtttttagtagagacggggtttcaccatgttagccaggatggtctcgatctcctgacattgtgatccgcccacctcggcctcccaaagtgctgggattacaggagtgagccaccgcgcccagcctcagtttcttttttaattttagctatagcttttatgtaattaataaaatttctagttgtgaatacattaaacatgcatagtagaagaggtccaagaaccttaacattgttgttttggtgaaaagcaatcagtaagccaatgactctcaagcttttacatgtacaagaatcactagggcagcttgttaaattgcagattacgaggctctgccaatcacaggttcttattctgtacagctggtaagatgtctggaagtctgcattttataattatcctgagtatatccaatgcagatggttcctggaccacatcttgaaaaattcagatggaccagtggggctggcagttgtctaatcagcctccatgtcagacatgagaaaccttgaaacacacgtagcttttcaaaaggataaaacagtgtgatgtccgttgtttcctataacgatttcagagctatattataagacctgagacctgtagcacaaatgcatgtatgtgccaaccgaatcatacattgtgcatgaatgcatgtatgtgccaactttgcttaactggatcatgctggacagagcacttcataactatttaaaacttggtattgatctttagaagaagagctaatgactcattttgtataatcaatgtgtttatggcatctcagaagagttttatttttctactaatgatatcttactgaaattaaggtaccttccactgtaagaacaactcttctgtatatgtcactgagaaggaaaataaaaagctcaaagtggagagtttaatataagacaacaaagagcactaccctcagatgagactgaagaagatataagagatggtgccatccgggcatggtggctcacgcctgtaatctcagcactttgggaggctgaggcaggcagattacgaggtcaggagatcgagactgtcctggctaacacggtgaaaccccgtctctactaaaaatacaaaaaattagccgggcatggtggcgggctcctgtagtcccagctacttgggaggctgaggcaggagaatggctgaacctgggaggtgaagcttgcagtgagctgagatcctgtcactgcactccagcctaggggacagagcgagactccatctcaaaaaaaaaaaaaaaaaaaaagagatggtgccttggtttatggccctctaaaagcagatctataggccaaatcttgagggcaggtgggttacctgggaggcaatccgaggaagcacatgtgaggaggtggggaaatgagaccgagaatggaaggcacccattgaagtatgatcatgagcagactgtcattgttagcagttgggactcaatcccactgaggcctctgtgaagcattctgtagaacacacctcagaattgtacagtcatgggtagggaagctgggctgttacccagtgactccctttccttattggttgaagtttgtctgggggtggggcgagtagatctccagcacttttagtgaagagcagtcagtaagcaaatgattcccaaattctatgcgctcaggacccctgggctgtcctctacaagggctgaacaagctacattggtgcttttggtggagaagtagaaaaatgtaggcacttgaggagggataccatcagagtgcagagatactgtcccctgcagctgcagtggagctcagaggtgggctggggtgatggcccaggcatcaacaatagctgctccaaatagctaggagacttaggtgtcttaattgcggcattgattaatggaggtttaaaaaatgtccccttaataatttggatcacagtctaatgctaatcatgcaagtttgtgtcctaaattcatacaagtgtggttcatagaagcctcagttagggactttaagtggtttcaggttgataatgctgcctagtgtgactaacaaggaagtgcaaatcctctctgtctgaatgtggcttcaatccagattaatagcaattgtaaggctattgatcattctattcatttcaacttcttcaatgtgaagatgtagaaaaaatgtcttcaaaacaatgaaatacagtagtaacaaatagctataaaaaatacaacttccttcctacataataaaaatgtaaagagcactactttttcacccaacccatgcagccatgttcacacacacacacacagacacacacacacacagacacacacacacacatgccaactaccacatagcctctttgtaatggaggacattgactggtaaaggagagcctgccttctttctttctctcaggtctacaaccacgcaaatgatcaatattctattgaagtcagccaaatagcaaccagattaaatacgacagaaccaggaagctgaaaattgagggtagctattcgtataactcttttatttgctcaaaggaagccacagggcaaagggggagggggtgttcctgcttctagctgcattattttcaactttcaaatttttttttacgagcaaaaatgtctatgtaattctataaaaagaaagaaattaactctgctgggtttttttcctctttaaaaagcctgctcttcaggtttttatttgcagactggtctaggctttttgtttgtttgtttgtttgtttttagaaaagcattgtgccctgagatcaataaatcaaaactggattgccttcttctcaaaggtgaattgttatcttgccgaagaagttatgtgacagactctctagtttggtaaaaatacatgaacaagaaaaggattaaggtgtctttgcctgaaaggaaaattctggatgctatttttttctatgatagggaaagtttcttgaactgtctcctggaacaagaggttaaatgtcagtagctaaagcagctgtgggcccattatttggtgctcgcagagtccattctgtcattggaggtgctgttttcacacagagaatgaagtcagcttgacaactgcaggaacagctgtggcagcctgagatatgaggcaaggaggcaaagcccaaacagagggcaaagaacatctgtttgttgtcaacattctgaaaaaagcaaaagattcttgactatgggagagaccagggtacctggagataacagcagtcaagacaaaagcaattttcagcaggcagaagtcaatcaagcttgaaggaaaaggccagttaagatgcttagcacccaggggttctggaagagtgctgagccacccagagatgtcaggcctgagtggagctggtgctttgatatgaattcaggaagccgcctggggatggcgggttgggggacatcatcacagacccaactgctgtggattgacctctgccattactgctgggaccccaggccctctggtgctcaagaaaaccataaagccttgtgctgcctcatttttagaatctgttccctggcattctaaaccatgccataatgcatttctaaccacagggataagagatccaaagcaacattaatctggttttccagagcagggccacagagtgatcccatcttagagaattggccgggcatggtggctcacacctgtaatcccagcactttgggacaccaagacaggtggatcatctgaggtcaggagttggagaccagcctggccaacatggtgaaaccccatctctactaaaaaaaaaaaaaagaaaaattagctgggcgtggtggtgggtgcctgtattcccagctactggggaggctgaggcaggagaatcgcttgaacccaggaggtgaaggttgcagtgagtcaagattgcgccactgcactccagcctgggcgacaagagcaaaactccatctcaaaaaaacaaaacaacaaacaaacaaacaaacaaacaaaaacaaaggagaatcaaaccaccaagctttgatcctgaaacatctgaaggggaatgaggtccatgctacagggctctgcagatcctgcaggaggggagagcctcagtacaccaccattttactgtattcactgccacagatggtgcagatcatagtgatgtccctggcatgtgacaggaacttactgtcttcattgtgaatgagtttacttgactatgcctcccccaagaatctcaggaatatggaagatgtttgagtccattactttcaagtggattacagttgaccaggcaggcctgtgaaagaaagtttagggccacctttcaaattccagccccatttcacctgcctctgcaaggctctctcaccactgtcactagtgatggggtggaaatatcccagaagtagagttaggagaacatttggtcccaacctcattgctgggtggcctggagaagtcatgccacttctctggggtcctctgttcacatctctaaggggtttaattggactgggagacagtcaaggagttttttttattttttgaggaaagtggccctttttcagacaacaaaagacaacacttgttcataagcctaaaaagtggaataaagcccctacgaggagggtttcggcaaaggtaacatcaacatctcacaggtagctttgacttctccttagccaaagtcatctggctgagtttagtagcacttttggttgcatgtttagttaatgtgacctagacactctttcaggtgtgtgtatgtgtttgctctgggagtaattaactctcagaaggcataaaaatgtttaaacccaacaaagatcaaagattaaggcccaagtatgtgtgatattgctttgtgaaaataagctgcctagaaaatgggctttcacttaatgcagatgtgtttggaaacttctcctagtaggaaaaaaattctatcatttttctctgaagctgaaagaattggtgttgagagactgagaccggaaatggaattagcttagcagaaccgcatgcatttacttccagttcagagccctcagacagccttcctctaatgcttctgtaaaccagcaagattatttcttggatgcagcgtacatttctagtcctttggtcatggacaaaggtgatgcactagattttattaaatattcagaacaaattatgctatttaggaaaatgtgacctacaaacaggacaagatatagcgcaaataattaaagacatctataattaagaatgtataggattaagttattctttgactgaagagctagatacataatcatgcaggatttcaaccctcgccatcagagatgcttcttctgtgggccttaagtgtatgatgaagtttcaaagaattcagccttggttattttcagcactaagttccttccttgtgagatttcacataaagaaccattgaaaagacagaagttgcccccactgtggctccttacatagttaaaaccctattagagtaaaagaatcaagaaactcctctggaaaaagtacatatctctgtgttcactaggaccctgctgtgtacagatttagctggtttctgcagagaaacaaaagccacaaaaggtgcatgatggggtggaggggagtgttagagacacccaatttgcattattcctgctggaaagaccctgatctgagatcagctctggcagcccccagctgagaagggcctccttatagtcttcatttcattccagccaagccctggaggggtggagaatgcataatgaggctgaatgagaattagatgcttaattgaggcctggaaaagggaaagaaaaagccagacatgtggaatgtgatcagaatgcagctcagttaagccaaatgtgatgacacctgggaaggcttcagtggttgggaccactatacagagaagctggaactcctttgaaactgactcatccatctagttccaactcaaatgttattttcttgtcctcaaagatttttcttcatcctcacaaaaggtggctcactctctcctttgtgcatccaccatgcttggttcatatgacagtgcttgccatttggcctcgtgggtgggggatgactttctctctgcgttggctggcttgtgaactccatgagggcagaggtgtgcctcattcattttgtatcccagaacataataggcattgaagtacctggtggacattttttttttttttgctcttcttcctaaatactgagttctctgtagagtagttattctgacgatgactgatgaagcatttccaaaccattctcaaagaggcatatggaggcatattatctggccaaacataaaagtatttctatatatcaggatctcgtgctcaccctcagctatcatcactgcctttcatcacttggtaaagacagtttctgattttgattagggtagagtattcccaactaatacatgaaaatttctgttgccatggaaagggtcttttgtaaaaacaggcacaggcacattttccacaagtatgttcctgtcagtgtaatcattcactatttgactttggagagggggccaaatgtgtgtgtctacagtgtttgtccaagtgacgaagagaggttcagtggtcaagtagcagctttaggatggaggctatttggaaaaaacagactaggtgagtaacagatggcatacaatcaattgtatctttgtcctaaagaagcatggactaagtgtaaatcaagtgtatccatctgctcggctgccataacaaaataccttaggctggggcgcttaaacaacagaaatgtatttctcccagttctggaggctggaagtccaagatcgaggtgctgctaatttggtttctggtgaaaatttgcttcctgtttcatagacagccgtcttctcaccgtgtcctcgcatggcagagcagagagagatttctctcttcttctttgcataaggccacagtcctatcagattaaggtcccaccctcatgacctcatttaaccttggttgtctccaaaaggccctatttataaatacagtaacttgcaggttggggctacaacctttgaattttgggaggacacaaatactaatccatcatatcaagtctgatcagaaccatcatttgaaaaatattcttgaaaccagctgctggcaaaggccaggtgcatgtgacacccacaacgaatacctagaagaatcaagagcctctgaacacctgatcttgggtgaaagaaggtggtgtgtagtcacattttaaaaccttactctcctccaaacttaacaatatgaaggaagagaagtaaaacaggcaagcaagtatcatcaacaaaaacagtaattaaacgaaagaaagggtgggtagccagcaaaaggaaggcacctttctggaaatgtgcggaaggaacgagcctggtgttgccctaccccatccctaactctacaggctcagaaatcatcctgaataagatcacaccagctaccatttacctccctaactaggagagaaaaggccaaggaaatttccacaagagcatgaagtcagccatgaacaccttttactcagtctttccccagagaaacaagaataacctttgtaatcctccatgtcaatacctctgaaggaaaacgggaaagaaaaagcagaccaataacaaatgactagaactaattatctctagcaaaatcccgggaatttcacaaaatagaaaatttaagaggacatacataaggcaaggtctctggcgtgaacaagaaccagggaaggaggtgctagcaggccccaggtgatgcttccttgaagaaggagccaccttcgctctctgacaaggctgcagagggtttatcacctgctagggtggaaggctaagaaagaaaacagcaaaagggaacagaggaactttcagactgactctttctcctggaaagttctgagtctcatgttgaattgaaggaattatccaagccccaaagatagtgcccactatgggaagtccaagccccaaagatatcccccactatggaagtccaagatggcaactgtgcagacaaatttggggggaacctgggctgggcgtgggatatgctatatacttgctgagaaatccaacacaatgaatgtggctgctttacccctcccaaggaaaacctccaaatgaaaggcttctaggcagctgctggaggaccaaggagccacagagcagtatagaaagggagcagcttgctgacatgcatgtggcatacacatcaccctgcaagcacactgaaaccttgactgagaaagagagggaaggaaggaagagagcaagtgagcatgcaacccagtaaagggcaggtgaagaacgtactgtggaagaaaacataacccaagagaaagatccaaattccctgcaatgaccacagatgaactttgaaaaaatgttaacaagcttgaagatgcagtgataaaaataacataactgatctgaaatgtaagaactaaggagataaatgttccactcttagagaaataaatcagttaagaacagcaaagaccaaattactgacaaagaaaaaaggttgagattttcacagtgaaaatataatacatatggaagagaaaacacaaaaattgctctatgtgagaatgataggtgtcgctgaaatttagaagtcaatgtatagaacagaaaatgtcttaaaacaaagggaagctgaattgatgatctaatggtcaaaccatgttttaaaaaatcaatacagaaatctcgtcctgaaacacatctttgataagtttaacgatttttaataaagaattttatggttatactggcacatgacatgtcacttaaaaatacctaaaacttttagaagaatacatagttaaatttatttaatgtatcttaaagaaaataaaaagatgacaatccaggagaaaatattcacaatgtattagacagggaagggttaattttcttagtttagaatatacaaaaatcatggaaaaaaaacaatcaaataggaaattggtaaaatataaaaacagatgacaaaagacagggaggaggaagaaaagaagggaggtagaaagggtaatttcactcgtaatgtaaatcaaaacaatgaggacatactgttttcttccctgaaaagtttgagtatactcactgctggagattgcggagaaatcattatcgttatcattatcatgctctaagtgatctgattgatctgacctttttggaaggaaattttgtaacatctatgaagattaacagttcacatacactagatctagaaattcactcggaattcatccttgggaaatatttacaaaatctttccaaaatataagtgcaagaacattcactgaagctgtttgtaaaagcaacagtgtagaaacacatcagaagtccactgatgtgggcctggataaagaaattatgatatatctatatttatgcaatgagatattaacacagattacaatggcatgctcatcgatatatagtaaatgcatatattgaataggcactaaaatcaatgcacatattaaaatgcaatactaatcaatgcacatttgctagtacctgctaataaagtatgtacgtattataaatacatatatttatgtagaaaataaaaaggccagactgcagagaatagaaagtatcatctatattttaagtaaatgaaaactgagatgagagagggtatgaagtagggcaagagtgggaaaagagcaaagagagagaatgaaagagatgggaattgtgtgcattatttttttctgggaaggtaataggaacattttaacatggaaagagttgttcagggtcatttttcattagcatttttctgagcagtttgaaagtgttaattatgtgtaagtgtcctttctgttgttttttaatgtcactacagttatttaagggttaggtttattgaactttatctttatttctatttagaaataaacgcatgctattttaaaaagttagcatatagtatgttttcacctgtaagtgggagctaagcaatgagcacacatggaataaatatgggaacaatatacaatgtggacccttggagggtggagggagtggagtgggtgaagaaactaccaatcgggtgctatgcttaccaccagggtgacaggatccgtactccaaacttcagcgtcatgcaatattcccaagtaacaaatctgcacatgtacccctgtatctaaaatgaaacttgacattaaaaaattatatattaatatctcattaaattgtagtttgttttggttaattaaatcttcataaaacatgaaagtgtccataataataagtcttaaattcaaggaagaaaggaagaaagaggggagggaaggagaaagaagggaggcagggaaggagagaaggagaaactaggatgcaggaaggaaggtagaggaaggagggaaggagggacaaaaagaaggaagaaaagagggagggaagaaagaaaaggaaagagggatggatgagaagagggaaggagggaaaaaattaggatacaggaagaaaggtggaggaagaaggagagaagaagggaagaaagggaggagggaagagaggaaggaagagaggaaggaagggcaggaagggagggagggagggaaggggaggaaaaaagagagaaggaaggaagaaacaaaaggaaaatgaggaaaaggtaagaggaaggacaggagaggaggggaagactctggacaccctatctactaagaggtaaaaactgaaaatgcctctgaagagcagcacaatgggttaaaagcctttgacttattttgcgtgactgtgactaaagaatttaaacattacttttgactaaaaacaattattcttggcacttgttaattaaaacagcccatttccaactaaaaacttaaagactgagagtaaaatagctacatgttaataaagtttttatatggaatctgacttttaaataaagactggaccaatttacctatagtaaattgaaaagaataaatcttgttccaaagtcagaaagagagactgtgtgacattttatttttgatacttatttgttcttcatgtagatgtagaatgcaagaaagctaattatggacaaggagaaggaataaaagaaaaatacaatgccgaaaagcaacagtgctttctcctctgagatttaatctagctacatcagagctctaattcatttaactttttaaattaagcttcatacatagtaggtatgcagcacaatatgctggctgtataatagaataatgaatgaatgataccccagaggagggatatgtggtaaattattgaatgatatgaagaggtgattcagctaggtttgtgttcttaagggtcagtgataaagagatacccagaagtagccaataaatattaatcaggcatttatgatagtcagtcattatgtctttcaatcctccagttttatgagagagttatcattaactccctctacaagtgacaaaaccaagactctggaagtgagcagaacttgcccccaaatcacataaatagaaatgccaggacttggatttgaaatcagctctgcctaagtctagtgagttaaacttcatcccctttcactaatagtgacacctctgagaaagatagccagaagtaagcagacttgaggttcagaacctatcacagtagggggtggggtgggggagaaagagaaagggagagacacagagagagaaaaaatcaaaggcatactcaatgagagaaggaatttctagaagttggagttgtggtttgttgaatggcatttgttgtagggaaagtggggtaaattgctacctgttttattttgactcctttcacactggatgaattttaagagcaagtgtttaccccttgcacccctatggattttcacaaaatacctgaatatgaaacctggacattactacagctatgtgaatgaataaatccatgccattatcaaggactggaatgcttttttagaagttaaatttatttagtttatggctgttggaaccacatgatgattattttagataatgctgttgacttcattataaggagcagtttgtgggaaagcatcattacggtatagtgtaccgtggactcagcttctcttcaagctggtgttgatattgacgctgtgttattcctcattaaattggtctttgatctcctttcacttagttgcacatgcattctagacctagacagtgaactgggaagtctaggggaaaatgaaatctaattgagctcatcttttccaacaatcattagcttaaaaagaacataaattcgtgtctgtgcatatggaataatagccttcttccatccgagcttgggagttaaatgtacgtgcagatgccctaaactccaagaccagttttcttccattttagaaccataccacagtgagcacagtttattttttgtttgtttgtttttggtattatattcagttttaacactttattattattattttatttttccataagttattggggtacaggtgatatttggttacatgagtaagttctttagtggtgatttgtgagatcctggtgcacccatcacctgagcagtatatactgcaccatatatgttgtcctttatctcttgccctctcatactcttccccctaagtccccaaagtccattgcatcattcttatgcctttgcgtcctcatagcttagctcccacatatcagtgagaacatacgatctttggttctccattcctgagttacttcacttagaatcatagtctccaatctcatccatgtcattgtaaatgctgttaatttattccttttaatggctgagtagtattctatcatataactaatatataaaatataatatagaatataaaatattatatataaaatataatatgtaatataaaatattatatattatatataaaatataatataaaatattatatattatatattatatataaaatataatataaaatataaaatattatatattatatataaaatataatataaaatattatatattatatatataccagagtttctttatccactcattgactgatgagcctttgggttggttccacgattttgcagttgtgaattgtgctgctataaacatgcatgtgcaagtatctttttcaaatgtagaactcccagttaatccagcaatcccactactgagtatctacccagaggaaaagaagtgagcagagtttagcctgttaagggacttctcctttgtatacattaattcagtgtttctcaaagttatgtacactcaccatttgtagtttgatagatgattttaggtgatgtaaagattaacacattatggcatgttaaaaaattagccacaaatgaagctcaagatttcatagctataatttctatgggacaaaattaagaaaaatttagaactgaatcgattagaagtgtattattatgtgtgttagttagctatcaccacagtaatgtaatgcttcatctcaaaccatcttcaacctcaggggatttagaacagttgtctgttcttttgctcatggatattaggatcaactgcaactagtctgggccaggaagtgtatccatccacatgagctgagtcctggtctcatcctcctcggatgagctacccctaaagcatgttgtccttgcggtaaaaggtaggagaaggaaagccccaactgtcaaatgcatttcaagtctctccttgacacacttctgctaacatcccattggccaaagcaaattttgtaattaagcccagcatcaagagagagtgaagtagattcccatgagggtggcaggtaggaaggaaacatttctgaacgcattatctaatccaattacattaatagtgaagttggaacataggtatggcaaaagttgtcaaggtggttcaagaaggtttgctttcggttgataccactttaattcaatacaattgaatccagacaggccctgagctctgtacctatcatgtcacctatgcaactacagattctgccaaataattacttgtaattctatttgttgtgtgaagtttactgtcaatacacatctcaaaagaaaagcttggaggactcctcccccggccagcatctctcacgtttatatatttaaaagtctaattaactacattctgtgtgcatctcagtatcttttcttctatgatgacatctgcctcatttattactttttatgtaactccactaacctagaaaaaattgctataatcaagggtttgagcagtacagttgcagttgttgatagaaaatgaaaatagtactgaatgtcccagactttttctatttctgcatcttttatcccctgctaggagctctggaatgtacctcttgtttgtgtttcaaccagcagcaatccaaatggaaggagggacaggcaaactgtaataaataggccacagaggccatttttgtttttatcagattatgttgtctatgtgaaatggattcatttctgtagggcatccagttgcactgcccagcgatgtagaagctattaggatagtaccagttccacatgcatgacacagtaagaaatatctgtcattcctctcccactttccaaacaaacaactcacacacacatgcacgcacgcacatgcaaattcacataaacataccattgcacacatatgcatcatattcacagtgcatgtccacacatacaggaaaacctcatgtgcactcatgatattaaattaatgaacaatctctaccaaacatgatattggagtcttggaaagcagatctaacagactatacttccctctgctccaggaatatagtggtatacagagctacaactttgatttctgtttttttctctctgtttcatggatttcaaatctgccattgaatctcatactaatctatgccaatactgtggcacaacctgagatttctcacacattccattgtgaagtgaggttagaaggacaagcatagggctagaaatttaaatgtttactgttttctgatttgctatttgcattttgctttcttcaactttttcctctctctcacctaacttttgaaagtgttttgtaccctcccttatttcactaagcattgtttaatagactagaattatgcctattagatagaaagttctctgtgataccagaggggtttccccatagtaatgtaaccagggttattaccattgagagtaacaacttagaaagatatttcctgaaagaatcagctacaggtacctctagatcccatcagaaacaaggaccctaagaaaatagtcaagaaagtaatgcttagatagagcttatcaattaatttttccacagtaatcatttcatataaataataataatattatattttaaataggtctgatgatgtcccagagagttaagatgagtcagaatattttataatcattttactagtgaaaaagccaaggcttttaagtgctatgagatttggtcaaagttattgaaaaaattaaatgaccagccacaatatcctcttttgtgacacgtctgtttgtgtcttgtccactttctgttgggttccctgtcttttcaaggttattttgtatgtttatttcttatatattctgtacaggagtcttttggcttattttcctctcccttagcatgttttgataaacttattttaatggttggtgctttgtcctgtgtaagaaattttgcataatgatgtgaaggtctttgtccacattacctttcacatttatttctttttgagggtaggggaaactatttcttcagcataggtctgtggacaccaaattctctcagtcatattctctgaaaaatattttatttcaaattcaaatttgaaaatctttttttttttaacacttcaaagatgtcattgcatcatctctggcttccattatttttgttatgaatttatctataagttttattgttattttgaagttaatggatctttattcactagataactttttttttctttaatgttggttttcagcagtttcacaatgattagactgagtgatagtttttttcattaattttgcttcggaatcataacagtcttgaaacagtggtttgagatgatatctgatatctttcattaattttggcaaattatcagacattatctcttaaaatattccttttgctctattttacataggataaatcctatctcatatggttccttcactcttatctggggttttcatctgcaatttaggcttcgtatctttttccgacctagcttttggcttactaatcacctcttcaactgggtctacctgctgtcaaaatcacctatttaattcttaacttgtttttgtggggtttttttttttcggttctagaattttcatctgacttttgaaaaagtatccagctctctgataaactactttgccgtaaaaattattcaacttggcatccaatttccaaaatacattaattgttatttaagctgcctctgcaatacctggatctctgatgtctatccatatgtcatctcttttattctcttggttttcagtgacttgttcttgttcctctgaaatgccaggtaattttcgcattgaattctggacactgtttgaaaaactgtagagataacttgaggcttttaatcttcctccagagaagatttacttttgcttctgacagcagagcactataattcaatcaggaattgtattaattaaaagttagacttcaggtttttttaaagagatggtctatttcaagttcatgcttgtccccaggatataacccttcagggtaccccaccaaaaacctgaggtagttagcagggtacctctccttggtagaacccaaccttcaagttttgctccctgcccctagcctcacaaaacacctgcaggctctattcaacttcttgacacatgtgcaatgtcagcttcaccattttgcatttcctcaggtttgtcctgcattcatagcactctggggccttacaatgctattttaaataatatgttcagtgtttctagctgttcttggtagagggttagtctgaatcattacagtccaccttaggcagaatccctttctcattataattttaatttgcattccttttgttgttagcaaagtaaattaccttttcatgtgttttgcaggccatttttatatcttcttttattaactgtctgttaaatctcttgtccattttcctattaagttggtggtcttcttcatctccatttttaaaaggccttatatattaaagattgtagtaacactttgtctacgataaaaggtgcaaatattttccctcaatttgtagctttttaaacatttcttttggtattttttccattaaaaagtttattatgtttataaagtcaaatattttgttcttgctccctattacttctgtgttctaaggcataattagcaaagttttcctgctcgcaggcttaggggagttcacaaatggtttcttctgtaattgtgtgttcaaggagtatgttgatgaacaattgaaaaatgatatatttctagaataggcagtgtgagaaaggtattatatagtgttaacaagtccagttggaagttccaagttttgtttttccttttccacctcattctcaggagctagtgaaaagcactgtggacacagtgactttcatcttgtccttgaagagttgaggagaccatgagtcctttttttcccttgtgttatctttttcctgagttctttcatctactttcatactatgaatgttaccctatcttggtgtcccccaaatacccacatgttccattcataattctcttctcataattctctccccagtgctagatgcaaaacttgtttgatatctcacataaatgcccctacacttcaggctttaaatctaaaatgactttgttcttcttttcccactctgcttgttttatatgtcatcaattaatgacctctctgccattcatctacctaagctcagagcccagtcacctttgaatcatatttcttaattgtcaacctcaatacaccattaccaagagtacaaattctacctctgaagatctcttcctttgtagacattataaactggatctttcctgtccttgcttttttctcatcaataggcacatgaagtttaacatactctggacacagtaagtaatcaggtaatgaaaataaatttaatcctctctttaaaaatgtacaggaatcataaaacctttaaaattatgggttttctagcactttatgtatgtatttgtatttacaaatgtccttgctcttcaagttataaaaacttaagagagatttaactaagaagcaagaaatgattgtccttttgaatacctggaaatgtttttacaatatgaaacacaattcctttactacattgaagcatcttatcgaagcaccttgtgaagctgtgcaaatagaggccagtcacaaaggaaatctactgacgactaaattctcagcaatccgaaatggcagcatcagaggtctcctaaggaaacaactaaaccatttgtttctgtttaaaaaacaaacaacaacaacaacaaaaactctcactaccaggagaatgaatctttcagctttcagtcatgcctaaggcaaaattcattttctctttttcttcttctaaggttaaactacataaactctctctcacacccacccatgcatacagacacacttccctaaatttaaactgtaggttgttctgaggaaatcaacttttcctgctgtcatgctaccagatttctaatttgagaaactatatatgtatatatgtgatcatctcacaaattaaagagaacttagaaggccacacaaaagtattcaagcaactcaaccctctgtttcctcttttaaccttttctgcaaaagaagttgaatcccaggagtatttttgaatttaaaagggcaatggagggtgacagaaatgattggccctcaggctgttataattctctattcatcagggactgtggtctttttctcttccagctccaggcgaggacacacctaggatgcctgggaaaagtgaaggctccagtgacctagaaaatactccaggtcctgatggtaaggttctgagctattggagcccatggaaactacaaatctggcatattttctatgtgtaatctaggattaagggaactatctgttctataaagcaacatatttggttagaacacagtaaatttcaaaaacaattttgtgctacaaactaataaaaatggcaacctcttatttaaaaaaaaaacctgtttctagctgttttaaaacagcatatgtcctggtttaatcatatcttataatactgaggactcaatagatactttcaagactaaactgaactgaagtctatctagtgaactttatggaagcattacttacttctgcaaaaggtacttagcctacttagcctcctgttaccctgctccactcagcattcgggagagccctacctttggtgtgggctaagattgttcttgtaccttcatcacttcactccactgtatcacatccattgccttggttaaaaacatagtgagtctttaaaagcaccttaaaaataaattttcaaacaacctttaaaaacttacatctaattttgtaggcatctaaagagtctgagcctcaggaatattaatatcccttttcccctgcacaaagatgctaagggccctttgaaataccattacttacattagagaaacaactatttaagcctacctaatgtaataagtatttgattccactggcccatagagtttaggagaaccagaattggttaggtggtcagtcatttaagtatcttgccatttgggttattttagccaaaggaaaaaaacaaattactttgagttgataatgaccttggaaaaaatttagccaatggtggatgttatttatagttttaaatagaatttcctataccaggtattccttgttcccaccggcttatcatcacctgaattgccttccttaattataagcccatcggcttatattgcccaaattggctttttactcatgggcatgcattgcctgtgagaacaatgtttttaagccccagacccatcccttaagagccactgcttgttagttatgagcagttgaactaaacctgcttcagcttggttgtgatgctacagacatggttcttaactagttatttacaaatcatgttctgaggactatcaggcccatgaataaaagagaagtaaatgtgaaatacggagttttagtcctcacttagagattcaccatacacagcagaggattgcaggccctcagaagtctcagaggtaaagagacatgtttaacaagatttaaagttgcttttcccaaacttatttggtgatgggatgctttttattgtaccatttattagtaggttttagaactagtatcccttggttggaagaagaaacagaaaaggaatactctcctgtattttatcctgcacactcccacactgagaagggtgaactcacaataactttgcagagcaggatggacggtggatgaatgcttatacttacatagggttgctgcatctggggccagtttatttatggggtttaaaatgagttcacacatcattagaaactcagggcagtttgcaggtgagaacactgagacctgcttttaaaaccttccttattgggagagagttcagtggatgccatataaagtcattctctctttcaagcctctttgaagtgtgaaaatcagcatctgccactactttacactaatttcatgtttgtgaaaaaggagatacaggctgttggttttgtgcaaataaatgaaaactgcccaaatgagaacaaacagtggttacttattcaaaggtaactataacaagggtggccattatcacttgtgtttggcaggctcaaaggcgggcaggggatgggaaacccccctttataggttagaaaaagagaatacttcaagcatgctctgattggaggttgttggcctagagaagctggacatggctaactagaagtggggcaccttaagtgattgtattagggaatacatttggccttccctggttggtcccaagttggaagcagaggtaaaaaatagggacgctgacagtcactgaccaagtcctgaccattctgagtcaattgctgcagagactgtgttttggttgcctaggctagcttctgcagaggttttacatcagaattctatcattatatatgatctggccattgtctatttgtatactgattttctcagcttataatgtggactttgatgcttgagaaaatatcaatctaattaaacctactgacccttggaaaatttagagtgagtgctatgcctgctctgggttacttctggagaatggcagtaatcatgcattctatttttattcaaatgctcacatagaatacactgagtcaggtaaaagcacacgttttatcacaactacgggatctggttagatggtcggctttttaatttcatggccgctcactgccactacagcagccgtcggcaagtctacaaggtctgttttgaattcgaaattgaaagtatggcaaaccaaacaggcctgatattgacattttggagcaagctgcttacctctctgcatgtcagtgatgtgctttgctttgccttctctctttattttcttagatatctattaaagcctttgcatttatccaagaatcataatatgtacatccaaactgtcaacccaaaaatctggtctgaagtgacgactcagtttcagttgagggaagaggcaatcctgccctcccacaatgggttaggccttttttgtgttgctataaagaaatacccaagactggataatttagaaagaaaagaggtttgtctcatggttctgcaggctttacaggaagcagggtgccagcatctgcttctgatgaggaactcaggaagcttacaatcatggcgggagaggaagggggagtatgcaactcacatggccagactagaagcaagactagaagcaacgtgtcacacacttttaaacaaccagatctcatatgagctcactcatcactaagaagatggcactaaaccattcatgaaggatacatccctgcaatccaatcacctctcaccaggccccacctccaacattagggattacatttcaacataagatttgaagggggcgtctgaggtatatcctctacccccaccagtaaaaatctacaagaatagtccccaaatcttgaatgaatgaaaacaaatggaaaagaggcatcaaataggaaatcaggaaagtatcaaatcatgggtcattttaatgtgtctcagagatttaggtttaatgaatatttaactttttttttttttctggtgacagttgaaatgaatagtcaggttgacaaggtaaatgacccaacagagagtcaacaagaagatcaactaataggtaagatgccccttgtggtgagattttcaatgatcaaccagccataagaactatttgcaaatgacatactggatttcccttggttttgccaagtccccacagcatggcttgggataaaccttgaaaatctttaaaccaaataacacagcgtaaggggaaacgatcacccctagaagcttgccatcttgaagaggaaaagatgagctacagcacattcaaatcatgtataccctggttttctgtgctttgacaagtaaaaaatgtctccatccatctcaccccctggcctcctggagtggtcaaattatttcagaaactccaagctgattctgaagcattgcttttctagaagctacctgctgagttgcttggtatatctgtctttaagcataacactcaatctttgccctggagtttgtataaaggaatatgagtgtgtttggacagaaacaagcctgccttaggtcctgtttttttcacaccactacctgtggacccgtgcgtctgcacaaaggtttgttatgttgaatgagcttcagggaactcccaggaaaataaaaagcctgggtttgttacgttgaatgagcttcagggaactcccaggaaaataaaaagcctggtccagatcatgtttaggagtttttccagaccaacattctaaatctctcagtagagactaaaatatatttagaatgatgagtgtaactgagtccaaagccagtactgcttgcttcatggcagccaatacatcaagagacaacgtgttgaggcaaggaaaatgactttattccaagagccagcaaaccaagaagatggcaaattaatgtcctaaagaatcaccctaaatttatagaattttaggctccttttctctttgaggaaaaggaacagagaggtggttgagatcaagaggtgacagacatctggactgcagcaagggttcaagggggagttgtgaaacgtctttgcccttggtcaggtcacattgctcctataaatctttaacataatgttgttacttgtgtgcatactgtctttatctcttcggtggttagttttgggaaggaactattgtcatctttgctttaaagttgaactataaagtaaattcctgccgtagttagctcaccctgcatgaagagatgagcaaaagcaatcaacctaaaagatatcactggacgggggcagcggggagcaaaatggagctagtcatgctaagcctcctttacactgctacctgagtggtctataatcctcttccataccctgagggctgatgagaagaattagaagaaggaaattatgcttgatgttataactgttccaagttctggtttaaaatatttagttgttaaaaaaaaaagaaaaaaacctatggaataaatgaatcatgggtcatctagtgtaaggcacaaataatgtgttgacacccttgccccctgtacctccttgcactcactgcatgttcttgatggttctctacactttcctaagaggcttggctttaccactcttgtgctccagcatcatggaagaataaaatatgggaatgtgtgaaagagtacatgtcttattcctgtatggtcttgaatatcctataaaactaaatgtaatggtatctgtgtaatgcatgtatagcataagactgctaaaaagtataagctcatacaaacatgttcttataaacatttctcctttttttttttactttctttatatatttaaaataccctgctaagctgcagaaatgatacggttgaggagtttccattaaaaagtaatgaaatgagactaaacttgaacaatttaaatgcaagctcctcagtgtttcctttccttttacccttttgctgccaataaactataggcttcttgtctagacttttttcttacagacattatttctttcctgtgtgaccagtgtccagatgaagtgccaggattagtctgtttttcttggttaatatcaaaatgatatttttcttgaaaataaaaatgaactcatatgttaacccaaatgaatcaggtgtcaaaactttttttttttttttttttttttgagacagagtctcactctgtcacccgggctacagtgtagtggcacgatcttggcttactgcaaacttcacctccctgtttcaagggattctcatgcctctgcctcctgagtagctgggattacagtcgcgtaccaccacaactggctaattttttgtatttttaatagagatagggtttcaccatgttggccaggctggtcttgaattcctgatctcaagtgatctacttgcctcggcctcccaaagtgctgggattaaaggccaggtatcaaaacttaaagtccaaaattagtttaaggaaactaaattccaggaaggagaagtgacatgcacagggtcacctggctaataaatggaaatttaaatactccaattcaaaattctgctccctaagcaatagcaagtttctggacacagttgtcacagaggcagaatgaatgatttgtgcaacgtcactgactcccacagcaatatttacacagaagggtttgttaagatgatctggtcgtttgacagaaagaaggaacccttgctccatgaatcataccttcaaggaaattaaagaaatacagtgaaatagaattagagagctcaaagacataatacaagaatgtttggcgttgtataatttgtaattgtaaaaaatcagggatagcataaggatacaacagggagagggttaaatgcatcagtggaacactttccaaatgtaaatgttttccaacaagtatttgagggcagtaatgatggttatggaatctgaacctttggttctggagaaacatggcagactgagtgtggcttctaggttgagctttaagaggcttgtaacttccgtttttgcactctcgtaatgctcgttgcctggaatccagacaccttggaagaagcccaggttatcctatagaatgaaggaggtcacatggagaaaagtcctagaaaatgagaatccctttcagatgttctggccccagcaggtaccaccctcaagcagatgaactgtcctgctcagtccaggccagatggtaaaatcatgagaaatagtgaatcactcatgttataagccactaaatttggggctttagattgttgatacagagacaggccttatggccacagtcttgcattttaatgcccaccttggaccttgaaccattcaacgtaaggagttggaactgatacctctgcataaataaatctaggacttctagctcaagaaattaatagaaagacttggatctgcgccaggtactgcatggggagagaaaaaggctcccaagatagatagaaaccgcaaatacactgtgagtttgaaacataattttatgtgatccaaagtcatgcagtaataaacaaattgaaaaatgaacttaataattgattacagaccagtgtgattcctggtgtatgtggcaaatggaaatatgaaactaccccatggaatttctgcaaaagaaaaacaaattctgaagttgaattcatagttttaagacttacagaacacacaaggaaatgatccattttgagtgagagtcagtaggtaaaattacaggacaattagcactatgagaacgttaagagagtaggaaattttgaagattttataaaataactacatttgaatgacaaaacaaataaaagcagacctaaaacaataagaaaagagcaacactaaataattaacgacaatagaaaaaacaaattaaaatgtagtagtatcaaagacacgtgaagagacatgaaggagaagaagagaataaccaagacatgttaagttcaataagagttctacaaggagactaggcagtgtagggctgtgtatttgattgatacccaccaagcatctccaggtttaacttaatttggactgagattactgaaaaccagggaccgcagatataaaatacagaaccacaaggaaatcccaccacgatcccactagtattgaattataaagttaacaccaccaaatgttacagaggatgtggaggagctagaactcttatacatggctgggggacatataaaatggttcagccacttttaaaaaattgttagtttcttgtaaagtatgtatccatcctatggccccacaattctgttcccgagtatttgagagaaatgaaaacctatattcacaaaagccttgtacaagaatacacatagcagatatgctcacaaaagccccaaacttgacacaacacaaatgtctcgcagcaagaaaatgaactttaaaaagtgacatatacatacatgggaattctagttagcaatgaagaggaacagattactgttaacaaagcagcaacatgaatgaatctcagaagcattacactgagtgaaaggagacagacacaatgaggtacttgtatgattccattagcagggagtcctagggcagaaaaaaactaatttatggagatagaaatcagatcatttgttcattccagcaggagtggggtagtagggaagggaactttccagggtgatgtcatgtatatcttcttggtggtgtgggtttaatgtatgcatttttcaaaacagattgaaatgtatgcttaagatctgtgtgttttcctgtaggcagattatacctcaattttaaaaatctaaaaaaaataaagagtataggtttttgcaaggcacagtgtcttcttagtgtcctctcatgggtagtgaataaggcagataatttaataagtacaatctgaagtggtggcataaccatcaatgacttttgcaaagcagcattatgaaaattgttattatttatatgctgatccctggaaactagagtgtgagcatgggcctgaaaagggaagccacatcaactcagggttacagttttcaacgaatactttgaagaattgagttaatcgtccccatcagccaaagctcgttgtcaatgtggcatacatttattaacagtgatttatatgctctttaaagataccatgtgccagcaattacagttcagacatctaaagctctttgatagtcaaataagatatttctgggcctatgtgaggggtgagagacatttaaatggctgtattaaaaatgtattccttgctaagcctgtgaagatgtcttatctttaatctaacaaatggcttctctttgtcttcagcaggggcacaagatgaagcgaaggaacaaagaaatggaactaaatgacaatcctcagcatcgcaaggcctctcctggctctgggggagctcgggaagatagcagcacacgctgtggaggagggtgggggtggggggaaggcaagtcccatggaaggacggggaatcctttactctaatttctccagctgcattttgttccgtttatctgcagaaaaagaaagaaaaaaaagaaaaaaaaagtttcctttaatttggtggagggacccatgttgacgcatctttcaggcattatccttgtaatttctgtcttttctcttacaactttgccccagggtcacagtggcttgattgaacactcacatgtgtatcctggcccctgtctgctttcttggttatttcacaaagctggtcacacagtggtttattcaaaggaaggggaggaagacagtggtttgataagctgcaggataaattttaggaatcaatgagcccagcagcagtataatccccagacagaggaggcaggatagaaaatgggcaaaagcctcggaaaccacttggaaaaggtctggacaatgaggtgaaaatattttcttcagggttcccaaggcacaatttgttccaagtggctaatgagaaatatggaagctgaattttttccagagcagagtgcagaggcataacagaagggtgggccctggcagccatctgggtctcttccttcctaaccatggtggcaggtgcatccttctttgacactgactttcagcagagcttacttggttcatgaggtcttcacatggagactaccagcaagaggtgactctctgctgcataactgtaaaggatggccctttgctaggtgttacagttaaaagctaagaaaaggggcagtgcatttaggacccaaacatatgcctatgaatatcaaaagctcctcctgaaattgctgtgagttttccataaaagaatatcctgtcttcacccaaggcttgacagcccacagagtggtctcatttgaaattacaggaaattagagcttttgcttgcagttctgccttcctggcctgtgtttaaatgctgtcacttgtttatgccaagttcaaggctgattcaatggttggtcccctcacccagaaaaccctgaaggggaggatacagctctgaaggggggcagcagtactaaaaacccaagatgccagtggtatagtgggcacaagggatggcgaccatgaggatgccaggcatcatcaccaatatctatcctagagccagtataaggccagatgcctacttcccacagcctccccgggttccaaagtcatgtcattgttttcagtggaaacatatcgtttgttgcatatcttcttaaatccatcttccttgtaagggctttagaactaaaacttacttatattgtttttccttaacagagggagaaaaatagtggattattatttctaaaataaaaggatgttctgctttctaaatatcccatcaaaatcttcagttttgcacttttttgatggaaaattcatcttatcttcctatgactttggttttagcctttctgaatttgttaccccttctggatggcttatttgatatactggaatagttaacaagctatacttcagcatatgcactatattctaacaaattttttttaataaaatcaagacatcagcaagaatgacatttacgtgacctcataatgtgggattatggccttctgttgctattccagtttgatatggaagcatctatatcctctattgccgttagatgttgttgcttttcagaaaagtaacgaaaaggctcattttaaagaatccaagaaacgatgtcatccaaatattgacagtttctacatttcatgccatctttataactcaattgaaagttgccgtcattcttgtgaagtatttgacaagtgcaatctgctagaagctcgtttttcttgtgactcccaaatgttagtgctacttagcctcagtaatgagttacagttgaaaaaaacatgagggaaacagagggacagagattttctaatgaacaatgatggaagagacctaatgtccttgctagaaacagccaggatggaaattatccagccctggcattctccttatcatcaatgacagtcattttattcatttatttcaaatgtgggtgggctagaagtggaaggagggaattctctctgcctaaaaattctagaagaatgaaagtaatctttgtatccaggaaactaagagaatgaggaataaatatcttcagcccgactcctgaatttgtttattcttccatctataattagattgtgttttcatttttgctttgtcatgctttttggttgttatttggctatacagttttatgctttaaaacaaatgataaagttaatttccaattcaatagtgaaatattaacaatctaactatagccagatcaaagacacctgaacacagaaaacctttatttgctggtgctgccattgcacaggctgtacaatgaaatagatttgaaaagctgattgattttcccgcacataaattctggatgtcaatttccaaccaaactccaatacagctatgtggcatgaagagttacaggagggagggaggaaaatagccctatgttagtcatgtttgcatacagaggatcaaagtaggccttcaccataatagttctaattaaaatggtcctcgctgtaggagagacaaaggggcttttcctctagctggtaactattcagatgatggacaagtcttctttcataaaagattacaaagaaggcatccgaatcactgtctgtgatactgggtcacatattaatcactgcagctaattgtaaatctttctatgaaacactgaaaagcctctttgtgaattaatacagttctgcttgatgcacttgatttgaaaagacatttctctgtatgtggcgcatgtcggctttgctttgaaaaataacaaagttagcagaatatgttcaatatattttcttggggaatagggtttttattacatgattcattaaggatttgccttaccctgacatttgtgatataaaggaaaatcagaaaaaaagtaattttcttgatcaagatatgtttttacttaatgcaaataaatgtagtctgttgcttgcaaggaaaaaaaaatggcttctgatatctggtataaactgctaaataggataatacgtgcctcttttgttaaaccggcatttaaatgctggactgcttctaaatctgtttgtttcttttcatctgtgccatacactaaaaaacaactgttgccttcatactatatttgttagagcagaatacaaataaaatttgtttgagaggataatgtgaa

SEQ ID NO: 1518 - DNA, 3510470 bp, Homo sapiens (residues 1-1,755,235 of 3,510,470)
caggatcacagacgtttaaattacactccttctgctgtgccttacagcagtagaaggggtgaaatttaaacgtctgtgatcctggggttgttgaagatgccacccatctacatattctttcagatgcacaatatttcactgtgtgaatgaaacagcagcccttcttacgtgtgcttttggaatttgaagattttgtaagataagatgaatgcattggaacaagtgatcctcaattctgtgcagtctgtgcctccggagactggcggctgcccctccctgtctagtcttgcaagagaggcagctggcaagaggacagaagccggcagctgctgcgttttcatcctgtttctgctcttggagctgagggggagaggtggctagcagccacccagtgatcaaacttgcagcctgcctctcttgcttccttttcacagactggagtgtgcctgggtatggagaaagaacattttgcttcttgcctctcagagtttcaagaacgcctcacctgagtggcatgcattcacggaatgagtaattattacagtggagaactcctcactgtgaattaattacacagatgatattcaagacttagactgggctagtgcaggggttagcaaactatggcccactgttcttgttttataaataaagtgttatgagcacacagccatgcccattcatttgcagattatggctgcttttgcctgacagtgccagatataagtagttgtggcaaagaccaggtagcctaaaaagcctaaaatacttgctatctgggtctttacagaagacattttgttgttgttgttgtttttgagatggggtctttctctgtcacccaggctggagtgcagtggtgtgatctcagctcactgcaacctccgcctcttgggttcaaatgattatcgtgcctcagcctccctagtagctgagattataggcgcctgccaccaagcctggctaatttttgcatttttagtagaaacagggctttaccatgttggccaggctggtctcaaaccccgacctcagatgatctgcctgcctcagcctcccaaagtgctgggattacaggtgtgagccaccgcgcctggcctataaaatgttttctaatctgttgtctagtgggtgctttgtaaagtttagttttagggggagcatcattaattcattcaacaagtattaactgagcatctcccctgtgctgggtgctgcttggcatactgggggtttagtggtgtgagagagaccgagcctcagctcttaggagcacagtgctgatggaggacgaaaggtaaacacacacattagaagttattggataatgccaggcgttacgaagaaaagaagcagaacaaggcaatgtgacagaggatgattggtatcatggaaggtctctctgaggaggcagcatctgagctgagacctgaggaggggaagggccagtttatgcaaagatctgggggaagagctgcccaggcagaggggaccataattgcaaaggcccccaggaggaaatgagctccctgagtttcaggaatagcaaagaggccagggtggccagagtcaagtgattgagaggaagagatgagaacgatggcagggaccgggtcatgtgggtgccctggaaaggagtttagattttattctaatggcaacagaaggcattggagggtttaagtagggaaaggggagtgatctgatgtatgtttttaaacaattgcttctttaaattttgaggagattggattattgggaagcaagaatgaatttagggagagaagcaaagaggacgttgtgttggtttaggcaaaagacagcaatggcttggattggggtgatggaagtaacagtggcaggaagtggtgagcttggggctatgcttcagagatagagcagaaaggtcttgctgatgtatttaatacaggaggtgagggaagggaggaatcaacgataagtgaatcgtttgtttctagctgaaccactgaaatgtgtaggtaaattgagacttctgttttggccatcatgagtttgagatgcttatcagacacccgagtctgcagcctgggtgagaaatcacggctggagatgagacgtggtgagctgggagtgtttttggatgacagatgaggccacgggattgaataataggtatccttatgaagactgagaaaaggagagggctgggggccaagccctgggacagtgcaaccttcagaggatgggggaggagggccctgcccaagagacagagaggaagtggccagtgaggtagggggaagtccaggagaggacagtgtggtgaatacctaatgctttactcattcactggtgaatgaatggatggatggatggatggatggatggatgaatgcatgaatattccttaataatatggttggccatggtccatccatatgactcctacggacaccatgttaccatttcacactcgtcttctatttaggagaaatcagacgaaactgccatcttatatataggtcaaaaatggtttccataaccacccacctcacatgcttactgaaattcattaagtaatagatggggtggggggcgggaggtttacaggtcggcaaaggaggcaaggctagagtgatccatgtggcagtggattagagtggcaggcatcagtatgaacacatgtttagctcaatatagatacagatggctacatagagaaatatttatggatatgtgcatatacacaaattagtaagacacacgttactaatcctggctgtcagcgaagagagcctagaagcaaggataccccagtagcaacaaacctctggtgcccaggtctctgttctccaataaacaccattctccagtaaaaggaaccaggcttcttgaacaaatgtcgatcctaggaccgagggaggaaatagataagaagaacctgaagcatcttgtagggtcacagggtgaggaggcgcgaaatgaaacaaaatgaaactgctgcagtgatggggcatctcagagggacacaggagccaatggaaaagctcccaggggtcaaagccagaacaatttgagccccaaaaaagtactattggattagaattcaaagaataaatacccatgattccatactgctataaatgatcagataagagagaagagacaaatctcccaggcagaagaattccagattatttatttatttatttttatttaatttttttttttacacagggtcttgctctgttgcccaggttggagtgcagtgatgtaatcttggcttactgcaacctccacctcccaggttcaagcgattcttgtgcctcagcctcccgagtagctgggatcacaggcatgcgctgccacactcggctaattttttgtatttttagtagaggcggggtttcaccatgttgaccaggttggtctcaaactcctgacctcaagtgatcaccctcctcggcctcccattcaagtgctgggatgacaggtgtgagccaccgtgcccggccccaggtaaattatatagctattccatcgtcaaggaggtggagcggacttcccacatcctaagtgtgggctgtgcatagtgactctcttccaaagagtacagtgtgaaaagagaggagagagtaactttacagtggagaacacggacagacactacctcagccaggtgatcaaagtcaacttcaatagcggcaagtcatcttgagagaatgcgtgcctgatacagagtgctgagaatgattcttaagctctgtggtcctcctcctcaaaacacacacaagccaagactaaggatgagaagcatctgccaaatcccagttgaggaacattctacaaaatacctggccagcactcctcaaaatgctccatgtggtatcctggaacagaaaaaggacattaagcaaaaactaaggcaatcagaatcaactatggactttaggtggccaggcacggtggctcgcgcctgtaaccctagcactttgtgaggccgaggccggcggatgggttgagcccaggagttcaagaccagcctgggcgacatggcgaaaccccatctctacaaaaaatacaaaaaattagccaggcttgtggtgtgcacctgtagtcctagctactcgggaggctgagatgggaggatcacttgagtccgggaagtcaaggctgcaagtgacccgtgattgtgccactgtataccagcatgggcaatgagagtgagaccctgtctcaacaaacaaacaacaaacaaacaaacaaaaacaaattctctggggatggtagcaggcacctgtatttccagctacttgggaggctgagatggaggatcgcttgagccaggggaggtggagggttgaggctgccatgaactatgatcacaccaccacactccagcctaggtgacgagcaagaccctgtccccacccccctaaaaaaagtatggactttagttcataatgcatcaagctatggggtacatggaaactctctgtactgctttcaccatttttctaaaactgttctaaaataaaaaatttacttaaacatttatttaaaaaaaaaaacaaaccatttgagtaccaacagtgtcatatgctcaacttagcacatctttttcctggtttggtttgtgggcgtgaatgtgtactgagccatctaaaccttggttgcccgaccttcaccgtagccactgacccaggttaacagacaaaaggcccaggttaaggttatgcccagtggccataaaatagcccagcatccagactgcactccttgatgtacccaaaaaagccaaggaataggacggatgggcggggagtggggggcaaactactgcccattgcccaactctggccagctgtctgttttataaataaagttttattggaacacagtcacacccattcatttattatcatctatggctacatttgcatgacaatggcagtgttgagtagttgcaccagagatcgtgtggcccacaaaatatttattatctagcactttacagaaaaagcttgtcaacctccaggacagtggccacaagttctgccatcatctcatcccttagcaagaagggaaaggaatgcccattaaggcacaaattgttttctgttgttgtttgtttgtttgtttgtttttgagacggagtttcagtcttgtcgcccaggctggagtgcaatggcgtgatcttggctcactgcaacctccgcctcccaggttcaagcgattctcctgcctcaacctcccgagtagctaggattacaggcgccagccaccacatccagcaaatttttgtatttttagtagcgacggggtttcactatgttgaccaggctggtctcgaactcctgaccgcaggtgatccacctgctttggcctcccaaagcgctgggattacaggtgtgagccaccgtgcctggccacaaggtggtcttttaacaacagagcacacagctggacaaagcccaacgctctcttctttggggccgaggtgggtcattaatattgaacatttacaatgtacttgctccaggtgattcagtttaatttctgccgtctcttgtaacagggctcccacgtgcacgggttggggccgtgtgtctgcctctgctttctgaggccccacagcgtattgattctgcgaaacgtacgtttctttgaaaacagcgtctcttgacatgacaggagatcacacatcgcttgttttctgtccctttcattgccctctgaacatgataaaatcatgacctagtgtcaccgagggacctcagcatctcttggaaagaaggacttgccttcttttttatctttgtcaagccagtgaggccaagtagaaaatttttagcagctttggagccagacagatcggagtgcgagttctgcccgttattgactggaccgtgtgaccctgggagagccgcctagtgtctatgagacggaggctgttgggcaagaaaatggggatggtcccagcattatggggcggttgtgagaattcagtgcaatgatgcagtgctcccagaacagctggtctagggcttggctcatgggactgtcccttcgcagaggcagcgtggacattccgctggtatccactggtgtggctgtgcctgtttggtcaccgtgtctgttctgattggtcggtgctcctgcatgtcaagagttcaatgttatgaaaatcatccctgcctagagatgaattcccccttcccctgaggtctagactggtatagctgcttttggagcctcacctgctgagagctcacagctgtccttctctagagaatcaccctcagatgggagccacattgcctgggatgggatgccatgcccagtaatggcccagtgactaactgatacagcaacgtgaatggctggtccctgccccacggtggggacgatcctgtggcgtgctctctgctgctcgtgggataggtcaaggcgggactttaagggaccacattctcactctgctctgtccccttctgcatcctgtagtcctcacctcccttctcctgaaagcccctttcaaaacaaaaacaaaaaccacatccacccaagtccctgtctccagctctgcctccaggaaagccggcggaaggccgccagtctcagctgtgacagatacagatatttctgcatttccaggactgaggtcaatccctggggacccagtgaggcggtatctgaagggccatggagctggcttgatggggtctacaggtaggcagggacctggtggggatgtgactcaaggatttttatcaaatatctttatcccctgacagatgcaaaaaaaaaaaaatgagatcagactccagggtttcctccatgccacactgtggccccattgtttgttgtgctatcagcagaagttgattttgcaaggaatgtacacgtgtatgtgatgtttgaatgcacctatctgtgtgtgcgtgcatttgtgtgtgtgtgtgtgcattcgcttgtgtgtgtgtgtgtgtgtgtgtgtgtgtgtgtgtgtgtgtgtgtgctgaggatgtgagccccacttccggcccagtgcccctgcccaggctggctctgccctcctgctgctctgggcccctcaggcagtgactacctggtacatagggaaggcatcagcatcccttattcatggggactgtatactgtctccaccatattgggccttttggcctcttggacatgacttggcctctgctggctttaagggactgccagagatgccatcttctctgggaaatgttctcagcctgggcacagcccactaaccactgcctgcttgtctgagacttctctgtccaggaaaacagcccagcctgaccagagatgggcatagagccatattttgggaaagactggttgggggtcaacttggtttctggaaccagttctgatttcagttgcaggggacagtgagccagttactgcccactggctgcatcctaagccttcctagaggagagctagcctcctcctagggttgcccaggctggaccacttctgcctgggtgatgggttgggagaaagacgttaatatttggagcagtgttatattagtcagccctcccatttgcaaacattagaaaaccagctcaaattagtgataaaagaaaatctcagctgaattaaatttaaagtagtttaattgagcaatgaatgattcgcgaattgggcagaccccagaatcacagcagattcatagagactccagcgcagccacgtggtggaagaagatttatggacaaaagaagggaaatgatgtacagaaatcagaagtgaagtacagaatggctggattgttacaagttggcgtttgccttatttgagtacagtttgaacactcagcagcgtatgagcggttgaactacggcctctgggattggccaagactcagctattgttacaggcgcatactcctaagttaggttttcaatcttgtctacctattaagctaggttgcaatttgtccacaaggactcaactatagaagtacgaagtcccactcaggccatatttagttcactttaacactagcttcggcaactgtctctcagagcccagggcagggcagggatgcaactgggcttcaggaaacttgaattcattgactgtctcttccccatcttagatgcagtgctaagggctttttagtaattttctcatttgactctcaaaacaaactgatgaggaaacggtctgagagtagttaggcagcttttcaaggtcacacagatagtaaatgtcatcactgggacttgaactcaggtctttctgactctcatgtctgtgcaacatgtcatctcagccactgttgacactgtatatgtggattagggttggctaaactgctgtaacaaatagacccaactcgaatggtgcatgtatgtacaataggggtttatttcttatgatatagttcacggtggtcccaggtgaataaggatgggtaggtctgcatttttcataatcatctgggtttctgctcaggctcctagagtctctgccaccttccccatgtggcttccaaggccaccttggagacagagcttggtggagcacatgtggtaggattttttttgtttttttgagacggagtctcactgtattgcccagtctggagtgcagtggtgcaatctcggctcactgcaacctctgcctcccaggttcaagctattctcctgtctcagcctccctagtagctgggactacaggcacctgccaccacgcctggctaatttttgtatttttagtagaaatgggatttcaccttgttggtcaggttggtctcaaactcctgacctcaggtgatccacccacctcggcctcccaaagtgctgggattacaggcatgagccaccactcccagccagttctttttttcttttttccattttttttttttcgagacagggtcttactctgttgcccaggctggagtgcagtggcacaatcacggctcagcgcagccactgcctcctgggctcacacgctcctccggcctcagcctctcgagtacctgggactacaagtgtgagccagtttggctaattttggctaatttttgtagaaacggggtctcgccatgttggccaggctggtctccaactcctgggctcaagggatccaccttcctccccctctcaaagttctgggattaccggagtgacccactgtgccctgctggcaaatttcttaaactgtgcctcagtgacctcatttaataaagggaataattgtagcacactttttctagagctgtgaagattcaatggaataaataaggcaataaatgaatggatggggaatgaaggatgtgggtttcctccctcttgtctttcaataagctctcaccatcaacctcccattgcctgttctctctcttccccctctctccctctgtctctctcttagccaggaaacctggggtagggaggcttggagccagcgggtgcgtcgggaggctgcgggtactgactggggacgcgcacggagattgcgggagaaggatccacgccgcgggagaaggatccatgccgcgggagaaggatcagagtggagcctgtggctgctgcaggaggaggaagccgccgcctggcccacaccacaggagaagggcggagccagatggcaccctgcccaccgcttcccgcccacgcactttagcctgcagaggggcggagcgtgaaaaatacctcgtgcgcctcggccgactctacagtgcgacgggcggagcttccagacgctccgccccacgtcgcatgcgccccgggaaagcgtggggcggagcttccggaggccccgccctgctgccgaccctgtggagcggagggtgaagcctccggatgccagtccctcatcgctggcccggtcgcgctgtggcgaagggggcggagcctgcacccgccccgccccccctcgccccgtccgccctgcgccgcgcggggaggaggaggaggagccgcggcggggcccgcactgcagcgccaacgtccgagcgggcggccgagctcccggagcggcctggccccgagccccgagcgggcgtcgctcagcagcaggtcgcggccgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccttgcgagcccccctgcctctgcggcctagcgcccggcgccgcctgccgcgtcaactgctcgggccgcgggccgcgggctgcggacgctcggtcccgcgctgcgcatccccgcggacgccacagcgctgtgagtagcgggcccagcggcacccgggagaggccgcgggacgggcgggcgtgggcgcgttccctggcccgggacgggaagcaggacgcgggccaggacgctcccagggcgaggctccggcgcagcacagcggccctgctaaataaggaacgcctggagccgcggttggcacggccccggggagccgaaaaaccccgggtctggagacagacgtcccacccgggggctgtgcagacgccagcgggggcggggcgcggaggccgcgctcagctgggaggacaaacagtcgctaattggagaggaattgggatgcggcctggggctgcggggtacccggagaggtggggatggctgtagggggctgcagggaagagttccaggaggtgtctggacaaggatttgatggatgtgcaagaattgggctgatgcttaggaaggggcgatgaggtgggtccagaagaaggggggtgaacggtgtgagcaaagaccgtgaggctggaggctggccacgggaggtgtgaggggtaggggcagggtgggaggtgggctcgcgggtgggctggggtcatgaagggcctcaggcgctctgctattgggttccaaggctatcctgagaacaggggtgagggcggattgccgtggggggttaaagccttgtcatgttcgctttcgggagataaaaacaacaggtggcctttatggagacgctgcccagagccaggtctgtgccaggctcctgttgggggtcgtcatgcggaatcctgactctgaccatccgaggcatagggaccgtggagatttgcatttcacagatgaggaaacaggtttggagaggtgacacgacctgtcccaggcatcacagccaggacaggacctgtcccaggcatcacagccgggatgtgcatagcaggggtttggaactatgaggtgcccaggacccagggttggattgaaaagggcgcaggggactaagataagcagacagttgtccccagcgctggggagagtcttgggaccagtctgatgccttgtatttcccaggctccaggctcctcgccgggacagtgtctctttgggtgcgtgctggatccctgggggacgtggcacatccccaggcttgctaaacattgggtgggttctggcatttggttttgtaacgtttctgggtcactcccgcctgtggccacccttccttaggggagccgtgtgtccttggggctttgctgggtggtctcgagggtgggagaagaatgggttctcctggaccaatggagcccgtgcccctcggggccacattgctcctgcgctccctgactgcggacgcgtgtgtctcgcggctgtctctgtggagatggcctcctcctgcctggcaacagcacccacagaattgcatcagacctaccccacccgttgtttgtgatgctgtagctgagggctcctctgtctgccaggccggtcactggggactctgtccaggtcctggtggttcctgcttcccagcacctgatggtgtccatgagagcagcccctcgggagctgtccgggagagaagggcgctggtggctgctgagcggagagcaaggcccgtgttctccaggcccttggcacagcagtggagcccccgcccctgccttgtgttgtcctcttaggctctggtcctggggtttggaggagggggaccctgggggttggtggcctgtcccagcctgagctggcaagattccgaatgccaggcccctcaagtgtgcaacagggcacagggtgacctcatgtgggcaggtgggtgctgttctgtacacacctggggccgccgctgggagagttctggaaggtggggtgaggggacccatgggaaactagggccctaggaaggatgtgaaggccctggctggccccccaggccaccctctgtgctgtggggcagcccagccattttgctgtctaccctgcaaactcctcctcggggagacggctgggttttccccagggaagaggggtcaagctgggagaggtgaaggacacagatcacagctgctggcaggtgttcaagggtccaggagcgttgctgtctgggtgtcaccagtagccttcctggggggctcacgcaggtgcctctccacttgtggctccctggctgctgaagctcagcagggacagctgtgtccagttccaggtggaggacagccggggcttctgaggccacagcctgccttgggttaatgatgctgccgagaggtggtggcttttggaaaagatggcgtactgcaaaacgtgctgctctgcgtggctcgaagcttcgtggggagacgtgggcagagccgtggctgactcacagaccccccaccccagagcctgccctgccctccctgccccgacccttcccctcctgacccatgtgttttttttttttttttttgagacagagttcactcttgttgccaaggctggagtgcaatggcacgatctcggctcatggcaacctccgcctcctgggttcaagcgcttttcctgcctcagcctcccgagtagctgggattacaggcgtgcaccaccatgcctggctaattttgtatttttagtagagacagggtttctccatattggtcaggctggtcttgaactcctgacctcagatgatccgcccgcctcggcctcccaaagtgctgggattacaggcatgagccaccacgcccagccctgacccatgttttgaaccaaattccagccacccttttatctgcaagcattttggagggcatcgcaatactgcagacccacctaacacaacagacaattccttcatgccaccgaaggcctggtgtgttcacatttttggtttaatagtttgaattaagagccaaataaggtccacacactgcaattagttgatgtcttttttttttttttttttttttttttttgagacggagtcttgctcttgtctccaggccgcagtgcagtggcatgatctcagctcgccgcaacctccgactccctggttcaagcgattctcctgcctcagcctcccgagtacctggtagctgggtttacaggcatgcaccaccgtgcccagctaatttttgtatttttagtagagacggggttttaccgtgttggccaggatggtctcgatctcctgacctcgtgatctgcccacctcggcctcccaaagtgctgggattacaggcgtgagccaccgcacccggccaatgtcttttaaaaatatatactttttttttttttttttgagacagagtttcgctcttgttgcccaggctggagtgcagtggcgcgatctcagctcacggcaacctccgcctcccgggttcaagcgattctcctgcctcagcctctccagtagctgggattacaggcgtgtgccaccatgcctggctaattttgtatttttaggagagacggggtttctccacgttggtcaggctggtctcaaactcctgacctcaagtgatccgcctgccttggcctcccaaagtgttgggattacaggtgtgagccagcgcgcccagacaaaaatgtgtatgtgtgtctttaaggctggtcaagcaaagcagtggaactggagaaagaatgaagaattctacctggctgtgatcaattcgttgtgaacaccactgtgcttggaccagctagctgatgtcttttgttttgttttgtttgagacggagtctggctctgtcacccaggctggaggacaatggtgtgatctcggctcactgcagcctccacctcccgggttcaagcgattctcctgcctcagcctcctgagtagctgggattacaggcgcgcgccaccacgcccagctaatttttaaaaatatttttagtagagatggggtttcaccatgttggtcaggctggtcttgaactcttggccttaggtgatctgcttgcctcggcctcccgaagtgctgggattacaggtgtgagtgatgtcttttatttatttatttatttatttattttttattattatttgagatggagtctcactctgttgcccaggctggagtgcagcagtgccatctcggctcactgcaagctccgcctcctgggttcacaccattctcctgcctcagcctcccgagtagcctggactggtgcccgccaccacgcccagctaatttttgcatttttagtagagacggggtttcaccctgttggccaggatggtctcgatctcttgatctcatgatccacccaccttggcctcccaaagttctgggattacaggagtgagccaccgtgcccagccatctttcttttcttgctttctctttcttttctttcgagaccgggtcttgctctgtcgcccaggctggactgcagtggcacaatcatagctcactgcagcctcgacctccctggctcaagcgatccttcctcctcagccccccgagtagttggaactacagctccacaccaccatgcctggctgattctttttttccttgtagagatggggtcttgctatgctgtccatcctggtctcaaactcctggccttcccaaagcactgggattacaggcataagccaccacagccagtttccttttcttctttttaactggaatagttgactttttctttattagctgtgtgtcaggagggtatttttggcctttagtatgtcgtctaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcaccccagctggagtacagtgatgcgatctcagctccctgtagccttgacctctctgggctcaagtgatttttctctcctctacctcccgagtacttgggaccccaggcgcatgccgccatgcctggctaatgtgtatttttttgtagatacggggtctcactgtgttgcccagggtggtttcaaaatcctgggctcaggcgatccttccgtctcagctcccacggtgctgtgttaccggcgtgtgccccagtgcctggccgtcttggaggtcttgtttctctgggtttatgcctcaaggtggcgcctgctcccctgtgctccctggtagcctggtagtgagcctgcttctcacacagtcatacctggttgtggtcccacagtgggaccaccctgttgggttcagaacaggagatgggggcccctcgagtctgtgtgggggctgtggacagggttgggagaccttggctctgtgggggactgtggacaggggatggggggccttgtccctgcgtgggatgggttgggggtccgtgcccttcctggccctgggtggacaggtccaggtggcactcggcatagggctgagatgggtgcagagggctgaggcccccaggcctctcccggcttggtttccccagatgagtgttcatttgggtcttccatcagaaaggcccctcctgacctctgggagtggggagctcaagggtgggaggccatagcttggggatgctggcaatgtgtgggatgggcccagggatggcctctggcctactaagggctctggccctgacccacggccactcactcctcagagacgtctcccacaacctgctccgggcgctggacgttgggctcctggcgaacctctcggcgctggcagagctgtgagtgtcccccagtcgtgccagcatgcggggctcactccgggtgggctggcggcaccgcctcttgctgctcagctgtgggggcttccgtcagctttgccgaatcccccctctcttccagggatataagcaacaacaagatttctacgttagaagaaggaatatttgctaatttatttaatttaagtgaaatgtaagttgtggttctttgggtggggtcctggctggaccccaggcccccagtatcccttctgccctcccagttggtccgtgtccccttccaggcttgagaccagatcctgggggcagttcactacctgcttggagccccccagtgccggcttggttggggcaggggaggcggtgctgtcagggtggctccagggcctggttgccagtggggggctggcatagacccttcccaccagacctggtccccaacacctgcccctgccccgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggcagctctgtccttcccagccaggtgggacctgggccctgcagacactgggcagggctcaggaaggcctctctggggggggcctccgggccaagggaacagcatgggagcctgtgagtgcggcgggcggatgggggggtgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctccttcgcctgcctgtccctctgctccggccccctgccgcctcctgcccccacctgtaggagccccaccctcctccagcacgtcttccctgcctccccaggggccgccctggtggggccccacggacccctggcctccggccagctagcagccttccacatcgctgccccgctccctgtcactgccacatgctgggactttggagacggctcccccgaggtggatgccgctgggccggctgcctcgcatcgctatgtgctgcctgggcgctatcacgtgacggccgtgctggccctggggaccggctcagccctgctggggacagacgtgcaggtggaagcggcacctgccgccctgaagctcgtgtgcccgtcctcggtgcagagtgacgagagcctcgacctcagcatccagaaccgcggtggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaatgggcactgctaccgcctggtggtggagaaggcggcctggctgcaggcgcaggagcagtgtcgggcctgggccggggccaccctggcaatggtggacagtcccgccgtgcagcgcttcctggtctcccgggtcaccaggtgcctgccccaccccccgaggggccataggttgggagatctctgaagcagtggggcagagcctgcggctggggagtctcaggaggagggaggtgggagctgggccggccctggtgagcaggtggcgccggccggtggggccgttcctgtcagctctgcagatgcagaggtggacgcgagctgggggcagcctccggacactcctgggcacgccatacgggaggtggcctgcacggggatccctgccggtgcccacaggccccgtgggtgggtgctgctgtgagcctgggctggtgggccctgctctccgggctctgagcctcagtttccccatctggaaagggggacagtgacggggctcccagcgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagctgagcactgcgtccggctcgggcccaccgggtggtgtaacaccgacctgtgctcagcgccgcacagctacgtctgcgagctgcggcctggaggtgtgcggggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgtagggacccctgatgcctctggcacggcagtacggcctctcagccccgcacgagcccctggaggtagtcggccccccacgttctataacctgccctcctgcctgcccctggaggcctcgcctgccctgcccactgtgggtctcgccaaaaaacttgggggccttaatgttgcttgtgcccagtgaagatggttgggaaaatccagagggcagagaggaaagcgtttactcacattacccccaggccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgggaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccatgggcgaatcagggccccaacaccctcccctcctcgcagggaccccggagaacggcagcgagcctgagagcaggtccccggacaacaggacccagctggtccccgcgtgcatgccagggggacgctggtgccctggagccaacatctgcttgccgctggacgcctcctgccacccccaggcctgcgccaatggctgcacgtcagggccagggctactcgggtccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcccttgcccctctcccagtgggagaagctctcgcctgggcccttggcacgagctgtgcctcctcttcctctctcccagcacagccgctccttcctgtctgtcaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggcttgctggcctgggggcagtgtcagcgcccgctttgagaatgcctgccctgccctggtggccaccttcgtgcccggctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcagcagcccagttactggggacgtcggccccgggcaggtcctgctggctggctcctcaggctacctggtgggctttaaattcctggaaagtcacggctctgacagcggctccgctaactcattccaccgtctcatttcacgaaatgaatttaaaactccgctccctgacctcacacgagtccccgtgagtctctcacgccctctgctgtgttctcgcctggctaaagcaagtggcttttgaggtggagtccgaacccctgatgggaaactgcgggctgcccgcggtgccaccatgctgggtacatgggggacagggctgttccatcttgcgggtacctgccccttcaccaggggccttgggaggggccatgagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctctcatggcatgcagagccccgggcacctcctctcctctgtgccccacgtgggactctccagcccgacgggaggtgtgtccaggaggcgacaggctaagggcagagtcctccacagagcccaggctgacaccagtccccccgcagaggtacagccccgtggtggaggccggctcggacatggtcttctggtggaccatcaacgacaagcagtccctgaccttccagaacgtggtcttcaatgtcatttatcagagcgcggcggtcttcaagctctcagtaggtgggcgggagtggggaggggaggggatggggcggggcgggggcgggctccaccttcacctctgccttctgctctgcttcatgctgcccgaggacgctgccatggctgtggtgagtggagggagggacgccaagcagggcaggcctctcacctgccacctgggcccactgatgcctgtccctgcagctgacggcctccaaccacgtgagcaacgtcaccgtgaactacaacatcaccgtggagcggatgaacaggatgcagggcctgcgggtctctacagtgccagccgtgctgtcccccaatgccacgctggcactgacggcgggcgtgctggtggactcggccgtggaggtggccttcctgtgagtgactcaggggccggtttggggtgggcaccaggctcttgtccgggcaccaggctcttgtcccggctccagcctcagccgagggaccccacatcagggggttgcttttctgagcctcggtttccctgtctgttgggaggtactgggtgcacaggagccctgaggctgcacgggagccgggagaggcctcagcacagccgggtgggccctgaatggaggcccggggcgtgactgcagagtggagcctcggctgggtcccaagcaccccctgccccgccaccgcgcacctgtgccccgccactgcgcacccctgtcccggttcactcactgcctcccaccgccccggcaggtggacctttggggatggggagcaggccctccaccagttccagcctccatacaacgagtccttcccggttccagacccctcggtggcccaggtgctggtggagcacaatgtcacccacacctacgctgccccaggtgagggatgagggggtgagggggccactgcctttcaggctctgagcacggggcccccccagtcccccagtcaagctgccccgcttcctccccaacagccctcactgtgacctcacctgggctgatggcttaggcccctactggggtgagggaggggccaggcgtgggaggagtggacagggaagctgggccccctgaactgccccccaccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggcgcagccgttcaccccgggctcctcaggcggggggcttctgccgagcgggtggggagcaggtgggggtgccgcggctgccccacttgggcctgtccccacaggtgagtacgtcctgaccttgctggcatctaatgccttcgagaaccggacgcagcaggtgcctgtgagcgtgtgcgcctccctgccctctgtgagtgtgtgcgcctccctgactggggcctgctggtaccccagagtgggtgtctgttccccagtccctgctttcctcagctggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccccacatacgtctgttcccacacgcatccccccaggggccctcagtgagcattgcctgcctcctgtcagggtccagctggctccagtacaccagaacacacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgccgcctcttcccactgggcgctgtgcacgctctcaccaccaaggtgcacttcgaatgcatgggtgagtgcaggcctgcgtagggggagcagcgggatcccccgactctgtgaggtcacggagccctcccgtgatgccgtggggaccgtccctcaggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccgggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctctccccgccccgcatgcctgccagggtactgggttcagccccccagggcagacgggcagcttggccgaggagctgagcctccagcctgggctccttcctgccatggcgttcctcggtctctgacctgcttcagtagcctcagccattctgctgtcctgtgtgaacgcagggtgcctctcgggggacccagggtgtaaagaggggcccagatgtggggagggactaagaagatgctgctctgtgccctccactctcccctcccctcccccttccctcccctagcccctcccctccccttccctcccctaacccctcccctcccccttccctcccctagtccctcccccctcccctagcccctgcctcctcccccagcccctcccctcccctagcccttcccctcctcccctcccctagaccttcccctcacctctccccctcccctctcccctcccccttctctcccctctcccctctcccctcccccttctctcccctccccccttctctcccctcccctctcctctcccccttctctcccctcccctctcctctcccccttctctcctctcccctctcctctccccccttctctcccctcccctctcctctcccccttccctctcctctcccccttccctctcctctcccccttccctctcctctcccccttctctccccttccctctcctctccccttccctctcctctccccccttttctccactcccctctcctctctcccctctcccctcctcctcctctcatgtgaagaggtgccttgtgtggtcggtgggctgcatcacgtggtccccaagtggaggccgtgggtcatgcagagccacagaaaatgcttagtgaggagactgggggggtccagtcaagtgggctctccagctgcagggctggaggtgggagccaggtgaggacccgtgtagagaggagggcgtgtgcaaggagtggggccaggagcggggctggacactgctggctccacacaggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggtgccgcggcccgtgccccacgccacccgcccgccccacgtggcccgtccgccccatgccgccctttcctctgcctccctcctccccacaaccgcctcgcctttgccccatcccatcttcgtccccctcccctccccccaattcccatcctcatccccctcccccaattcccatcctcatcccgctcccccaattcccatccttatccccctcccccaattcccatccttatccccctcccccaattcccattctcctccccctcccccttccctattaccatcccttttctccatctctctccccttttctccatttcccccccgatcctccccgtccttttgtccattcccctcatctttcttatcccccttatcctccttcccctcccttatcccccttcccctcccttatccgccttatccccttcccctcccttccccctgctcctcttcttctcccctttctcttttctctacccttttccttcctttttcctccctctccccatcatccccctcatcttcgtcctcatccccatccccttccccctccccctccaccactctctctccagcttcccccttccttctgcctgcacctcgctctctgccccctcaggttccccctttctcccagtccccaccctccggctccccctttttgcctgcccccaccctccctctgcctccctgtctctgcactgacctcacgcctgtctgcaggagacctcatccacctggccagctcagacgtgcgggcaccacagcgctcagagctgggagccgagtcaccatcgcggatggtggcgtcccaggcctacaacctgacctctgccctcacgcccatcctcacgcgctcccgcgtgctcaacgaggagcccctgacgctggcgggtgaggagatcgtggcccagggcaagcgctcggacccgcggagcctgctgtgctatggcggcgccccagggcctggctgccacttctccatcccctaggctttcagcagggccccggccaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgcctcaccgtgaaggtgcccaacaactcggactgggctgcccggggccaccgcagctccgccaactccgttgtggtccagccccaggcctccgtcggtgctgtggtcaccctggacagcagcaaccctgcggccgtgctgcatctgcagctcaactatacgctgctggacggtgcatgcagcggttggggcacacgcggccccctggccttgttcttggggggaaggcgtttctcgtagggcttccatgggtgtctctggtgaaatttgctttctgtttcatgggctgctgggggcctggccggagaggagctgggggccacggagaagcaggtgccagctctggtgcagaggctcctatggcctttcaggcccatggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgcgggccggcctggcagggcagggcagggcatcatgggtcagcattgcccgggttacgggccccgtggggacggcaggcagcgaggggactggaccgggtatgggctctgggacttcgacatccaacctggcggagcctgggctcacgtccactgccccttcccttcccaggaccagagacccagtggggagttaccgtctgaacctctccagtcacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgtgagtgaccctgtgctcctgggagcctctgcagagtcgaggagggcctgggtgggctcggctctatcctgagaaggcacagcttgcacgtgacctcctgggcctggcggctgtgtcttcacaggagccaacagcggatgtaaactacatcgtcatgctgacatgtgctgtgtgcctggtgacctacatggtcatggccgccatcctgcacaagctggaccagttggatgccagccggggccgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggaatgagtctcgtcgcaggcgtcagaacaaggcagtttttgcagtactgtgtgaagggctcgtgtgttcatcctgggaatgacctcgtgagcactcactgtccctgaggactaggacagctcctagctggaagtaggtgccagtcagtcagggtgggcagcccacgttctgcacagtagcgtggccccacaagtgacatgagcatcgctaccactgtgggagaccatgcatccacccgcgatcctgactgcatagctcgtctctcaggcggaggtgccagcaccctccccgtggctgtttcttcaatacctccattttcctttattggaattgcccttctggcattccctttttgttttcgtttttctttttttggagacggagtctcgctctgttgcccaggctggagtgcaatggcgtgatcttggctcacagcaacttccagctcctgggtttaagcgattccccttaagcgattctcctgagtagctgggagtacaggtgcacaccaccacacccagttaatttttcaccatgtcagccaggcgaactcctgacctcaggtgatccgcctgcctcggcctgccagagtgctgggatgacaggtgtgagccaccacacctggccgtgttcccattttttatttccatgctgctttcatcttcatttcccagttctttcttttgattacctacttttaaaaactgtcggccgggcgcggtggctcacacctgtaatccgagcactttgggaggctgaggcaggctaatcacggggtcaggagatcgagaccatcctggctaacggtgaaaccctgtctctactaaaaaatacaaaaaaattaggccggcgtggtggcaggcgcctgtagtcccagctcctcgggagactgaggcaggagaatggcgtgaacccgggaggcggagcttgcagtgagctgagattgcgccactgcactccagcctgggtgacacagcaagactccatctcaaaaaaaaaaaaaaaaaaaatactgtcacctgggtctgtcactgggagaggaggtgacacagcttcacgcttcgcagtctgtgcatgaactgagggacgggtgtgtggtgcaggtcaccggttgtggcgtgactgaggcgtggacaggtgtgcagtgcgggtcactggttgtggtgtggactgaggcgtgtgcagccatgtttgcatgtcacaagttacagttctttccatgtaacttaatcatgtccttgaggtcctgctgtttattggacaaattgcagtaaccgcagctcctcgtgtatagcagagctgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcccggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctatttcactcacatccagagggccacctgctgcgttctcctcatctgtctcttcctgggcgccaacgccgtgtggtacggggctgttggagactctgcctacaggtgggtgccgtaggggtcgggacagcctcttcctgcccagcccttcctgcccctcagcctcacctgtgtggcctcctctcctccacacagcacggggcgtgtgtccaggctgaacccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcacgcctgtaatcccaacactttgggaggccgaggcgggcagatcagttgaggtcaggagttcgagaccagcctggccaacacaatgaaaccccatctctactacaaatacaaaaacagctgggcatggtggcgggcgcctgtagtcccagctactcgagaggctgaggcaggagaatggcatgaacccaggaggcggagcttgcagtgagccgagattgcgccactgcactccatcctgggcaacggagcaagactccgtctccaaaaaaaaaaaaaaaaaaaatcccacaaagaaaagcccaggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgatggccgggtgtggtggctcacacctgtactcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactaaagaggctgagccaggacggacaatcgcctgaacgcgggaggtggaggttgcagtgagctgagattgcgccagtgcactcctgcctgggtgacagagcgagactccatctaaaaaaaaaaaaaatgaaatttaaaactctgttccttagctgcaccagtctgctgtcaagtgttcagtggcacatgtcgcgaggggctgccatcacggacggtgcagatgtcccatatatctagcattctagaacattctgtcagatggcaccgggctctgtcctgtctgctgaggaggtggcttctcatccctgtcctgagcaggtctgagctgctgcccgctgaccactgcccttgtcctgcaggtggctgggagcccgagccccacacctgccgggcagcaggtgctggacgtcgacagctgcctggactcatccgtgctggacagctccttcctcacgttctgaggcctccacgctgaggtgagggctctactgggggtcctgccgccttggcgcagcttggactcaagaccctgtgcacctctcagcaggcctttgctggacagatgaagagtgacttgtttctggatgattctaagaggtgggttccctagagaaacctcgagccctggtgcaggtcactgtgtctggagtgccgggggtgtgcgggctgcgtgtccttgctgggtgtctgtggctccatgtggtcacaccacctgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttagccggacctgctcagtgacccgtccattgtgggtagcaatctgcggcacgacccccacttactgggtctctccttttacaaccaacacaaccgaaatctagggcttcttctttttttttttttttttttgagacagagtctcattccattctgtcacccaggctggagtgcaatggtacgatctcggctcactgcaacctccgcctcccaggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacagacgtgagccaccatgcccagccaaatctagggctggaacatggctgcagcatataaatagaattgaattccatagttttgttaaccctgttttttgtttgtttgtagttgttgctgtttttgagacagagtctcgctctgtcgcctaggctggagtgcagtggtgcaatctcggctcactgcagactctgcctcccgggttcaaactgttctcctgcctcagcctcccaagtaggtgggactacaggcgcccaccaccacacccggctaatttttgtattttattagagacagggtttcaccatattggccaggctggtctggaactcctgaccttgtgatccgcccacctcggcctcccaaagtgctgggattacaggcgtgagccaccacccccagcccctgttttgtttttgttttgcttgtttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagtttgggcacactctgtgtgatcgggcagaaggcctgtgggaagtttagctgaggacagggccaggaaaggtgatggacagtgggggtctgtcctggtcaccaggcccctgggtcctgcccacctgcttggagctccccacccatcacacatgatgctgccaagccctctgggtattgtgggcaaataccttaggagagaagctgatgagctttgtttcttgaaatgcacagattccttggacatccctgagaggccagtcatgaaagtcagcttggttttctccccctcatttgggttcagaatttaaagtccacacacacgggcagtaagataatatagataaggacatcatcactcggtttcggatgttaaaatgtctaggtgggttaggggtgatttgagatcacgcaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaaatcaggtttgtgaaggttccagagaggacctggccttgggaggagcgtgggggactgagatgggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctccctctaattgctcctaagcctcacgctcccttgccccgcgtgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccttcccctccccctcccctccccctccccaactcagatccggcccggtccccgtccccttccctcccccctgccctaagccacctccacctctgtcctggccacctccgggtgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggccgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggccccgctgcactcttgtctctaacaaacaaaacggaccaaaacaaagtgaaatgtcatttgatttgtgtcatctggtttgatgacttttttttttttttaagacagagtctcattctgtcgcccaggctggagtgcagtggcaagatctcggctcactgcaacctccgcttccggggttcaagcaattgtcctgcctcagcctcctgagcagctcagattacaacgcctggctaatttttgtatttttagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttttttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtcaggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcataggttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaattttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtattttttttttttttttacttatgctgagctttaaatgacaaagattcatataatccaagagagaagtattatttagagggattcttttaccatgtgatatataataaatgcatccaatgttatacatcaatttaaaaaacaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatggcaaaaccccatctccacaaaaaatacaaaaatttgctgagtgcactgtcaggcacctgtactcccagctactcaggaggctgaggcaggagagtcacttgaacctgagaggcagaggttgcagtgagccgagagcacaccactgcactccagcctgggtgacagagtgagaccccatctcaaaaacaacaaacaaaaacaaaaaaaatggccgggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagagggtcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggagagagatccgtatgtcaaaagtctgtacttggtaagaatttggctgctaagttgtggcataatttgtcttttgagccttttttcctttgggtaagttgagctctacattttgtcttgccattcatgacagtaaaaatgtggttgtgtgggggctgaacctccttctgaacaatgatccaagataaaagtactaataccacaatgctttttgatattcaagggaagaggaagtatgtttcagttttaccgcctagataattacacgtcatttggcactgcctttcaagatatgtggaaaacagaaaatatatgagttatgaagatatctaggcacatttaacattctctatgccacttagtcctgaacagagaatttttggtataaattggaggaagctttttttttttttttttcttttctcacccccaaaaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagcgtgagccaccacgtgagccaggggaagtttttaaatttaccactttttaacaattccatttaggaaagttcagttgagctgttggacttggacaactttgtacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttttatcctatgtgcagaaatcaggaaaaaacaaattctacaaagaatttgaaagatattatttcaggccaggtgtggtggctcatgcctgtaatcccagcactttgggaggctgaggcaggtggatcacttgaggtcaggagttcaagaccagatgggccaacatagtgaaatcccatctctactaaaaagacaaaaattagccaggcatggtagcaggcacctgtaatcccagctacttgggaggccgaggcacaagaatcgcttgaatctgggaggtggaggttgccgtgagccaaggtagcgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcattaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattaattacttccttttcaagttgtgaaacatgttaacctgtggtaaaatacttacaagatgataattaccatctaaccgtgttgaagtgtacagttcagttgtgtgaagtatattcatgtcattttttttttttttttttgagacggagtctcactctgtcaccaggctggagtgcagtggtgggatcttggctcactgcaacctctgcctcttgggttcaagcagttctcctgcctcagcctccggagtagctgggactacaggcgtgcgccaccatgctcagctaatttttgtatttttagtagagacggggtttcaccatgttgcccaggatggtctccatctcttgaccttgtgattcacccgcctcggcctcccaaagtgctgggattacaggcgtgagctaccgcacctggcctatatttttttttttttttttttttgagacagagtttgaattttgttgcccatgttggagtgcaatggcacaatctcagctcaacacaaccttttcctgctgggttcaagtgattctcctgcctcagcctcccgactagctgggattacaggcatgcaccaccatgcctggctaattttgtatttttagcagagacagcgtttctccatgttggtgaggctggtctcaaactcccgacctcaggtgatccgcctgcctcggcctcccaaagtgctgggattacaggagtgagccaccatgccagcctcatgtcattcttgtgtggtgtgtgtgtgtgtgtgtgtgtgtgtgtgtgtgtgtgtgtgagacagagtctcattctgtcactcaggctggagtgcagtggtgtgatctcggctcactgcaacctccacctcccagcttcaaacggttctctgcctcagcctcccgagtagctcggattacaggcgcccactgccatgcccggctaatttttgtatttttagtagagatggggtttcaccatcttggccaggctggtcttgaactcctgaccccgtgatccaccctgcctcggcctcccaaagtactgggattatacgcatgagccaccgtgcccagccgtcattcttatattattatttcctaggtgtctttcctgaagactatcttcccgtctcaaaatggacatgatggatccacggatgtacagcagagagccaggaggtccaaccgccgtagacaggaaggtatggctctgttggagtccccatagtgtggaaatgagtttgccctggaaagggaaagaacagcttcttgccctcaggtttctcaccttctcctctcctcactctcaccaagggctgaggtccgtttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttctacaatatttgtggcaaattcagtgggttcaaaattgagcttgtcctttctgcttcattagtttaagctgtataattcctttcccttcctacattcttgtttgtcattttttcaggggaagaggagttgctagtactggcattggttttcctttctctctctctttttttttttttttcctgaaatggagctttgctcttgttgcccaggccgtagtgcaatggcacaatctcagctcactgccttttgggttcaagcaattctcctgcctcagcctcccaagtagctgggattacaggtgcccaccaccacgcccagctaatttttgtatttttactagagatggggtttcaccatgttgtccagactggtctcgaacttctgacctcaggtaatccacccgcctcagcctcccaaagtgctgggattagaggcgtgagccaccacacccaggctttttttttttttttaattttgagatagagtctcgctctgtcgcccaggctggagtgctatggtgcaatcttggctcactgcaacctctgcctcccagtttgaagcaattctgccttggcttcccgagtagcttggattacaggtgtgtgccaccacattcggccaattttttttttttttttttttttttgagacagagtctcactctgtcacccaggctagagtgcagtggcatgatcttggctcactgcaacctccgcctcccaggttcaaacgattcttatccctcagcctcttgagtagctgggactacaggcatatgccaccatgcccagataatttttgtatttttagtagaggcggggtttcaccatattggccaagctggtctagaactcctgacatcatgatccgcacaactcggcctcccaatgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaactcaatgcttgggtcacctccagattcattttcacagtctttcatgttttggtcatactacattgtattttgctgccatatgactgatctttttttgttaaatgtgagatacttgttaaaaaatatttaacaatgaattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatgggttttatattctgtttggtgtcccccattgttctcatctgagatcagaagcttcagatgcacttatgtcaactcaagagtagaatgcttccttagcctccctccagagtcaggttttgtgtttctagttcccaagtgcacagcaggagtagtgatgtcctcactggcttctcatttgcattaaactgtgagcttctttagcgtggggacaggaccctgctcccattgcattgtcagcacctcaccacacacaccttgtttgaggccactccagacagcatgtgctgaaggatgccctgtggtcagaaacaagttcattaactttctctttgaagtgttttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaactgaaccttgttaaagtcagtcaacaccagggtggatggtttgccgttgtcacctattttcaggacataacatcctgacttaggagccattccgatcatttctaattcaatagatgcacccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggagaagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgatttttttttgtccctcaatgggaggtgtccattcttccttcggttgtgagaatcagttggttcatttgtgggaaggttgcaggggggatctttgaatcagccttcagatgccagaagggcagagggaatcccacacgtgctggtggatcatgtgtgtgcatttctctcccttctagtctgaggaaactaagcatgaaagaacgtgagcacggagaaaaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcaggcagtaagcaagaggaggaatcaatatagcaacagtttggatcagactgtacagtttttttgtttttgtttttgtttttgtttttctgagatggagtcttgctgtgtcacccaggctggagtgcaatgacgtgatcttggctcactgcaacctctgcctcccaggttcaagtgattcccctgcctcagcctcccgagtagctgggattacaggcgcctgccaccacccccgcctaattttttgtatttttagtagagacggggtttcaccgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaaccgtgttgcgcaaaaacaccttcatccccacccagtggggcccccatctaatattctaagtgtcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattgcacgcgatgggacttgtacacttgaaatgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgcggagtgtctgctctatccccttccaccctcagcggatgataatctcaagacacctcccgagtgtctgctcactccccttccaccctcagctccaccctcagtggatgataatctcaagacacctcccgagtgtgtctgctcactccccttccaccctcagcggatgataatctcaagaaactaaggaagaataaataaataatataaaaataaaatgaatactgcagtccttatgttattgctttgtttcaatatctggtatgattgcctgagggacctgaggtttttaatcgtaggggtttttttaatctttagaagtggttggttatgtaaaatattattatttgtttttttttttgagactggagtttgctctgtcacccaggctggagtgcagtggctcgatcacagctcactgcagcctcaacctcctgggcttcaagcaatcctcctgccccagcctcccaagtagctgggatcacagatgtgtgccaccacgcctggccaatgttaaaaaatcctttaacttttttgtagagatgcactcctggactcaagcaatcctcctacttgtcccgaccaccagcctctttctgataaacatttacactgtttattatctgatgccatttctatcttcttccttgtcatccagacatcaaagaattaggtttcttcagggttttctttttcaagtgctcagtgttaaagatcactcacattagggccagacaccacggctcatgcctgtaatcccagcactttgggaggccgaggcgggcagagcacttgaggtggggagtttgagaccagcccggccaacttggtgaaaccccacctctactgaaaaaatacaaaaattagctgggcgtgatggtgcatgcctgtagtcccagccacttgggaggctgaggcatgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagacttggaagcagtggttattgcaacaggggcacggaagtcatctggctatgccagggtgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaaactctctcctggccctcctctcttgccagcactatgggtgactgaagacccccagggaggcacagcatcctcttatctaagatttttttttttttaagagacagggtctttctctgtcgcccaggctggactgcagaggcacaatcatagctcacggcagccttgaactcctgggctcaagcgatcctcccacttcagtgtcccaagtagctgagactacaggcacacgccagcatgcctggctggttttttaatttgtatttcctttgagacagcgtatctctctgttgctcaggctggagtgcaatggctcaatcagctcactttagccttgaactcccgggctcaagtgatactgccacctcaacctcccaagtctgctactacaggaacacaaactccttttttaaattttttgtggatatggggtctcactatgttgcctaggctggtctcgaactcccaggctcaagcagtcctcctacctcagcctccacaaatgctgggattacaggtgggagctactgtacacctggccttatctaagctgtttccctgaaaatccccgtcttgggtaatgattccattggccccaccatgccctctgccttcctggctgtgcccaagcttggtccctgcctgcctgcctgcctccctctctgggtctcgagctcctgtgacacatgactcctctctcttcctagtgatccaagccctgccacttcctgactttgcccacactgtaccctctgcctggggcaacttcatgtctgcccattgacccttaggcctcagcccaggcacaagcccctgcctccggaggtcatccaggcctcaccaggctacaccctctcgtaaaattggattccctcccttcagggcagctttataatgaaatcctcctcagaggccaggtgcggtgacacccatctgtaatcccagcactttgggaggctgaggtgggaggatcacttgaggccagggggtcgagaccagcctgggcaacataagagagactcttgtctctataacaaatttaaaaattagctcaccaggccaggcccagtggctcatgcctgtaatcccaacactttgagaggccgaggcaggtggatcacgaggtcaggagttcaagagcagcctgaccaacatggcgaaaccctgtctctactaaggagaatcgcttgaacccaggaggtggaggttgcggtgagccaagatcacgccattgcagtccagcctgagcaacagagcaagactctgtctcgagacaataaaaacacataaaaaattaactcgccatgatggcacatgcctgtagtcctagctacttgggaggctgaggtgggaggattcccttcagcccaggagtttgaggctgcagtgagccactatgattgtgccactgcactctaacctgggcaaaagcgagaccccaggctagagtgcatgattttgggtcactgcaacctccacctcccaggttcaagtgattcccctgcctcagcctcttgagtacctgggactacaggcatgtgccaccacgcctgggtaatttttgtatttttagtagagacagggtttagtagagaccatggtgaaaccccatctctattaaacaaatctctactgaagatttgctgtactgaagggatagcaaaactcagttaccaaaatggcaatgtgtttgaactgtttacaggccaagaattcacatttgcaacccacgcaatacactactgattgtgtgacttcctctagagagaatgtcaaaagttacaatgtgatggcttttatgaatgtgagatgaggcccagtgtgccttctcctcttcggtttgtgcctcaatgatcatcacctcccaaaacatatgctgagctcccagcttccaggcactgtcccaaaagtggggtgtcagtgggaacccaagcaacagacaatatagagtctcgcacctcatagaactcattttctccttgcttctttttctcaccttttttttttttttttttttttttgagatagggtcttaccctgtttcccaggctggagtgcagtggcacaatcatagctcactgcaacctcaaatgcctgggctcaacgtagcttcctgcctcagcctcctgagtagctgggactacaggcacccgccaccatgtccggctaatttttctttctttcttttttttttttgtatttttagtagagatggggtttcatcatgttagccaagatggtctcgatctcctgaccttgtgatccacacaccttggcctcccaaagtgctgggattacaggcatgatccaccgcacctggccctgattttaacttctcttttttctttttttttttttttttttttgagacagactcctgttgcccaggctctggagtacagtggtgcgatcttggctcactgcaacttctccctcccaagttcaagcgattctcctggctcagcctctccagtagctgggaataaaggcatgcgctaccatgcctggatcattttggtatttttagtacagacggggtttcgccatgtgggccaggctcgtctccaactcttgtcctcaggtgatccgccggcctcggcctcccaaagtgctgggattatagccatgagccaccgtgcctggccttgatttttagcttttaactttgaaataactacagactttgaaagaagttgcaaaaatagtacaaagagttaccacatactcttcatccaagcttcctgaaatattgatatcttacatgaccatagtacaatgatcaaaacaaggaaataagcacggaaatcatacacgtacctaatctacagatcttattcaaatgatcaccgatcgtcaccctaaggttctttgttcccagtctggcctccaatcccagattgcttcacattgtgttgaactgtcaaatggccttagtctccaagtgagatcactaaccggctattctgtaggctgtccctcagtttatcaacccagttgttatgggctaaatgatgccctccaaaattcatatattggagccctaatttccagtacctcagaaggcgactgtgtttgaagataaggcctttaaaatggcaattaagttaaagtgagacctttaggatgggctctaatccaatctgtctggtgtccttataagaagaggaaatttgggggcatggttggtggctcacacctgtaatcccagcactttaggaggctaaagtaggaggatcacttgaggtacgaagatcacttgagaccagcctggccaacatggtgaaaccccatctctactaaaaattagctgggtgtggtggcacatgtctgtaatcccaactacttgggaggctgaggcaggagaatcgcttgaacctgggagagggaggttgcagtgagaggagatcgagccactgcactacagcctgggtgacagagcaagattccgtctttaaaaataaaataaaataaaaaaaaaatttggacacacaaacaggcaccaggggccgggcatggtggctcatgcctgtaatcccagccctttaggaggccaaggcaggaggattgcctgagctcaggagttcaaaaccagcctgggcaacgtagtgagaccctgtcactctctctctctttttttttatttaaaaaataaataaataaaacgaggcaccagggatgttttcacaccaaggaaagaccatgtgaagacacagcaagaaggcagccgtgtgaaactaacccagcaggcaccctggtcttggacttcttgcctccagaagggtgagcaaataagtttctattgtctaagccacgctgtgtgcgctattttgttatggcagccccagcaaactaatatatccattctcttcagttcttggaaatctgcccatttctatgttctctgaccctttttatctgcccgtttattgatttatagccttctccggctccttatccttgttactggtccggagtaaacttctgttagatttctcccagctgggcaggcttccagctcaccaaaacatctccttctttgctttttacttatatcccccttgtatcatttttccatggctgaggtaacaaattaccacgaatttaatggcttaaaagaacacaaacttcttgtcttagaatttggggtgtcagagtctaaaatgggtctgcaggactgcattcctcctggaggtcctaaaggagagttcattttcttgcctcttccaagcttctagatgctccctgcactccttggctccccatccaacatcttcaaagtcagcagcataaatcttcccatctccctttctctctcttttttttagacaaagtcttactctgtcacctaggctggaacgcagtggtacagtcatagctcactgcagcctcaaaccccgaggctgaagtgatcctcccgcctcagcctcacgagtagctgggaccacaggcatgcaccaccatgcctggctgatttttaattttttatagagacaggctcttgctatgtcaccagggctgtcttgaatttgggagcccgcgatcagaagccagcatggtcggcagctccctacaccacgtccgggcttcccgggcctccagctgccccctgcgccgccgccgcctcccgcacctgcacgtggccactccagatgctccggagggattgagcaccccgcgcacacccagctcacaccatccaatccggaggccatgggccgacatgggggctgagcgtttgaaatgagcccggaccaccagatgcatgggtccgttcacacgaaatacccagaacaggcaaagccacagaggcagaaagtatggggttatttattttaattaattaattaattgttttgagacgtagtctcctctgtcgcccaggctagagtgccgatccctatgttagcttgatgtggtggctcatatctgtaatcacagcactttggtaagctgaggcgggaggatcgcttgtcaggccaagagttcaagaccagtctgggcaaaatagtgagacccccctgctatggtttggatttgggtccctgcccaaatctcatgccgaattataatccccagtgttaggggagggacctggtgggaggtgattggatcatggggggagagtgcctccttgctgttctcctgatagtgagtgagttcttatgagatctggttggtttaaaagcatgtagcgcttcccccttctctcccttcctcctgctccagctatgtaagatgtgcgtgcttcccctttgccttccgccatgattcaaagtttcctgaggcctcccagccatgcctcctgcacagcctgtggaactgtgagtcaattaaacctcttttctttataaattacccagtctcagggagttctttatagcaatgcaagaacggactgatacaacctccatatctacaaaaaaaaaaaaaaattgttttaattacctgagcatggtggtgcacacctgtagtcccagctactctggaggccaaggcaggaggatcactccagcctgggcaacaagagcgaaattccgtctcagaaaaaaaaaaaaaaattaaaaaatttaaaaaacgtaaagaaaaaaattattttgctaaatctggcaaagccaaagggatgaaactgacatttactgggcaccttctgcacaagtcagttctcctaggaacccagagaggcaagggattggtagcaatctctagaggcaaatatcctctaatatccatggtgttctttgtggagcagctcaatggatttacttaatgggaaatgaaagaaggaaaaatgaagacttagaaggcttcgatgatttccaatgcattactgtatacttatctcttcttagaagcaatagaaaaaaaaatcaggaattaaagacaatctattactcaagcaaatgctaaaggcctcccatggtcttcaaacaagaagagatgctctaagataaattacttcattacgttgatgcttcatcatccgtggaagctgtgactcagagccctgcagcaataattaggcagtgcgttcatgtcccgttaatgtccccaaacagtgggagatgaatggagaacatagggctgtgttcgaatgaaaaaagggttttgttcggcgctctttcagcagggaataagtactgatgtgggaactgagcttctgtttacaactaaggatcacattaaaaatatattaagatgactacagtaaagcttattgtagctattattatttcatttaaatgaatcccagtttcataagaaccaccaagggggctaccatgtctaaaatgtaacttctctgcgaatcctgaaatttctactgacaaaagactacgatgcacaattaattaattaattaattaattaatttgagatggagtcccactctgtcacccaggctggagtgcagtggcacgatctcagcttgctgcaacctttgcctcccgggttcaagcgattctcttgcctcagcctcctgagtagctgggattacaggcatgcgccaccacgcctggctaaattttttcgtatttttagtagagatggggtttcgccatgttggccaggctggtctagaactcctaacctcaggagatctgcctgcctcggcctctcaaagtgctgggattacaggcgtgagccaccatgcccggccaacacgcaacatgtttaagaccaaaaggactgttttgcaatgaagcagatgaatcaaccagtaaggccaacccctcaaaaaatgtagcactgaagtttcttcaacatctgcctctgagacttgttcatatgtgcagacacagagcaggaaactaaagcaactgccttcctctttgtcacctgaaatgagaatggagagaggctggcaaggaaatgatatgtaatcttccctccttcctgattttcttttctatccttttttttttgagttggagtctcgctctgtcacccaggctggagtgcagtggcacaatcccagcactttgggaggctgacgggggtagattacttgaggccaggagtttgataccagcctggccaacatggtgaaaccccatctctactaaaaatacaaaaaattagccaggcgtggtggcatgtgcctgtaatcccagctacttgggaggctgagcatgagaactgcttgagcccgggaggtggagattgcggtgatctgagatcgtgtcactgcattccagcctgggcgacagagtgagactacatctcaaaaaaagagaaaaaaaagaaaagaaacatttacaatctattcactctgaaatttacagtctatttactctgaagcctgctacctgaatgcttcatctatgagataaaactttagtctctgcaacctcttattgtaacccatatatccctttctattaataataactctttcaaccaattgcccatcagaaatctttttttcttttttttctttttttttgtttttttttgttttttgagacggaacctcgctctgtcgcccaggctggagtgcagtggtgcgatcttggctcactgcatgctctgcctcctgggttcacgccactctcctgcctcaggctcctgagtagctgggactacaggcgcccgccaccacacaccactaatattttgtatctttagtagagatgaggtttcaccgtgttagccaggatggtctcgatctcctgaccttgtgatccgcctgcctcggcctcccaaagtgctgggattaccggcatgagccaccgcgcccagcccagaaaatttttaatctatctataacccagaccaaaccaatgtaaatctttaaatgtatttgactaatgtttcatgcttccctaaaatgtataaaatcaagctgcgcccggaccaccttggggatgtgctctcttgctgctacgctttctgcaaattttccatacaatttttctttttcttttttttttttcacacagagtctcactccattgcccaggctggagtggagtggcacgatcttggctcactgcgacctctgcttcccaggctcaagtgattctcccacctccgcctccaaagtagctgggactacacgcccagctaatttttgtgttttttgtagacagggtttcgccatgttgcccagactagtcttaaactcctggactcaagcaatctgccctcctcagcctcccaaagtgctgggattacaggcaggagccactgcacccagctagaagagggaaagtttaatatagttgattctcattattcaagatagttacattcaaaaaagtcaccaaggacactgaattggtgaatattgaatcatttgctctaaaggaaatgcaggattgggtgtctccaagcctctggtcgcaacatttttataaagcaatcaatacataatcttcttttatgtgtgtgtgttaaaggacgccttatctaatacatattgttgattcattgacattgaactcacggccaacagcattgtaactcatgcctgaacaaagcttatctaacaaatgtaccttctccattaggtacttcacagccttcttgcactcagagacactggatagcacttcaggaggacacttaggggccttctgttgttgttgatgttgagatgaagtctcgctctattccccagtctggagtgcagtggcgtgatctcggctcactacaacctccacctccaagattcaatcgattctcctgcctcagcctctggagtagctgggattccaggtatgcgccaccatgcccggctaatttttttaatttttagtagagacagggtttcactatgttggccaggctggtctccaactcctgacctcaggtgatccaccagccgtggctttccaaagtgctgggattacaggtgagagccaccgcacctggctgggggccattttaagcagcaaaatcacaaaaagcacagaactgtgaaagatgtgacactgaatacactgcagagaggacacttgtttgcagtctgaaagctgagacaagaaggcagagtgtggccaggtgcagtggctcatgcttgtgaccctagcattttgggagactgaggcaggacgatcacttgaggtcaggagttcaagaccagcctggccaacatggtgaagccctgtctctactaaaaatacagaaattggccgggcgtggtggctcacgcgtgtaatcccagcactttgggagaccaaggcgggtggatcaagaggtcaagagatcgagaccatcctggccgacatggtgaaaccccatctctactaaaaatacaaaaattagccaggcatggtggcacccgcctgtagtcccagctactcaggaggctgaggcaggagaatcgcttgaacctggaaggcagaggttgcactgagctgagattgcgccactgcactccagtctgaagacagagcaagactctgtctcaataaataaataaataaaaataaaaatacagaaattagccgggcatggtggcacgtgtgtggccccagctactcgttgaggcaggagaattgcttgaacctcagaggtggaggctgcagtgaaccaagatcatgccactgcactccagtctgggcgacagagcaagactctgtcttaaaaaaaaaaaaaaaaaaaaaaaaaaaaaaagaaggcagagtgtcaccttgttggacctcagctgggaatgggtgcatcatgtgacttaaatattttgctgctctctgcatgtacatgtcttcagataatagcaaaagcaccagaggtattgatttggggtccaaatacattttagaaaggtagacacatttataaatatggaacccatgaataatgaggatggactgtatgaagaattgttaataggagactggaataatgagggtttgagtagtaagaagggaactctgaagagtatacaggcagatgcagggggctcatgtctgtaatcccagctctttgggaggctgaggcaggtgattagcttgagctcaggatttggagaccagcctgggtaatacagcaagactccatttctaaaaaaaaaaaaaattttttttttaattagctaggcatgggggctcatgtccgtagtcccagctactcgggaggctaaggtgggaggattgcttgagccagggaagcagaggttgcagtcagccgagattgtaccactgcactccagtctgggcaacagagtgagaccctgtctcaaaaaaaaaccaaaaagtatacaagtagtagatacaaggaacagctactacccctaggactgagatatgacacttacggaaacaatcacccctggagggctgagatcttgaccaggtagagagggtacagccctgggtcactgaatagcaaagaagacagttgacgtgatgccctgctggttggtggaacttgctggaaatctaccctcagggtaaacttttcatggcaaggtgtctcactgaaggtactctgctgcaagaccaccagaggggagtgccaggggaagctgcctgccaatgagtggtataggagctgggcactggagaagccatcagcaggaaccaataagcaaaaccctttcctcctgcagtgtctctccagcaccctgtactgacaaaacttaaaataacattgtgcctcctggcaaaggaaagctatttaaagggcccagatccatttttacccagaaggcaaaaaggatggatttggagctggaaggcaatagatcaaaaactgactgttttgatgttttttattttctttttttagagatgggatcttgctgtgttgcccaggctggcctcaaactcttgggttcaagtgatcctcccaactcgatctcctgagtagctgggaccatgggctcctggcattgtgcctggctgtttagtggttttaaaaaataattctacaagtatgaaaaacaaaaaagtgtaattaagaaaattaacatcttggctgggcgcggtggctcacacctgtaatctcagcactttgagaggccaaggcggatcacctgaggccaggagttcgagaccagcctggccaacatggcacaaccccatctctactaaaaatacaaaattagccaggagtgatggtgggtgcctgtaatcccagctatttgggaggctaaggcaggagaatcctttgtgcctgggaggtgtaggctgcaatgagccgaaattgtaccactgcactccagcctgggcaacagagacagactccatctccaaaaaaaaaaaaaacaaaattaacatctctagtgttaaccactcttttcattttttatgaattttttatagtcttttctatgcatgtagtttttcatttaaaaaaaaattaggttcatattacacatgctgtgttcttaccagcccttttgagttaacagtgtcaactttccatattaacaactgtgtacctgcatcacttttttttttttttttttgagaaggagtctcactctgtctcccaggctagagagcagtggcgtgatgtcagctcactgcaacctgtgcctcccaggttccagtgattctcctgcctcagcctcccaagtagctgggattccaggtgtccaccaccatgtccggctaatttttttgtacttttattagagacggggtttcaccatgtcagccaggctggtctcaaacttctgaccttaagtgatcctcccacatcggcatcccaaagtgctaggattacaggcgagagccaccgcacctggcactttttttttttacagcttgtgtcttaaccagttttatggaagtaccactatttagccaattccctgttattttgttgtatatatagtttgttttcaattttgtttcattataagcagcgctactgtggacggtcttatagttaaacctctaacatatttatgtatttagtttacactttgggagtagaattttaagtacaaaacctaggtatattttaagtgtttttgttactgaatgcccagttccattcagttcaacacaaatgaaatacgtcaaaggttttataacaatctgaaattctaccagcaatccataagaatacttattttcttctatttttttttgagacggagtttcgctcttattgcccaggctggagtgcaatggtactgtctcggctcaccacaacctctgcctcctgggttcaagcgattctcctgcctcagcctcccaagtagctgggattacaggcatgcaccaccacgcctggctaattttgtacttttactagagacaggaatttctccacgttgctcaggctggtctcaaacttccaacctcaggtgatcgacccgcctgtgcctcccatagtgctgggattacaggcgtgagtcaccgggcccggccgagaatacttatttccgtctacactaacacgggatgttattttattttattttttgagacaaagtctcgctctgtcgcccaggccggagttcattggcacgatctccactcactgcaacctccgcctcctggtttcaagcaattctcctgcctcagcctcctgaatagctgggactacaaggcatgcgtcaccacacccggccaattttttatttttagtagagatggggtttcactatgttggtcaggctggtctcgaactcctgacctcacgtgatccgcctgcctcggcttcccaatgtgctgggagtacaggtgtgagccaccatgcccagccggatgttattattttttaaaaaaactttgctaattataggcaaaaatgctatttgatccatttctgcaattttggtcactagtaatgttgaactttttgtcatgttgactatttgcatgtttttcctttttatattgtcggttaatgtctttgcccatttgccttctgggcacacagttttagagaagcctgttcactttcatgaaatgtaaataaatctgaaacaaattaaacatcaattatagtttaaaatgctaataaaaattcttattttcagccaggtgtggtggcttatgcctgtaatcccagcactttgggaggccaaggtgaatggatgcttgagctcaggagtttgagaccagcctggacaacatggtgaaaccccatctctaccaaaaatacaaaaattagccagcggtggttgtgtcctagccactgtggaggctgaggtgggaggatggcttgagcccatgaggcagaggttgcagtgagctgaaacaccactgcactccagcgtgagagacaggagtgagagcctagctcaaaaaaacaaaaacaaaaacaaaaacaaaaaggtcctttgagtaccagaaaaattgtcaatgggaatactttcctcaaggtcttgaaaattaataataaatcaacaaatcattgatggtagtggctggtgttgctttcttctatatctagctagttatcactgaacaaacattttctaaaacattttcgatgtttcagagcagagatttcaaattgacagccaagggacggattcatgcataatttactctcttttattttgctttatttttcttatggtatttacaagtaattaacatacattatatagctacttatctctctgttacaataggatataagatccacaaaaatagccagacacaatggcttatgcctgtaatcccagcactttgggaggccagggcaggaggatcacttgaacccaggtgctcaaagaccagccagagcaacatagggagatcccacctcttcaaaaattaaaaaattagctgggcgtggtggtgcatgcctgtagtcccagcagtttgggaggctgaggtagaaggatcacttgaacccaggaggttgaggctgcagtgagccaggatcatgccactgcattccagcctgagggacaaagtgagacctacctacctcaagttaaaaaaaaaaaatccgcaaaaggcaaagacttaatcccttttaatgattattgtatctccaatttctaaaatactgtgtggtatataatgcaccttcagaaaatatttgttgaattcacgcatttagtaattatttattgaactcccactgcatcctaggcactggattagctagacttgggaggtaaatgcctctgcctccatgtagtgtctttaaaatatgattctcggccgggcatggtggctcacacctgtaatcccagagctttcagaggctgaggcgggcagatcacctgaggtcacaagatcgagaccagcctggccaacatggtcaaacccggtctctaataaaactccaaaaattagccaggcatggtggtgggcacctgtaatcccagctactcaggacgctgaggcaggagaattgctcaaacccaggaggcagaggttgcagtgagctgaaatcaagccactgcactccagcctgggtgacagaacaagactctgtctcaaaaaataaataaataaaataaagtatgatgctcattaaaaccagattgaaaacaatggaaatgttttggaaataaaatatacacactgtgccagtatgtggattcattactcattaattctatgactattttttgagagcctatttgcagtcacttggggacacaataatattaaagacagattctgtccctgcggatatggcattgataatctatcaagggaggtagacattaagcaactaattaatcgtgattgtgccaagtacataaaggagaaagacaggtgcctataagcactcatgagatttccctgagaaaatgatacttacacttctaccaaagggattagaagttacacaagacaaaagggaagggaaaaaaagaacagtctcatcgaagaaaacagcttgtcaggaaagatcttgctgtacagaaagaccaaggggggcactgtggctcgcgcctgtaatcccagcactttgggaggccgaggcaggtggatcatttgcgctcaggagttggagaccagcctaggcaacatggtgaaacccacaaaaatacaaaaaaattagccaggcatgatggtgtacacctgtggtcccagctactcgggaggctgaggtgggaggatcacttgagcctgggaagtggaggttgcagtgagctgtgttcacaccactgcactccagcctgggtaaccaagtgagaccctgtctcaaaacaaaaacaaaaagaaacaacaacaacaacaaaaagaccaagagaataatcaagggaataatgacagccagagaccaaagaggtaggcaggggccatattctatactcatgggccaagtgaaggatgctcgctttattccatggacagctgaaggtttgtaagcagatgatctgatttctacattaaatagatgactctggtttctgtattgagaatggtttggctacacagactgcttagatatggcagtagtcaaggcggtagcaacggaaatagagatgcagacagctttgagagatatttaggaggtggaagtggcaacactgattggaaggggttagggaagggaaagtgtgagagagaggaagacaccctggttcctggcgtgaacagctgggtggatgatggggagcttttatgggatgtggagtgcgagaatccgtggtttagggtagaagacgagttcagtgcaatcaaggcacagctataaatgtgtacaactgaggcagaagtttcagaagcaatgagtacccttactaccatagaagatgctctgattttttttcttttttctttttttttaagaaatttttggctaggcatggtggctcacacctgtaatcccagcactctgggaggctgagttggatcatttgaggtcaggagctcgagaccagtctggccaacatggtgaaaccctgtctctactaaaaatacaaaaattagttggacatggtggctcacacctgtagtcccagctacttgggaggctgaggcataagaatcgcttgaacctgggaggcagacattgcagtgagctgagatcacaccactgcactccagcctgggcaacagagtgagactcggtctcaaaaaaaaaaagaaaagaatttttttacccaatagtaaaataaccaaccaatgcgctgatattttttaatcaactttgttgaagtatgttttacataatagattttcatatgttttacataatataataaaattcacccatattacatgtacagttcaacaggttttgacaaatgtatatacctgtgtaaccaccacgattaaaatacagagctcttctgtcatttccaaaaactccccagcaccccttggcagtcaattccccctccatctcagccccaggctttctgtcattatagtttgcattttctagaattccatataaatgaaaccatagagcatatatacagtatacatatgaaataggtattcacttgtatctggcttttttatttccttggagacagggtcttgctgtgtcacccaggctagagtgcagtggtgcaatcacagctcactgcagcctcaacctcccaggcttgagaaatcctccattcccagctaattttgtttttttttttttggtagagactgggtctctctttgttgcctaggctggcctcagattcctgggctcaagcaaacctcacacctcggcctcccaaagtactgggattacaggctccaggccatgtatctggcttctttcactcagcataatgtttttaagattcatctatgacagggaccagcaaactagggcctgtgggccaaatctggcccagtacctgattatgcaaaggcctaagagctcagcatgactttatatttttaagagattgaaaaaaaactcaaagaagaatattttgtgacacatgtaaattaaatgaaatccaaaattcaatgtctataaataaagctttattggaacacagcaacgctcacttgtttacatactgtctgtggctgtttccatgctacagaatcaaatacttgagaccgagatcgcaagaacctaaactacagcttgcaaagcctgaaatatttacaaccaggccctttacagaaaaagtctgccaactcctaatctgtggtgtcccatggatcaataatgtactccctttacttgcagtacagtactccattccattgtagggataggccacaagttgtttacctgtttgtctgttgatggacatttgggttactgcccaattatccttaatccacgtgatatgctctgatgttttgcatcctatttcattttttaaaaaattgctactcatgacccaatggttgatatcacaacccactgatgaactactctcagtttgatatagatgttaattgaaataatggaggatgaaattatgtagaagaagaaatcaaaaggactttccaggctgggcacagtggctcacgcctgtaatcccagcactttgggaggctgaggtgggtagatcacctaaggtcaggagtttcagaccagcctgaccaatatgatgaaaccccgtttctactaaaaataaaaaattagctgggcatggtggcacgtgcctgtaatcccagctactcaggagtctgaggcaggaaaatcgcttgaacctgggaggtggaggttgcagtgagtcagcgagactctgtctcaaaaaaaaaaaaaaaaaaaaaaaggcttgccagctgagtgctgaggaaatccaacaatgaaacattgggtggaggaggaggaaactccaaaagacattgagaaggaacaggcagaaagggaaggtgacgatccggagaatttgatattgtgggaagcatggaaagtcagtttcaagaagaaagtgatcatctggttctagggctgctgagaggtcaggtgtgatggactgagatggttttagtgacactggtttgggtggagggaacaaggccgaagctagattcagatgagttggtggtgcttgtgtgatgagaaaattgagaccattaggtgtaaccagaaggggatgtggatgaagataaggagtttttatttgcttgttttttgagcataagaatgtttaacaaacactaaaaggcaagcataaccagaattttacagatgaggaaactaatataccaagaggttaagtaacttgcccaagtagttttcacttatacagcttaaaaaaaaaaaaaaaaaagaatccagttctacttgtagccacagtctgaactctaaccaatgggctataccatcgacaagggaaaaaactggcccagacataatccaatttttgtacctttgagttaaaagtctacagttgaggctgggcctggtgtctcacgcctgtaatcccagcactttgggaggccgaggtgggtggaccacctgagatcaggagttggagactagcctgtccaactagtgaaaccccgtctctactaaaaatacaaaaattagccaggcttggtggcacgcacctgtaatcccagctactcaggaggctgaggcaggagaattgcttgaacccgggaggcggagcttgcagtgagcagagatggtgccactgcactccagcctggcgacagaacgagactccatctcaaaaaaaaggaaaaaagagaagtgtttgaggccaggctcggtggctcaggcctgtaatccaaacactttgggaggccgaggcaggaggatcacttgaggttgggagtttgagaccagcctggccaacatggtaagaccctgtctctactaaaaatacagtgtgtgcgatggcgcacgcctccagtcgaagctactccgggaggctgaggcagcagaatcacttgaaccggggaggcagaggttgcagtgagccaagactgcgccgttacacttcagcctggacaacagagtgagactcgtctggaaaaagaaaaagaaagaaaaagacaggtctgttagcagcacataaagccatatgtcagtagagattaaacctccccacaactgatggcttcatgctccaaactgtacaatattctgcttatctctcttcactagtccatagaatgttgcattataatgtatcagttttcctatctgtgcatccacaagccaaatggtttcaacttttttttttttttttcggggatgggggaatcacagacttgagtatataatgaagacaatggatgttttccccagaaaaatgcactcactcacacacaaaatgttgagtatagtttcagagacctccatctgcatcccaaagtaaaaacttctacccaaaatagtgtttttcttcagggcagagagcttgtctttgttttgtgtgtgtgtgtgtgtgtgtgtgtgtgtgtgtgtgtgtgtgtgtgtgtagacggagtcttgctcttgtcgtccaggctggaatgcagtggtgcaatcttggctcactgcaacctccgcctcccaggttgaagcgattctgctgcctcagcctcccgagtagctgggattacaggcgcacaccaccacacccactaatttttctatttttagtacagacgagggtttcaccatgttggccacgctgttctccaactcctgacctcaggtgatccgcccacctcggcctctcaaagtgctgggattacaggcatgagccaccgcgcccagccttttttaaatttttaaattttttattatattttgtttttgagacagagtctcgctttgtcgcccaggctggagtgcagtggtgcgatctctgctcactgcaagctccgcctcccgggttcacgccattctcctgcctcagcctccagaatagctgggactacaggcgcccgccaccatgcccggctaatttctttttgtatttttggtagacacggggtttcaccgtgttagccaggatggtctcgatctcctgacctcgtgatccgcccgcctcggcctcccaaagtgctgggattacaggcgtgagccaccgcgcccggcccagcctcttatttgtatttttattgttttttgagatggagtctcgtcttattgcccaggctggagcgcagtggcacaatctcggctcactgcaacctctgcccccggggttcaagtgattcccctgcctcagcctcccaggtagctgggattacaggtgtttgccaccacgcccagctaattttttgtatttttagtagagacggagtttcactctgttggccaggctgctcttgaaccagcctcttattcttttacatactatttccagcacaactgtccaagatggcagtcaataaatgtttggctaaatataataaataatacggttgattatttccactttttcatgttgggttttcaaagtctacttttaaaacagtaaagttaacttttctctctagtatttgttttgtagaatctattatactttgtaatgtaatccacagaaacttggaggtgactttagtaaaatttactagttttgaatgatacccatgctgaggtgctcagaggtgaaatgtactaacatatatcgatggatggatatatggatgcatatgtgattaaagcaaatatagggaaaattaactgtagaatctaggtagtgggtatatggttgttcactgtacaactgtttaaacttttctacgtttgaaaaatttcataacacgttggaaaagtgacttgttttgctcaagcaggggtacattcaatcttcaattcttgaaagacataaatctatctttccttctgtttggaaagctctttagagagtcagaataatccccacagtacagtctaaaccagcacacaagggttttttggtagaaaataattttattaacataaccaggcaatttaccaaatacaacgtagatagctcaaaacatggagttactgcgctgaaaatgtgaccctgtttacacagatttcgggacgaagagtataaaacaggagagaaaaggagtaagattgtggttgtagcgtcatcgcagaggtgaagtgttccattgattgccactgtggtagtctatatcagtttcccacattaaggtgggaggaatctactaagcaaatgtacgccctccccattcgttcgaaacacattgcagtaaaattgcaaaagtggccgggcgtggtagctcatgcctgtaatcccagcacttggggaagctgagacgggaagatcgcctgaggccaggagtttgaagccagcttgggtaacatagtgagacacccctaccttctctattaaaatgagattttaattttttttctcttcagttcatcggttaacaagataaaaaaattaataaaaaattaactttttaaaacatttaaagtaaagtaggagtggaagcagtatgtggactcatggggcttgggtctgaatcctacctagatcggcactgcgaaatggggataatgatctcctagagctgctgaaataggaaaatggaagaacagcagctgatgtattaatattatcattattactactacccattacctgacaagtgataattgtgacatgaaagaggctggaccggttgttacaacaattttttccgtctagaattcggcggtaaggtctgagacaacacctcagcttagatcagtgccttctctgaacagcgttcactaagcagcccccaaccccaaaacccccaagtccccgggcgccgaggacgctgcgagtcctgcgcatgcgcaaggttgcccactcgctcaccgcctccttggcgaatggcctgttccattctcgagggatgccggcgggaggtgaggcgggagacttggaagcctgggcccggaagtgaggtgcgtcactagtatttccagcctttcactccatgaatagtactttgtgattattatacttctaccttgatgattgcaacaggctgctggaaagagtttggtgaacaatccaccgggcatcctccccccttcacctgcgcacgttagggagggccggcgtggcgcccaggtacggaatcccagagggctccgcccagcgctacggggccccgccccgccgcctctcaaccatcaggttcggcagcccgcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaaggtccgtgccgggagggggcgatggggacggtgctgcggcccggggctcccgcttccgaggcaactgtttcccagtcgcgagctgccattgtgacccggacagggggacgcgggctgacaggccctgcctgaggaggcctcgccgggagggcggctggggcccgggcgcgtcacggggccgggtgtctcttgggtccccgtgggccgaagaggctgggcggggttcggtgggggccgcgacgggcccggagcccaggactgggaccgcggggccgaccttgggccctgccgaggttccgcgagtggccggcctgagctcggctggccctttcggaggaccgggagctctccgttggcggccccagatgctcccggaaagaagccgcagttatttcagagccagctgcaaacctgtaggtttttcttggtctccgagttaggaatgaaaattgccaaagcagtggttttccaacttcagcctgagtgggaatcacctggggcctttggtaaaatgcggaggttcagtcccggggtcagaacctctgggggcgggaccgggaactgcgtgtttaaccgccaccgccccgctcccactccgccccacgcaggtgattctgatgctgagcctgcgatcaccgggcgagaacctctgagttccagaaaggggtgggtgttgcgtagattgcgaattgagttttggggatcgcagctgctccacaacttcctggctcccccattccagtggcgaggagggatccccgagtcaactcgaaatccactggtaacagagcctacctctggtttccccttgggggaacggcagcgtggtgtaccaggctgactgctctaccatgtgaaacggattctcattgtcccagtgttagggcttgtaaatggaaaccagtttgggtttcttcacggattcctgctttcggtacctgacattctgccctccctcaaagcccttctgtctgttccagcttgggagtctgcttgtccaatccagtgcatacccggtttttcatgcatgtggcattcaggagcaatgctcgtgttttaagacggctacattttaattttgagctggtaggaataatatattttgtcttttttcaaggcagcagctgctgtagattttgttcacttgtcactggagagttgaaggcaataattgtaaaggttgggccagatgtcttcatgtgctcacagtggtatagcctactcctgggttgcttagcataaattgggtggaagacaagaaaaagataatatggttttcttgtgccatctctggggtgaatgttacgtgttttcctggctgggaataaagtctttccggtcgtctgattagcagggtgtctaccttttggtactttgagtttgtccagatgagtggttcttaaagcagggggcaatttatttccccaggagacatttggctatctctggacatagttttgattgtcacaatgggggcagggaggtgctgccggtacctagtgggtagaggccagggacgcctctaaacatcctacgttgcacaggacagccccccacgctggagaattctctggcccaaaatgtcagcagtgttgaggctgagaaatcctggtcaagatcatgtttataacaccagcagttgagtacaaaacgatgcaaagtggtgttatcaatttcctaagaaggtgggtgggcttcatgtgattgtaattggaatcctgaagaactggggtgatctttcctccaggaataattagcctttataggaaaatctgcagggtgggtcagaatcctgctttaaatattacttttctggcatttgatcagtaggttacagtagttgctccctaagtgttaattgatgataaaagatcttaaactctctcaatgaggatcgcaagagggactgaaattccagtgtgtttaatattggagcattcacaaaaattgtagtgatcttttaggaattcagaacgtgtgggctggaggtttctgccttaggtcaatgtgaaaattctgagtgtaagtttttcagaactatgggacttacttttttttttttttttttttttttttttgagagggagtctcggtctcttgcccaggctggagtgcagtgaggcgatctcggatccctgcaacctccgcctcccggattcaagtgattctcctgcctcagcctcccgagcagctgtgactacaggcgtgtgacaccacacccgactaatttttgtattcccagtagagatggggtttcaccacgttggtcaggatggtctcaaacgcctgaccttgtgatccttcagcctcagcctcccacggtgctgggattacaggcgtaagccactgcacctggccgggacttagatttatattccctgaagtaatacagggccttagatggaataaacgatttatattggtgctaattgggcagaaaagaaaaagcattgctgtaatatgaatgttgatgactttatgttctgaaaaatagtctgggtcaaagtgaaacatttaattgtgttcattattcctgtttctttgaggaatagactatcctgcgttaaattctacattgttaatataaactcaagagctatgtgagcagttgtaaatgatcccatttaaactgattgttgcataatttatactgattacagaaaccacaatgttatttgatgctcaccctctaaaatttaaaataatatctctcactttaaaatgtatgtgaaaaaacaaaaacaaaatgtagtatgcgatcatcatttagtagaatcactcagtgatttggatttggtccaaatatagttctgtcccttgctttttctgttatgtaaacgtgcagacctgtgataacagagccattttctcgtcacgatttgcttttcttccacaacagtatcagttttcttgtatctgagatcagtgatgtcccaataaatcagatgggttaattgaggaggcaaaggaaattcaaacttaggagagtaggagtaggggctttgcccctgccccccactgtatgtccaaggcataaggaacaaggccctgtagcagagtctcacagtgtgtacttatgttaatattcaataaggaaaatgccacaggaagtaatcactataatgatgaagattttaagttattaaacacaccttccagtaaaaacctgttatattattattatttttgagacaggatctctctctgtcacccaggctggagagccgtggtacaatctcggctcactgcaacgtccgtctccagggctcaagtgatcctcgcgcctcagcctcctgagtagctgggactacaggcactcacccccacactgagctaattaaaacaatttttttgttctcgagacaaggtctcactatattgcccaggctggtcccaacctcctgggctgaagccatcctcttgccttagcctcccaaagtgctgggattataagcgtgagccaccgtgccaggccaaaacctgctactctaaacttgtagaatagcccagacctttttctgttggttaaaagatctcattcttcctgggtattatgtttaggcaaggtatactgcagtttgtttgcatttactttaattctgtccttgagcaaacttaaagcagtttctcagcgtcagcactagtgatattttgggtcagataatttgctgttatgggggctggcctgtgcatggcagcatgcttagcagtgtcccagacctctgctcagtagatgctagtcgcactccctacacccagttgtaacaataagaaatgtctcaagatgggggcagttgtcccccaaggggtagagggaattgcctgtcattgaaagtccctaatttagggaatctagagctacagttccggtttggtcaccactagccatatttggcagtttacattgagattaaaattaaacacaatttaaaattcatttcctcagtcatgctagccacatttcaagtgctcagcagccacatgtggctgatgtctgctacactgggcagcacagatgtggaacatttccatcgcaaagaaggttccactggacagtgctaagagctggcaattcgtgttttttttttgagatggagtctccctctgacgcccaggctagagtgcagtggcacagtctctgctcactgcaacctctgctttccgggttcaagcgattctcctgcctcagcctctcaagtagctgggattacaggcacccaccaccacacctggctaatttttgtatttttagtagggatgggatttcaccatattgaccaggctggtctcaagctcctgacctcaagtgatccacccgcctcggcctcccaaagtgctggggttacaggcatgagctactgtgcccagccaattacttgttatatctaattctcatctctgaaagaggcaactttgaccctgtttctgacctaaatcagcacaactcagcccatttttggttcttgaactcatcctgagctaagtgtttctttcctgctatttgggactgattttagaaaattctttgtcaccttgctgttatgctagaggtttatagcagcatcaatggaacattcctgatcattacttactgataaggactccgagaatttctattcctgctccttccttaaaaagcatgagaaaagaacccctgttaggcaaggttgaaatgaccagtttccgtgtatggctttgtagatcccactcttttatatagaatgagaggagatgagaggctgtaattgtagctttcatataaagccaattccaatgttacaatgtgagggttttgcatacagatgcatggtggctatggctgtaaatgattatctaatactggctgtcagggaaaactgatgggactcggccatagtacaaagttcctgatcctagatatttatggctttgttcattcttgatttattcaattttgcaggggaagtcagtggcagagctattgatggtcccatttccgtctttgctccactatatctaggattatatgagttataggtagaagttggttgagcttgatttcatctgttgtcacctaaagcagaaacctgttttgatttataattttttttttttgagacggaatcttgctctgtcacccaggctggagtgcagtggtgcgatctcagctctatgcgacctctgccccactgcaacctctgccccctgggttcaagcaattctcctgcctcagcttcccgagtagatgggattatttttgtgccacgcccggctaatttttgttttttttattttttatttttttgagatggagtctcgccctgtggcctaggctggagtgcagtggcacagtctcggctcactgcaagctccacctcccaggttcacgccattcttctgcctcagctgggactacaggcgcccaccaccacacccagctaattttttgtatttttagtagagatgtggtttcaccaagtgttagccaggatggtctcgatctcctgacctccacctcagcctcccaaagttctgggattacaggcatgagccaccgcgcctggccaatttttgtatttttaatagagacggggtttcgccatgttggccaggctggtctccaactcctgacctcaagtaatctgcccaccttggcctcccaaagtgctgggattacagatgtaagccactgcacccggccttgatttataatttttattaatcgaaggtgagctgtggtcaaagcccaatgctgagtgctgacagagacacaaggtgagtaagatgtggcccctgcaggaggttgcgttctggtaagggagtatacttttttttggacaaatccttgtatagaaagggataaaaagcataggaattaagaaacaaattgtgagtgcaaggagcaagtgaccaggaaggattatgtgaaagagattctttaggcagaatatttagctcagaattatgcttttctagagtttaattgtaaatataatgcaaacctttactttacgagtgtgcctcatattattgctggtagataaaaatcaagaaacaggaaaagcatttcatctttacctttccgatttgatcgctccctaacaatccctgaacaaggtaaatcctgaatggtgataatcattcaaccttcatctctgctaaaagcatttcttttcctcccaggcaaaaacaaacagtgcctgctgtctagcactagttaaactagttaaacactgcctataaagcttatcttaaggaagagttataacagtatctgcttctgtttagcagttttctttttgttccagaataaaggtgtgattccaggtaaacagtaaagtttttagaaatagagcttccctattgtatgctatttttccatcagtgtcattatctggaagtgtttactcgtgttataagatctgtgtgaactgacactgcagtagtggtctctgggaacacaggtttttggaacacggagttggatctctagcatctccaacgtatatctgagtcaagtgattagaggctttttccctccttcacatactgctctctgactgagatgtgatctgtgcagttaactttgctgcctcctttccactgttgggtatttttgtccttttcttttgtttcttttttttttttgagatggagttttgctcttgttgcccaggctggactgcagtggtgcgatcttggttcactgtaacctctgcctctgggttcaagcaattctcctgtcttagcctcctgagtagctgggattacaggcgcccaccaccgcgcccagctaattttttgtatttttagtagagacagggtttcatcatgttggccaggctggtcttgaactctgtacctcaggtgggccactgcacccggcctatttttgcccttttctttcctattttctgcctatcttcttgaggaatttgtaaggttaaatacttatagttacaccttatacagtacttggctaacccttttcaactaggaagattatgatgcttaatcttaatgagccagtaattacagtatgtcttcatattctcacagacacactcaagcgtagagaccatgatggttaaaaataagactttcaaatgacaatatccagttcttagaagatgagaggagacggctgagcatggtggctcatgcctgtactcccagcactttgggaggccgaggtgggtggatcacctgaggtcaggagttcgagaccagcctggcccacgtggtgaaaccccatctctactaaaaatacaaaaattagccaggtgtggtggctcacgcctgtagtcccagctactcaggagattgtgccactgcaacagagtgagactccatctcaaaaaaaaaagaagatgggaggagacaaaagttctggttcttaaatactgtactgttgaatcaggcaaaaatacttacaaatgtagaaactgagactccaataagataaaccaggtttacaagtcactgtatcagcttggaggattcctgtcctcttctctcatccttggcccataaggaacattatgttcttgctgtggcttctcagtggtatgtattataatagacgtgtgtggtgtttggggaacttgtttaactagtgctagacagcaggcactgtttgttttcgcctgggaggaaaagaaatgctttttgcagagatgaaggttgaatgatgatcactattcaggatttaccttgttcagaaagctgtgggaggcaagagtagttaagttaggaacagctgtctggagctttacctcttgctttttatctcagccgaaggtaggtagtgattttttttatgtctaatgcatatggtataaactagcatctcataactccaaggtcttctaatatgagcagctggtttctctttagttagccctaagaggcctctgaaataagtcctaaaagtcccccaaataagaacattcctctcctgaaaaaaaaactttgttgaaacgaaagtattatatacttctagcattgatgaatgttacaattaatatacttttaaaaataaattttagactttctttgttatagaggctgcttctcttaaaagccttctcttggccgggtatggtggctcatgcctgtaatctcatcactttgggaggccgaggcgggcagatcatgaggtcaggagatcgaggccatcatggctaacatggtgaaaccccgtctctactaaaaatacaaaaaaactagccgggtgtcgtggcatgtgcctgtggtcccagctaattgggaggctgaggcaggagaatcgcttgaacccgggaggcggaggttgcagtgagccgagatcatgccactgtactccagcctaggcgacagagcaagactccgtctcaaaaaaaaaaaaaaaaaaaaaaaaaaagccttctctttgaaggcttagctctgtatgtcttaaacagcagttattcatgtcagttattcatgtaccatctgtgaatttggccacatcactgtaccacctatactattatttgcttagtattttcttttaaatctactttacatcaatttactccccctttatgaaaaattgaggaaccgtttacttacaacaaatagacccattttaattatatagtttgtgttttggaagttgtatatagtgatattaccaccagcatgatcaagatacaaagcattgacctggtgcagtggctcacacctgtaatttcaacactttgggaggccaaggaaggaggatctcttgagcccaggagtttgagggcagccagggcaacacagtgagactcctatctctataaaaaataaaaacttagccaggcttggtggcatgcacctgtagtcccagctacttgggaggctgaggtgagaggatcgcttgagcccaggagggtgaggctgcagggagccacgatagtgccgctgcacttggcctgggtgacagagtgagaccctgtctcagaaaataagtcccctacccacccaccccaaaaaaggtacagagcatttctgtctccctgaaaatgtccctatgtccctttgcagtggatccctgccctgctttctgtcactctagacctctttacccacccatcccatccctgcacccccgcctttttttttttttttttttttaacttagatttgtcctcaactgtaatgtctctaaattctgggatttgaggtgtgtgtttgtgtgggtttttttttttttttccaaatcacataaaagtgagagagagagagagagagagtgtgtgtgtgtgtgtgtatacatatatatatatatatatattttttttttttttttttctgagacggactctcaccctgtcgcccaggctggagtgcaatggcgccatctcggttcactgcaacctccgcctcccgggttcaaacgattctcctgcctcagcctcctgagtagctggggttacaggcacaccaccacgcccaggtaattttttgtatctttagtagagacgagatttcaccatgttggacaggctggtctcaaactcctatcgtgatccgcccgcctctgcctcccaaagtgccagaattacaggcatgagccaccgctgccagccaaatgtataattttttaaattcacactttggtgaactggtttaactgaggaaaagtgttgattcgtgtgttttcaaaagatgaaatttttttttttcccctgaaacagagtcttgctctgtcacctaggctggagtgcagtggtgcattcttggctcactgcaacctctacctcctgggttcaagcgattctcctgcctcagcttcctgagtagctgggattacaggtgcccgccattgcacacgactagtttttgtatttttagtagagatggatggggttttaccatcttggccaggctggtctcgaactcctgacttcgtgatctgcccaccccggcctcccaaagtgctgggattacaggtgtgagccactgcctaagatgaaaaaatttttaaagtgactagttcattaattcccaaatcttaggctctaaagacaccttttatttctattgtagttaccagttttggaagatatgataaacaacttttttttttttttttttttttttgagacggagtcttggtctgtcgcccaggctggagtgcagtggcacaatctcggcttactgcaagctccgcctcccgggttcacgccattctcctgcctcagcctccctagtagctgggactacaggcgcccgccagcacacctggctaattttttgtatttctagtagagacggggtttctactgtgttagccaggatggtctccatctgacctcgtgatccacctgcctcggcctcccaaagtgctgggattacaggtgtgagccaccgcgcctggccttgccaatttataattttccgttagcttttttgaaaagttgagagttgctccttgacctcctttaccatcttaccttgcatttgattcttgacttttcctccaacatttaaattgtcagaacttttaagcaattttaacattacatatgtaatatttcttctggtagtgagggagtattttaatatcccatactgtctgataaaaatcgcctagcataaaaacgattcttggccaggcactgtggcccacatttctaatctcagcactttgggaggccaaggcaggaggattgctcgtgaagccaggagtttgagatcagcctgggtgacatagtaggaccatgtctctccaaaaaatttttaaaaattagctaagtgtggtggcatgtgcctgtagccatgtctgctcagggggctgaggttagaggatcacttgagcccaggaactcaaggctgcagccagctatgatcacgccactgtgacagcctggacaatagagcgaggtcatgtctcaaaaaaaaaaaaagtttgtaaaaaatgctcacgaaggtatgaatagtagggcttgttttataaaatgagctaactattaaagtctcagttctggctgggtgcagaggctcacgcctgtaatcccagcactttgggaggccaaggcaggcagattatctgagggcaggagtttgacccggccaacatggtaagatcccgtctctactaaaaatacaaaaaaattagctgggcgtgatggcgggcacctggaatcccagctactcaggaggctgaggcagcagaatcacttgaacccgggaggcggaggttgcagtgagccgagatcaagccactgcactccagcctgggagacagaatgagactgcatctcgaaaaaagtctcagttctgtgacagtgagcatgcaattgaatggctcttcttaggaaaggagaattaaatcatacctatcatgcaactgtgttagataaaattgtagcaaaaatattgaacccacgtcatttatacaacagaattaactgtacttgaaatataatttatgaatttgtagagaggtaaaactgtgtctaaattctcagcaattagtatctatcagaaaatgtgcatgtagatatacccactctgtaaatgctttgttgcactttttttggttttgggatttttgtttgagacagagtcttgctctgctgcccaggctagagtgcagtggcgcgttcttggctaactgcaagctccgcctcccaggttcgagtgattcttgtgcctcagcctcctgagtagctgggactacaggcgcacaccgccacgtccagctaatatttgtatttttagtagagacggggtttcaccatgttggccaggctggtctcaaactcttgacattgggtgatctgccctgctttggcctcccaaagtgctggttttacaggtgtgagccaccatgcgtggccatgctttcactcttaaaaatgcttgggtttaagagttggtggaaaaaggaaaaaaaaaaaatgccctgatctggatgatgagtttacggccatctggttgagactgttgtaaagtagaaattttccctgtaaagtgtcactttcttcccaggtgaaaacattaatcaagcaaggataatctttaaaattaaaccttagttctaaatatgatttttgagtacaagcttttttaaagtgttgagttgcttcatttacttacttgataaaattgagaagcagtattgcccagtggttaagagcactggtcctagaattttacttagttttaaattctggctctaaaatgtactatgatttggggcttgtgaggaagtaatgtgtgtagaggcgttaattattagcacaatgcctggaatatagtaagcaacccagtaagtattagtaattataaggatcataaatctgattgaatatttactctgtgtctgaccctgcactcagtgctaagggattcagaaattatttgacattcttccgaggaacttgacatagaatactgtttttcctttgtttttttgttttttgagatggaattttgctgtcgcctaggctggagtgcagtggcaccatctctgctcactgcagcctccgcctcccaggttcaagcagttctcctgcctcagtctcccgaatagctgggattacaggcaccccccaccacgcctggctaatttctgtatttttagtagagacggggttttgctatgttggccaggctggtctcaagcacctggcctcaggtgatccaccaaccttggtctcccaaagtgctgggattacaggtgtgagccactgcgcctggcctgttttttttttctgccaacattatcaaacattttcctatgtactaactaatagacatctttatacatctttatacaattctttttttttttttttttttgccatacaggttcattttattgagtggaaagcttacaaaaggtccactggccccttccctccccacgtgacactcattccttccaatgcaaactctggtgtatccacactcgcttctgcgtcactggtttcccccaacaaggcacaaagggcgggtgcttccaaaggatcccttgctcctggcagtgggactttcagtgctgggtgtcttgtgcaaatggtggctgaaagcaggactgttagttcactcagacactgggatcttccttactcctgcagaggggcttggctccaggcccacagtactcgttgtagatgagcttgaagaggaagaggtggaagagggtgatgagggaggccaagctgaaccagaagaggaagggcagcccggggtcctgctgagccatgtgctcatcatgggccaggatggccttgaggtgcagcgtgtgccgcaggtcctgcaggtgtgtgaggtcggtggagatgtagagcagtggcgtgatgggctgtgtcaccatgaccgagaaggtgtggcccgtgggcgccgaggtcagctccactggctcgtccaggcagcctgccttgcaggcatagatcttgacaggctggccacgggactccacggactcgtgtaggtagggcttgccctcggcatccgccagcacggccaggttgatatggtcgttcttgtagcggatgccatgcaatgcatagctgttctgcagcacgtcggggtcggcctggaactggaggtggttctctgtgaactgcagccccccgaagctgagcaccatgccctgcaggatgcctggggcacccaccttcaccagccccttgcagccactcttctggagggtcagcctccacaggtcagagagctgcaggatctgctggacggaggacagcagccccggccacaggttctcggcgtgcatggtggcgtgcccgctgaagcggtgatcttcatagttgagcgtcgactccatctggtctcgctccctgtggctcagggaggggctgagcagcggggctggcgagcaggagagcatgtaatagagcgtcaggttcacggtgaggccagacggcctgtgggtgtcagtgatcttcatttccactcctgggctgaagagctgagcccagaggagctggtggtcttgaagcagctccgccgctggcatctccaagagctccagcatttccttccgtgccaagtcctgcagcgccttgagctccttggctgctttgcttttgggcacctgggggataatggggccagagacgtgcaccacccacagcaccgtctcatccagctgcgtcttgggagccacttggaggcggttcaccagcttcttggcggccaccaccaccaggtgcaccaacccagtgggcgtaggcggggaccggcctgagtagaggaggaactgatggtctccgaccttctccagggtactggtgaaggccttgggggctgggccggcagtgggccccacagtctgcagcgcggtcacgcgctccgtggggttgttgagctggatgcgctgcaggtagacgtggggtcggcccctgtgcgccagaaagccctcttgcagcagcacgcagtcgcggccggaccccgcggcaaggccagagacggaggcgggcccggggccggcggccacggggccaggacctggggaccccagctgcaggcaacgcacgcggcgcagcagcccctcccgcagcagcagcaccgcctctccagcttcagccagcgcgctcagcgggcgcagctgcacgaagggcacaaagtccggcgccacggcgggctcccgctccccgggagtcacccacagccgattggcagccacgtccagggccaggaagccgttggccaccagggccggcactccagggcccagcggtaccgcctcgccgcgctcccgcaggccgcgccaggcgcgggtggccgcctccaggcaggcagacggctcggtggcgcccggctcaccccaggaccagggaagcaggtgcaggccgcccgccgcccgctgcgcgccggaccccccaaaccacagaagcagcagtaggaggccaagcaggcagaggaggcggcgggcccagctgctcgacagcagtcccggcagccccttgagcccctgctgtagccacatcgggccgccaggcgcgggcaagggcgcgagggcggccgccgggcccgccgcccagcccaccggcccggccgcccgtgcctcactgcccggcccagaccgcggcgcccaccccggcccccgccgcaaccgccgcagcagccgccatcgctgcttcctcctccttctcctacaatttaattcttcatttaggtttgtgtctggctgttgccctggtgttgtttattaatgttgatcatacagctattttggcattgcccacagctattgaggataagaaatgtgatgaagaaagtggtagctgcccccagtagaagcttatgaagacgctgtttttagttttaagggatcagttaatctacaacttttcatagagcattcattggtttagatcttaatattatcctgaaactggataatactttatattttgaattatccaattaatgcaacaaacacgtgagggtctatggcattggagtcattgttcacatttattcacccaaacttaactatcagtgctgcttttcctacccacccactcccccctgggcttactccctgaagagcaagaatgatttatttatttttatttaattttttgagacaatcttggtctggcgccaaggctgaagtgcagtgtcgcaatttcagctcgctgcagcctccgcctcctgggttcaagcgattctcctgcctcagccttccgagtacctaggactacaggcatacgtgaccatgcccagctaatttttgtatttttagtagagacgggattttgccgtgttagccaagctggtctcgaactcctgggcctcaggtgatccgtcaacctcggcctcccaacgtgctgggattatagtcgtgagccactgcgcccggccagcaagaacaatttaaacataagccagtttacgtttacgtaaactgcatgtacactccagagtcagagattcacctggggattgtgaatctgcatttccctcctgcctttcagtttaagcatcttgtcattacacgggattttagtgtttataaatgcatgttcacacaatgtggcttctaaactattttgtgtgtatatatatgtattatatatgtatatagatatgtgtgtgtgtgtgtgtgtgtgtgtgtgtgtgtgtgtgtatttgttgttgtcgagacaggttctctgttgaccaggctggagtgcagtggtgtgatcatggctcaccaccagagcctcaacctcccaggctcaagtgatcatcccacctaaacctcccaagtagttgggactacaggcgtgcaccaccacacctggctgatttttgtactttttgcagatatggggttttgtcatattgcctaagctgtattttgtctatttttttttttttttttggtgacaggttgttgctctgtcacccaggcagtggcacaatcttgtctcactgtagccttgacctcctgggctcaagcaatcctcttgcctcagcctcctgagtagctgagaccagaggcatgcactaccatgcccggcttactttttttgtattttttgtagagacgaggttttgccatgttgcccaggctcatctcaaactcccggactcaactgatcctccttccttgacctctcaaaagtgctgggattacaggcatgagccaccacacctggcgtattttatctattcttaacagaaatattcattataattctattgaaagaaatagctgtgttgcatttagagaacagtatgttgatatccactctggcatgccttcctaagggattttcaggttaatatgacaattggagaattgagccaactttagacccgtggtctaaagagaagtcaaaattagtaggagtctgaatccttgccttcaagaagcttgtaatctaattggagagcacatttatactggaaagcacatctataaaacaattcacagtaaagggtgtaaggaatcatgaggataaatggcagccgcaacaactgcaagcattctgtcccattgtccccataaatacaaccaacattgtcaagcaacaagtctagatttttggtttaggaaaaaaggcatcagtatcattagaggggatgggaaagagcaaaagtggctttatctgtaaaggcttcctggaattattgacttgtaattgaataggtgctaggagagagatagataaaagtcatgaggatatttcagacactatggtcgttgggagcatgaaggtgtgaatcaagccaaactgtttatcatttggctaggtggtaggggacacacgggagtgtcacagcagtgaggatcgtcaggagcatcaccagctgactcaggggtgaagataaattctcttgaccatcatattcctcattctcttcactgtctgcactgaggcctttttcgagtgctttctgagccttctcatagttaaagtggtgaattttattgaaaacacttgttttaaaatttgtctattttatctaaaaatttggtcatggctaaatgattaccttgtaagcccttgtgggagccagtgtgatataatagaggtcagaaacaggagtcagggaccctaggttttggcacctcattgtcgtttattagctctatggccataggcaagtcgcttaacctctctgcatcttagtttcctcacctccaaaatgttagaccagaatcagacgtttttatgctatacttttttttttttttctttttttgagacagggttttactctgttccaggctggagcgcagtgacacaatcatagcttactgtagcctcaaactcccaggctcaagcgatcctcctacctctgcctcccaagtagctaggtctacaggtgtgcaccaccacacccagctaatttatttctcactatgttgcccaagctgatctgaaactcctggcctcaagtgattcttctgccttggcctcccaaagaattttttttttcttttcaatgacactttaaaaaaaaattttttttttaattttttaaaattatactttaatttttagggtacgtgtgcacaacatgcaggtttgttacatatgtatacatgtgccatgttggtgtgccgcacccattaactcttcatttaacattagttatatctcctaatgctatccctcctccctccccccaccccacaacaagcagcagtgtatgatgttccccttcctgtgtccatgtattctcattgttcatttcccacctatgagtgagaacacgcggtgtttggtgttttgtccttgagatagtttgctgagaatgatggtttcaaacttcatccatgtccctacaaaggacatgaactcaccattttttatggctgcatagtattccatggtgtatatgtgccacattttcttaatccagtctatcattgatggacatttgggttggttccaagtctttgctattgtgaatagtgccacaataaacatacgtgtgcatgtgtctttatagcggcatgatttataatcctttgggtatatacccagtaatgggatggctggatcaaatggtatttgtagttctagatccctgaggaatcgccacactgacttccacaatggttgaactagtttagagtcccgccaacagtgtaaaagtgttcctatttctccacatcctctccagcacctgttgtttcctgactttttaatgattgccattctaactggtgtgagatggtatctcattgtggttttgatttgcatttctctgatggccagtggtgatgagcattttttcatgtgtcttttggctgcataaatgtcttcttttgagaagtgtctgttcatatccttcgcccactttttgatggggttgtttttttcttgtaaatttgtttgagttcattgtagattctggatattagccctttgtcaggtgagtagactgcaaaaattttctcccattctgtagattgcctgttcactctgatggtagtttcttttgctttgcagaagctctttagtttaattagatcccatttgtcagttttggcttttgttgccattgcttttggtggtttatacatgaagtccttgcccatgcctgtgtcctgaatggtattgcctaggttttcttctagggtttttatggttttaggtctaacatttaagtctttaatccatcttgaattaatttttgtataagatgtaaggaagggatccagtttcagctttctacatatggctggccagttttcccagcaccatttattaacaagggaatcctttccccatttcttgtttttgtcaggtttgccaaagatcagatagttgtagatatgcggcattatttctgagggctctattgtgttccattggtctatatctctgtattggtaccagtaccatgctgttttggttactgtagccttgtagtatagtttgaagtcaggtagcatgatgcctccggctttgtttttctggcttaggagtgacttggcaatgtgggctcttttttggttccatatgaactttaaagtagttttttccaattctgtgaagaaagtcattggtaggttgatggggatggcattgaatctataaattaccttgggcagtgtggccgttttcacgatattgattcttcctacccatgagtgtggaatgttcttccatttgtttgtatcctcttttatttcattgagcagtggtttgtagttttccttgaagaggtcgttcacatcccttgtaagttggattcctaggtattttattctctttgaagcaattgtgaatgggagttcactcatgatttggctctctgtttgtctgttattggtgtataagaatgcttgtgatttttgcacattgattctgtatcctgagactttgctgaagttgcctatcagtttaaggagattttgggctgagacgatggggttttctagatatacaatcatgtcatctgcaaacagggacaatttgacttcctcttttcctaattgaataccctttatttccttctcctgcctcattgccctggccagaacttcccacaccgtgttgaataggagtggtgagaagagggcatccctgtcttgtgccagttttcaaagggaatgcttccagtttttgcccattcagtatgatattggctgtgggtttgtcatagatagctcttattattttgagatatggtccgtcaatacccagtttattgagagtttttagcatgaagggttgttgaattttgtcaaaggccgttctgcatgtattgagataatcgtatggtttttgttgttggttctgtttatatgctggattacatttattgatttgcgtatgttgaaccagccttgcatcccagggatgaagcccacttgatcatgctggataagctttttcatgtgctgctggattcagtttgccagtgttttattgaggatttttgcatcgatgttcatcagggatattggtctaaaattctctttttttgttgtgtctctgccaggctttggtatcagaataatgttggcctcataaaatgagttagggaggatttcctctttttctattgattggaatagtttcagaaggaatggtaccagctcctccttttacctctggtagaatttggctgtgaatccctctggtcccggaccttttttggttggtaagctcttaattattgccacaatttcagagcctgttattggtctattcagagattcaacttcttcctggtttagtcttgggagggtgtatgtgttgaggaatgtatccatttcttctagattttctagtgtatttgcgtagaggtgtttatagtattctgtgatggtagtttgtatttctgtgggattggtggtgatatcccctttatcattcaatgaaactttttacaaataaaaactttactactttactcaaaaccctgttatacaaaacagagctgatctgctagggagttagaagccccaactgcttacctaacccttccttctcagagtcctcccagggaccttaaagctcaggagaacacagctggaaaatccctggactagatcccttaggtcccttctagaatgtaacaatttctgaatcttatattgataaatggagtggaatttcttaaaaacaattttgaggaggcaatgcagttttaaatacgtacgtattgtatgccatgctgtaacatattgctagatacagtgagcaataggaaaaggtaaacacagctcttcctttaagcagcacacttagaagagtaagaggggaacaaaagagctataacttatatatgatattatatgtattatatgtaatataatatataatatataatttattgttataacacaactcatactacatagagattgaagtcaacaagaattttctccctaaacataactacagagattaagaatagagaaaggaaaaggaaaggaatgcgtatgttttaattctgcaaaaagttcgggcacagtggctcagcctgtaatcccagcagaaggataacttgagctcaggagtttgagatcagcctgtgcagcataatgagaccttgtatctacaaaaaaattttgaaaattagccaggcatggtggcgagcacttgtattcccaggtactcaggaggctgaggtgggaggatcacttgatccctggaggtcaaggctgcagtgagccacgatcaaaccactgtaccccagcctgtgtaacagagcgactgcctcaaaaataatatttgtcaaaatagcttgtctttgtatcactgccacattgcttgtttgaaacgaagctgactcactttgttatcataagtgatcttaccaaagaccaagttgtccagttgccttggagtgtaggtcatgcgttgccggtaccctggggctgtgtacaatggccaggctgaggggaccttgtggttacccccatgggacttgtaacttgtcaagtgggaaggtggtaccaagtgaagaagggtagggtccttggttttggcctcacctggttcttcccagaatgaatggtgaaaaaattataattctgcagaaaaatttaaattctattttgtttactttttggatgggagataggtgtacacatggcactaaaattcaaaaggaacttaaggaggccaggcacggtggctcacacctgcaatcccagcactttgggaagccaaggcgggcagatcacttgaggtcaagagttcgagactagcatggccaacatggtgaaacccccccgtctctactaaaaatacaaaaattagctgggcatggtggtgtgtgcctgtaatcccagctacttgggaggctgaggcaagagaatcacttgaacccaggaggcagaggttgcagtgagcaaggtcatgccattgcactctagtctgggcaacagagtaagactccaactcaaaaaataaaaataaaaacagcggcttcctctaggaagtggggctggaagatttttactttttctgttatacttttgtactattgcaagttttaaaatcatgtatttcacagtaaatccagaagaaattatgcacttaatttttctgggtgaattgtgttatagaggtaatagaggattattaaaatttctttctttttttttttgtttcccagatagcagaccccacgttagctgaaatgggaaaaaacttgaaggaggcagtgaagatgctggaggacagtcagaggtgagtaggacagaggtgaccctgttcaacgagttcagcctgctgtgaagccagtggctctgggtcctttctgttaaaggtgcctcttggcttcacagtgtcacacacagctttggctgacttgaaaattggtatttgtcttgggtaaaaggtgccttgtaattaaaggattttgaaattgagaggaaagacttatactatttaattctgtctattaagagtttcatttacttaatatattgatttgactctataaatacttattatatattcaggtcatatagagcaccaagtaaacaagaagtgggtggaacttttttgttgcatattcttgtcttttccagaaattcaaacgatacctgaaactggaggcagggagatgtgataaatgtgtttgaaatcctgcctcagtcactgggaggttataggcaacatggtcatgtttgcatattcaggagttagaaatttggtatgatgaaacaaatgaacagctttttcttttctttaaattagaagaacagaagaggaaaatggaaagaagctcatatccggagatattccaggcccactccagggcaggtaggtggcactgaggatccatacctttagttaaggtgtaaatttttgtttgtttctgagatggagtcgtgctctgttgcccaggatggtgtgcagtggcacaatctgggctcgctgcaacctccgcctcccgggttcaagcagttctttcttgtgcctcagcctcccgagtagctgggattacaggcgtgcaccaccatatctggctaatttttgtattttcagtagagatgggattttgccatgttggccaggctggtttctaactcctgaccttcacctcaggtgatctgcccacctcagcctcccaaagtgctgggattacaggtgtgagccactgtgcccggcctacatttttcttaaaccagtgtcttatcatcattgatttatggttttagttttaatgaacacatagcaaatttaaatagacttatgtgcagtataacattagaaaactgaagtgtcgttggctggttggtgatattgctgcacctgctggcttctctccctctcccatttggaatttaatagatgctaagtacagtgggtcacatctgtaatcccagcactttgggaggccaaggacagaggatcacttgagcccaggagttcaaggttacagcgatctgtgattgtaccactgcactccagcctgagtgatagagacactctctaattttgagacagagtctcgctctgtcgccaggctgaagtgcagtggtgtgatctcggctcactgcaacctctgcctcccaggttcaagtgattctcctgcctcagcctcccgagtggctgggattataggcacccaccaccacgcccagctaatttttgtatttttagtagagacggggtttcaccatgttggccaggacggtctccatctcctgacctcaggtgatccgcctgccttagcctctcaaagtgctgggactacaggcataagccaccgcacctggccaaaaattttttagaaaaccaacaatttaatacaacctcatgagtcaaaagtgatacatggagctaggcaccgtggtgcacacttgtagtcccagctgcttgggagcctgaggcaggaggatggcttgagtcaaggagttcgaggccaccctgaacaacatggcgagaccctatcaaataaaataaaagtgatatacaaattcatcattataactggtgtgtcatacttagttcactcttgaaacctgtcatctatttggtagactgagttttattctaagaggtattttaatttgataagatttattgttttcataatgtaaatgaaaggaaaatgtcaaattacttattttttggcaactgaagcaaatctgtcatgtttgagtaggaggaaaaatagcaaaaaagtaagtagctgactaaaattttcacaagacattagcagttaatctgggattagtatcccagcccagcttccctgagacaaacttttttttttttcctgttataaccaggaaactgcacataagtaaacagtacaactcccttaaatatcctttgacttgaatataaattgaaccaggttgcaaaagaaaagtatggaggaaggatcacagtgtgccaataacacgctgagatactaatactttaaaagtcactcctattcgtagcatgaataatgctgatgtgaagctaggtgtgaagtgcattctcagctcagaacaggaggcaggccctataaaatctcctcattccaggcctactgatggaaaccaaaggttttaaggtttagtctcctaattccacggaagttttcccaggggagatactcccagcagcatctgtaattctcagccttaagccactgactaggaggattcacacttaggagtgctaccacccagcattcaagactagtaacatgccaggcacagctaagtgccataccttcactgtctgaagcctcccaaatccataacgtccggcttggcaagttggaatagcttgctcgaggtcatgtggcaggcagccagtgtgcctcaagggcccctgcctgctctgatctctacagtgtccaaggcccagagcccctctcacttgaagggcagcaccttggggacaattggtttggggacactgttttgatggcgcttcctttgttgaaagaggaaacctctttttagtctattctcattaacagacgaatagccctgcgttattcctgttgcaagttgccttgccattgcttgctacttcagccgttcgaattcttttcgtaactttccatctcctcatgtaatgagcatttcatagcaacacatcttggatagaagtaaaatgtttttatactctaagcagatctcaaggttcccagcttggggaagagctggtaataaatgaagcttgcattgttagaggctgttagtccaaacggacaagatccctatggaggaaaattagatataccagtggcattggagtgttctgtgactgtctagcattatactatactaaggatgattatatattatattttatataatatattttatattttatataatgtatagtatataatacacttatatattataagtacatattataaggcctttttgctcttattacatgcttattaaatattctctgtcttgtactccaagattcaaatgaaatgtatagaaatgttgctagagcaagactggtggctgggcaaggtggctcaggcctgtaatcccagcactattggaggctgaggcaggaggattgcttgagcttggtggtttgagaccaggctgggcaacatggcaaaaccctgtttctaccaaaaataaaaaaacggctgggcgtggtggctcatgcctgtaatcccagcactttgggaggccgaggagggtggatcacttgaagccaggagttgaagaccagtctggccaacatggtgaaaccccatctctactaaaaatacaaaaattagccgagcgtggtggcgcaagcttgtaatctcagctactcaggaggctgaggcaggaggatcgcttaaacccgggaggcagaggttgcagtgagcccagattatgccacttccctccagcttgggtgacaaagtgagaccctgtctcaaaataaataaataaaaataaaaagactggtgacatttattaaaatgaaactcataattaggtagaagatttatttaaccacaagtaaatttatatcggaattcagtttataatttgagctttgttttttaaaaagcataaactatataccacgttctttctcttatagttgcttaagaaagaaaaaaaaaacttgaagcaacgctagttgaatgagggaagtagcgggagagtggcgggggatgtgtgctgttcccatcagcccatcaactctttttattctgcagtgggcaagatatggtgagcatcctccagttagttcagaatctcatgcatggagatgaagatgaggagccccagagccccaggtaatgaacctggcagcttctcttttcaagtgtatgtgttcttgatttcagtagtgattgcgctctgacaagttgctcaaataagaagctatatttcattgagttacatatgatattaaaataatcctttttattttcagaaagacatttatattaatatatattttgtgaaatgaaggcatttattgaaattagatcccatagtttttatggtatcatgccttagagaggcgctggcagaaggactgaagagtgagtgtcggatgtctttctgctgctgtgcttctgcttcctaagaattgctgtagttgtattcattaggtatttagttagttttctcttcaattattttaaatttaatgttttgaaataagtaaaattattctcttggttcaaaattcagacaatgaaaaatgatatacaaagggaattttccttcctacctctatctccctaccatgttttcttctctagagacagacattaccagtttcttgtgtattcttccagagagattttatatgtattatacaccagcaaaatgtctatgcccaccctctctaatacataattactatgcatatgctgtgcatcttgcattttttcacttatgtcttggagttcactgcatattaatgcacaggaactttctcctttgtcagagctatgtgttttactttgaacagatgaaccatattttattttattggtcccctgtcatgttgcactgttacaaacattgctgcagcaaacaactttcgacatgtgtcacttctcatagaagcaggtgtctggaggacaaagtcctgaaagtggagttgctgtctcagacagtgtgtgcttttgtaattttgatagatcctgccaaatttccctccatggagttgcggcatttagcagtcccaccagcaatgtatgagagtactttatttccacacttttcacctgcaaaggcgttatcagactgaaggatcattgataagtgatattctgatgagaaatctgataagtgagaaatggtgtttcagcataattcgaatttgcaggttttttaaattatgaaccaagtgacgtgtctttttgtatgttttaagacccatttatatttctaggaactgtctgttgcccatgatcctattaggtgatttgtctttttcttattattcacagttaacaattgtaaactttttccttcttttttacagttattctttataaggaaaattagttttaattctatataaaacattttatataatcaattttaattatatataaaataatacctagtcccccatgaatttgctgtattattgcaataaataattcttatttgatgcatagacctgagatttaattcttttttttttttttttttgagatggagtcttactctattgcccaggctggagtgcagtggtgccatttcggctcacttcaagctctgcctcccgggttcactccattctcctgcctcagcctcctgagtagctgggattacaggtgcccaccaccaggcccggctaattttttgtatttttagtagagatggggtttcaccatgttagccaggatggtctcaatctcctgacctcgtgatccgcccgccttggcctcccaaagtgctgggattacaggcatgagccactgcgcctggccaggatttagttctttaaaaaatgctttcagctcattttaccttagctctaccctccacaattcttaaggctggtatttaatttttaaaatactttaataggaaattattttaaaacagtttgtaggtactcaatttaaaaagggctatttatctcctggaactcaaattataaaaatatttttctggccaggagtagtggctcatgcctgtaatcccagcactttgggaggccgaggcaggtgaatcacctgaagtcaggagttcaagagcagcctggccaacatggtgaaaccccgtctctactaaaaatacaaaaaattagccgggcttggtggtgcgcgcctgtaattccagctactcgggaggctgagacaggagaatcacgtgaacccaggaggtggaggttgtagtgagctgagatcgcaccactgcaccccagcttgggcatcaagagggagactccatctcagaaaaaaaaatatatttttttctccatctcaaaaaatagaaaaaattctcaccaaactatcactactgtttatgcattgatttgccttctgggccattaagtagatttcgagtctgacagatatttctgtggaattctgtgtctctaagttctatgtccttttttatggtttgactctaatactttaattttgcttaacagaatccaaaatattggagaacaaggtcatatggctttgttgggacatagtctgggagcttatatttcaactctggacaaagagaagctgagaaaacttacaactaggatactttcagataccaccttatggctatgcagaattttcaggtaaagacatgatgagtttccagtgaagacttttatgagtcgggtgtagactgaaagatcttttttctggagctgtactacttgggttcagatttccttctccttgaaaggggtgtttaacctctcaatgcctgtttcatcatctgttagatggggatagtattaatacctatttcatagaagcgttgtgaggattaaatgagctaatggactaatacatgtgaagggtggagaatagaagcacatatgtgtttgatagggtcagcagttatttatttgtggggtatctaattggcacatgtcggtagaagatagagcaatgatctggattcaaatacagttgtcccttatccttgggtgtccttgggggattggttcttgacctcccatcctcaccctatggataaaaaaattcatggatgctcaaatcccttatataaaatagcacagtattttcatgtaactgaggcacatcttcccatatactttaatctcttgattacatataatacctaatacgatgtaaatgctgtgtaaatagttgttacactgtattgtttagggaataatgacaaggaaaaaaagtctgtagatattcagtacagaggcacccatctttttaaatttctgaagattttttactcatgcttggttgaatccacagatgcagaacccataggttcagagggccagctgtgctttgaaaatattagcttgtgtttttattagaaagaaaactctgaggccaggcacggtggctcacgcctgtaatcccagcactttgggaggctgaggtgggcggatcacaaggtgaggagatcgagaccattctggctaacatggtgaaaccctgtctctactaaaaatacaaaaaaattagccgggcgtggtagtgagcacctgtagtcccagctcctctggacgctgaggcactgcactccagcctgggcgacagagtgagactctgtctcaaaaaaaaaaaaaaaagaaaactctgtcataaggaagatgaaaatgtgctatgaaactgaaatttgttttattctgtgataatcctggcagtactaaggaattacaacaggtgaaggattcagtaggagacataggactagtggcattgggtttatgctgttacttttatggagaaggaatgtttgcctaacttgagacatttatcttgagagaccctgactttcagtgttgggaaagaacttggccaagcaggagtataagtttgcccaactttattaaaggagcagtgttctgttgttctagtaaaaatctactgcctgtaattgaaattgtccatcctcctctaggagatggagcctcagcagattatagtaaaaccaaaagctagcctgactagcttttttatttttttgagatggagtcttactctgtcacccaggctggagtgcagtggcacaatctcggctcactgcaccctccacctcctgggttcaagcgattctcctgcctcagtctcctgagtagctgggactacaggcactcaccaccacacctcgcaattagtagagacagttgtttcaccatgttagctaggctagtctcaaaactcctggtcaggtgatccacccgccttggcctcccaaagtgctgagattacaggcgtgagccaccacacccagcctctaactagcatttttgacagttttatttactttggatgttttagggctgaaactctgctatgaactatgcctgtgttatccagtgctggccttagttcataataagccagaaccatgatcttcaggctttttatatctgagaattcctggtctctacttgttttcatagtttctgctctttatggaattgggtatggatggagggttattgtctcgctgcttggtaacctcagctgtaatgaggtgtcagccatctatgatgaggatgtttcacattcctgtcctctctgcctgataaaagtgacaattcctagcttgagaaaagaattgtctccatgattataaggttgacttatacaatccttaactagaaataagagcatattaatatgtatctcttaacagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcaggtaatgtggtatcaggtggctattttaaagaaataatgtcttattttgttctgaaagttttaaagttgacccgtttgtctagttgctgttcttgctgagtgaaaagaaagatggtcttatatgcttttgtcatatttgtaaaaattactgaatttagaaataaggaatatgggatagattacccaggggcatccacagtcaacattttctcttttttcccagactttaatcgaagggggtgtgtttgtgtttatatggttgtatctggctcttttcacttattgttaaaacaggaatatatcattttaataataatttttcaaagtatagtttatttttaatgtcttcatggtattccttcaagtgaatatatagtaattaactgttgcccttttggacaactaagagtgtttgcattctcttgctttctgtgaccattttcaggtaatgttctttgtgtagtgctgttaaggacttctctgtgcataaagctcttcctgtattttatttagggttatggtcctcagatggattttcagagtcagtctagaattgctggatcaaagagcatgactttttttttttttttttttttttttttttttgagacagagtcttgctctgtcgcccaggccggagtgcagtggcgtgatctcggctcactgcaagctccgcctcccggattcatgccattctcctgcctcagcctcccaagtagctgggactacaggtgcccgccaccacgcccagataatttttttgtattttttttagtagagatggggtttcaccgtgttagccaggatggtgtcgatctcctggcctcgtgatctgcccacctcagcctcccaaagtgctgggattacaggtgtgagccactgcgcccagccgagcatgactatttttaaagttcatggtgcttctagcccaactgggaggactacatcgagataagacattgttaaccgtctttgccaagaacgtttgaaagcaaaaccatagggttggagggttcctcttttgtaagctgtaggagtcccagggggatgtatgggagacacttagtgacttttaaattgattctgagctgtgatcactggtgttaagaaattatgtcctcttcttgaggggtgtacaaaatggggagtttaataataatcctctgaaacgtgaaatgaattacttagtgtctactgcaagccaggctcttgcagacacaaggctgtttggggacaacagtctaaccttcaaaagatgtgtaagagtgttctgttgggaatggcagctggcagagcagcatatataagatggttatgttcacgttttttaaagtgtgtgtatcctttatacctatgtttttgtacctagaaaaatacgtaaatttatacctagaaaatatctgaaaggttatgtattaaactgttaacggggtggattggtggcttatagggtagggggctaggcattttcacttttaatacctgtattttttttgaggatttgttttacttgggtgtcacattcataatttttaatcctttaaggagaaaaatgtgcttattaaatttttggtctctgaatgctaccaagtcttagtcatacagaacaatatgctgcaactgtttacaattcctaaaactgtaaactcctcaaggacttggaggctaaacatgaagaatataaaattaagttgacaatcactgtctcctgcataacactgacttcacttctcttgagaaatgtgcatctgctaatccatatttattactttttaggggtgggtgaacccataaataagatactgttctttgaatgcctttagctggtgttatttaccagtaatgcttggagaaagaatccaaaattacccccactaaaatgctcacgacccagttgtttctgtgtttgtcaaagtgtttctggtatattctagaatataccaaagataattacttgaatcatttagaaaattttacattatatcctcttataaggcacttggaaattcacccttttttttttttcggcttggctttctaaatgtactttaacatcaatttataatattaagagttcctaaggagagagatttcttagaagaataatcgtgtcttgtcttagagccacagcctttcacaatctgaagtgaatggtgcagagagctttcttgtcaagtcatatgtttcttcctgcagctcggcttgcccttcccctgcttgtgccgtgtaccctgtaacactgtgtttggatcccagcatcagatggtgagttctacttttggtttgtaaaatcatgtgggattgtgttttgaaactgcctttcaaatgaagttctttttgctggcctccagataattagtaacttactcatgtattgcttggatccttacattgtgtaatatatgcttctgttaatatgtgaatgtccatgaaggttggttggtatataggtcaggagcacctggcttttaaggagtcttgtaattactgtatcacctgctttaagtagaaacatggcagctcaattaagcaccagaaatttcttctgaagctcctacttttaatgagttagcactgttgcctggatttatgaatgggcagattttgaaaatgaggttcttcattgtcatcatggaattgagttctgcttattttcagacatgcaggtgataaatctctccttaatgattccagaaggaaaaggaagggatggattttagagttttttatttcttttgtcaaggtagttttattttctagttcaggtacatcagtgagtaatagtagagatacattcttggctgttttaggagagttaagagaacatttcatttaaatgtaaatgtttaaaatcaaagaaatgttcctgcatatgtacagtttttacctttaattttgtttaactgatttttctagtcttcaaggaaaactatttgattttcacatctatgatgagagaaaacagaaaaattgtcaagagtaagaattgatttgacattacttttgagagttatctgcttcttttgtaagtcataatttttcattttatagcttttatactgggcacctcattttttaatgatttgttttggttccaggatgttgccttcctggagaaactgattaaagatgatatagagcgaggaagactgcccctgttgcttgtcgcaaatgcaggtaggtagcatgatgctgaatctaccattttgaatatataggagcgaggctacgtcctcagcctataaaagataaagtcttaagaaatgtgtgtgtaccacatgtttaagatagtccatatccacattgtagcaaaaactgtaatagtaaggttggctcgttagatttttctttaatcgttggtttgttttggaagttattttatgtgtgtgtatactttttcatttagatggtaaatgcttctctatcttctccttcatgtacttcttttccctgttctaaactgaattttattttatttttttgagatagagtctcactctgttgcccaggctggagtgcagtagcacaatctcacctcactgcaatctctgcctcccgggttcaagtgtttctcctgcctcaacctcctgaattgctgggattacaggtgcatgccaccacatctggctaatttcttgtatttttagtagagacagggtttcactatgttggccaggctggtctcgaactcctgacctcaggtgatccgcctgcctcagcctcccaaattgctgggattacaggcatgagccactgtgcctggcctgaatttttaaatgacacatttaagccaggtgtggtggcacatgcctatagtccctctactcaggagacaagcaagatgttggcttaagctcagaagttcaataccagtctgggtaacatagcaagaccccatctcaataaataaataaaaataattgtactgacgttgtaagattgttgtaaaaattaaacaagaaaattcataagatgtcacacttaaatatctaccttataggcggcagagcaactaccacttgctgctccatttatctcattcagcatcatacttgaaatctaagacagtgcaataaggcaaaaaaaataactgacagattagaaaggaagaaataaaactttgtttgcaggcatgattgtatagatagaaaactaaagaaaagctactggaactaatgatcaaatctaaaccattttctggatttttacatactagcaaagaagaattggaaattgaattttaaatgtcatttataataggatcaaaaaagatgaaaaatttatggataaatttaacaaaatatatgcaagatctgtacattgagaactaagaatgttactgagagaaattcaagaagacccaagaacgatatgccatacacacgggttggaagactaagtattaagtcagttcttcccaaactaatctgtagattcaacttgatccatcttaaaatctcagcaggctacaatttcttaatagaacttgatgagctaattctaaagtttatatagaaatacaagggatctaggaacagcccaagggattttgaaaaagaacaaaattggaagacttaccttgtcatacttcaagacttctgtaaagtagcaagtaagactgtgtgagattaaccaaagaaaatagagaattcagaaatagactcatgtgaagtatatggacacttcaggtttttacagatgcctgagtaattcgagggagaaaggaccatctttttccatcagtggtcttagagcttggatatccatatggaaaaaaactgaatcttaacccttatcttattctctgtatatataaatattaactataaatggttcatcaacctaagcatagatctaagacaataaaatgtctcaaagaaaatacaggagatctttgtgaccttaggttacatttcttaggatacaaaatatgtgaaccataaattgtactttatcaaaaattaaaagcattagctgtttgaaagcccctattaagaagatgaaaggcaagttacagactgggagaaatatttgcaaaacatttttttctttttttttttttttttttgtctttttctatttttattttttatgtttttgagatggagttttgctgtgctgcccaggctggagtgcagtggtgcgaccttggctcactgcaacctccgcctcccaggttcaagcgattcgcctgcctcagcctcccgagtagctgggattacaggcgcacgccaccgtgccgggctaatttttgtatttttagtagagacgagatttcgccatgttggccaggctggtctcaaactcctgacctcaggtggtccacctgccttggcctcccaaagtgatgggattacaggcgtgagccgccacactcagccagccactgtcccagtcctgtcttcttttaaaatttctttttcattcttttccccagaagctacaaaacatttgtttgacaaagaacttgtatctaaaatatataaagaactgttacaactcaataaggacacaagcaatacaattttttttttttttggagatggagtctcattctgttgcccagactagagtgcagtggtgcgatcttggctcactgcaacctctgcctcccgggttccagtgattcttctgccttagcctcccgagtacctgggattacaggcatgtgccaccacacctagctagttttttgtatttttagtggagatggagtttcaccgtgttggccaggctggtcttgaactcctgaccttaggtgatctgcctgccttggcctcccaaagtgctgggattacaggtgtgagccactgtgcccggcccacaatacaattttttaaatgaacaacagatttgagcagatacttcatcaaagaaaatgaaaatgtatagcacttgaaaagatgtttaacatcattagtcattagtgaaatgcaaattaagatcaccatgagacattactacatgtctgttagaatggagaaattacaggtggctcacacttgtaatcccaacacttgggaaggctgagactgcgagatcaattgccctcaggtgttcgagaccagcctgggcaacatggcgaaacccctaggaaatctctacaaaaaatactaaacattagccaggtgtggtggtgtgtacctgtagtcccagctactccagaggctttggtgggaggttggcttgaacccaggagagagaggttgcagtgagccaagattgtgctaccataccccagcctgggtgacagagccagatcctttcttaaaaaaaaaaaaaaaaaattctttaaaatataatgtcaggccaggcacagtgactcaagcctgtaatcccagcactttgggaggccgaggcgggcagattacgaggtcaggagatcaagacatcctggctaacatggtgaaaccccgtttccactaaaaatacaaaaaaatagctgggtgtggtggtgggcacctgtagtcctagctacttgggaggccgaggcaggagaatggcatgaactcgggaggcagaggttgcagtgaggtgagatcgcaccactgcactccagccttggtgacagagtgagactctgtttctgtaaaaaataaataagtaaataaataaaacttgccaggtgtggtggtgggcacctgtagtcccagctacttgagaggctgaggcaggagaatggcttgaacccgggaggcggagcttgcaatgagccgagattgtgctactgcacttcagcctgggcgacagagtgagaccctatctcaaaaaaaaaagaaaaaaaaaaaaaaaggcaaaaaactacagtgacagaagcagatcaggattttccagggccagtgaggagtcagggaaagggtaattatattggggttgatgggatttgggggttgatggaagtattctgaatcttgattgtgttgatggttacatgctctatatatttgtcaaaactcattggaccgtatacttacatgagtgagttttgttgcatgtaaatcatactacaataggccgagcatgagagctcatgcctgtagtcccagcactttgggaggctgaggcaggcagatcacaaggtcaggagttcaagaccagcctgaccaatgtggtaaaaccccatctctactaaaaatgcaaaaattagccaggtgtggtggtgtgcacctgtagtcccagctacttgggaggctgaggcaggaaaatcgcttgaacctgggaggtggaggttgcagtgagccaagatcgcaccaccgcactgtagcctgggcgacagaaagggtctctgtctcaaaaaaaaaaaaaaaaaaaaaaatcatactacaataaaactgcttatttaggccgggtgcggtggctcatgcatgtaattccagcactttgagaggccaaggcgggaagatcacctgaggtcaggagttcaagaccagcctggccaaaatggcgaaaccctgtctctactaaaaatataaaaattagctggttgtggtggcaggcacctgtaatcccagctacttaggaggccgaggcaggagaatagcttgaacccaggaggctgagattgcagtgagccgagattgcgctgctgcactccggcctgggcaacagggtgagactctgtctcaaaaaaaaaaaaaaaagacaaaatagaaaaaccacataaatattcactttattgccaacaggaaaaccatcacttcctgccttattgtttaaaaacacaaattcacccatattcaatcacatgataaactggaggggctgcagtttgcatgtgactgagtgacttgccagtgtgattatgttgcagatgtcagcagacacatgtcaagggttagtcaccagacattgccaagaaatacgaaaagagaatctgcatgcgatccaggcactaacacagcagtacgcttttattttgctggaagagcctgtggcacagcccatgcattgacatttgatcttgtttcagctaaactaaatgtgtctgttaagattttttttttttaatttgaggtagatttaggtatgaggggaaaaagttttcagcccttttcctggcatagaccttacaaaagaactactttctttagctgtgtttgttgaggccgttggtgagtgtttgaaatctttttagttggcttactgctaactggaaatttaggacggttgggggaatgcctgactcaacgttttaactaagctctctctgaaaagggatctccccagcaaaatctgtagtgcaatcaattaccaagggagcggctgaaagtgcttaatatgcttaagctggcttcagaatgcatgttctgtattacaaggaacctgggtggaaacaaaacaaattcatctatatgttttgtttgtttgttttttgagctggagtcttgctttgttgcccaggctggagtgcagtggcacgatctcggctcactacaagctctgcctcccaggttcacgccattctcccgcctcggccccgcgagtacctgggactataggcgcccaccactacacccggctaattttgtttttgtatttttagtagagacgggatttcaccgtgttagccaggatggtctccatctcctgaccttgtgatccacccgcctgggcctcccagagtgctgggattacagatgtgagccactgtgcccagcccacctatatgatttttataaagggcatatctaaatcaaaataatccaggaagtgacaataaaataaaaaggtggaaaagtttatcttggacaaatgctgacaaaatgaaagtaccatagccatattagtgtgggataaaatagacttcatattgatgaaagatgtaatctcctaaaagaaataacagttatacctgctgggcacggtggctcatgcttataatcccagcactttggaaggccgaggcaggtggatcacgaggtcaggagttcgagaccagcctggccaacgtagtgaaaccccgtctctactaaaaatacaaaaaaattagccgggcgtggtggccaccgcctgtaatcccacctacttgggaggctgaggcaaggagaattgcttgaacctgggaggtggaggttgcagagttgagatcatgccactgcactctagcctgggcgacagtgtgagactccgtctcaaaaaaaaaaaaaaacagttatgaatgcttgtgaacataactttaaaatatataaaggaaagctaaaggaaaagtctgatgtaacacaagtatatattgacaaaccacaatcttggtgggagatttgaatatatttctcatgagtcagcagatcaagtagatagaaaataagtatataaaagaattcaatgacacaattagatacatgtaatagagattacatactcttcaaagcttgtaataagtcaactcacaaacactgattttaagtccttccacaaagaaaatctcaataaaatagggatataataagtcacttccctcctagggcgataatgtgtataaaagtgtttaaggtataaagccttagaaaacatttgttccttttaatgccctgatgtgttttatcctaggaacggcagcagtaggacacacagacaagattgggagattgaaagaactctgtgagcagtatggcatatggcttcatgtggaggggtaagccggcggtgaggctggtggctccattcgggcctgcacagagtccttatgaggactggacatccaggctctcactttggtgacatttatcacgaagggctctttgggtcacagatcacaaaataacccaaattggcttaagcccaaagagatcttactggctcacataactacaaagagcagtgttatgactgcctcaggcacgacatcaaccaggatccagtgtgttactcccacctctgctcccccagtcacaggcactgggcttggtttcctctatctgtggacagatcttcctgttacagtgcaaagtagctgcagaaactccagccttctttccagcttcgtggtcagctggaagtcctaacagaagtctcgtattgaaccagccactgtggccagggagaagtaatcctctgatagttgaggttctttgctctcctctggagcagatagtggtgtctcctccccacaaagctcatgttctgctggaagaaatggagatggcgccctggaaggctattgtagggccattaagagaagcagggggaacggacgtgggcagccagagtagcccatatccaccacatcatacagggaggtttctttttgatccctaagtaaagaatgataactggaaaataagatccatgaaagagaagaatactcccattatattaaatgagcggggatagttcctgagacacatttttattaaagtgcattttcaggattttccttcatatgtataaagcacaccttctgttgctgttaatgaaagctaataacattaaaaatatacttaagtgtcaacttgcaacagcacagcctttatttttttaagtacatggtgagtaagcaacattaaataattagttcttggactggtgttttttcttccagtgtgaatctggcaacattggctctgggttatgtctcctcatcagtgctggtatgttgttgatttactgaatattggtgtttttaagaatgaatttaaagtcactcagtccctcatggctcttcacagtttttatgaatggaggagggtgttaggtttgtgtattctgataatctaacaaagagttgttcttgttttggtaggctgcagccaaatgtgatagcatgacgatgactcctggcccgtggctgggtttgccagctgttcctgcggtgacactgtataaacacgatgaccctgccttggtaagtttccactcactggggagggagtgggtgtggctaatacacattattggctttgggggcaaaatccagaaaaatacaggaaaaagtgaaaaatacccataatttcacttctatttcatttttttaaagagaaacttgtgagactttttttaatgacattttatgattgtataatattctgtcacaatttaattattctccatttatgaacttataggatgttttcagagttttgttactgaaataatgaagcagtgaacgtctttctgtgtttctaattatttccttagaataggttcccagatgtggaatgactgagtgggggagttttaagcctcctgatccacattgcccaataggttttaactttttttttttttttttgatatggagtctcgctctgtcacccaggctggagtgcaatggtgagatgatcttggctcactgcaacctccacctcctgggttcaagtgattctcttgcctcagcctcccaagtagctgggattacaggcatgcgccaccacgcccggcttattttgtatttttagtagaggcagtgtttcaccaagttggtcatgttgaactcgcgatctcaggtgatctgcctgcctcggcctcccaaagtgctgggattacaggcatgagccatcacacctggccacatttttttttttttttaatcgtagttgtgggccaggcatggtggctcatgcctgtaatcccagcactttggaaggttgaggcaggcagatcgcttgagcctaggagtttgagaccagcctgggcaacatggtgaaacctcatctctataagaaaaaacaacaacaaagaattagctgggcatggtggtgtgagcctgtagtcccagctactcatgaggctaatgtgggagggctgattgagccctggagatcaaggctgcagtgagctatgatcacaccactgcactgcagcctgggcgacagaatgaaaacgaaacctgtcacaaaaaataataataataatgtggttcttgataatataggtcagcgtgcaaaataaggtttaagtgatttctgctaaaacactgctgtcttgctcagctaataatggccaggtgtttgaggatgctcagagctaccttcgaagtggggagtctcctaggttctgggatgtgacccatctgggttttccactggcttttcctggctttgccactcctgagctgtgaacccttggacaaaccgaggtctctgagtgaagttacctagaatacttagctcacagagttgttggaagatcacatggataatgcaagcctagtgactagtatggcatctagcccacactaagtgggtagcaaatggtagctggttagttctattatgagattgcaatggctttgattaataaacctcttttggcttttttagactttagttgctggtcttacatcaaataagcccacagacaaactccgtgccctgcctctgtggttatctttacaatacttgggacttgatgggtttgtggagaggatcaagcatgcctgtcaactggtgagtagaagcctgacatttaaatgaaagactccttggccacagcagagacagaaaaacatctcatttctgtaccttccatccagagtggtgttgtctggattgactgtctcgtgagccagagactaatcgccctgcatgtaaatatttcttgttcaaagttctgggagaaagtgctgggttgtctgtcccagcatttgtgtgcagatgaaatcagatgaaaaggaacaccactgtcagcatgggatcagaaaagaagtcacagatgacttccaaggagtggagaagggtgcaaaaggtggaggggtggggagcgagtgttccccttgattgactgactacggtgagggaataggaaggttacaaggtggttatggagggcatggatattttataaaccagctggcttgggtttccaaattgcagggctcttggggacaattctaattctctctccattttaggtgtgttctaattgtgaaaaatatataattatgctatatttcagtgttttagagcattcaggcttctataacaaaataccttagagtgggtaatttataaacaacagacatttattgcttacagttctggacgtgagaagtctcagatcaaggtgccaggagattccatgtcgggcccgttcctcatagatagtgccttgcatgtggcctcacatggcagaaggggtgagcacagtcccttgagcctctttcagaaggtcactagtcctgtttgtgagggttccatcctcatgccctaatgacctcccaaaggcctcaactcatttgcgattaggtttccacataggaattttgtggggacataaatattcagatcatagcatttagaaagcaaaaaaacaggctgggcatggtggctcacgcctgtaattccagcactttgggaggctgaagcgggtggatcacaaggtcatgagatcaagaccatcctggctaacacggtgaaaccccgtctctactaaaaatacaaaaaattagctgggcgtggtggcgggcgcctgtagtcccagctgctcaggaggctgaggccggagaatggtgtgaacccgggaggcagagcttgcagtgagccgagatcgcgccactgcactccagcctgggtgacagagcgaggctccgtctcaaaaaaaaaaaaaaaaaaaaaaaaaaaagccaaaaaacagggtcatgtttactcagggttagagctgagccctccctaagctcagaagtgcgtcacctccattttcttacctgtgaaatataaattatatgacaaggattgccaggatggctcgaggaacgaatacaggtagagctcttgcagtagtgtctgttcatatagtaagttatgcacgtgggttgaaatctttgttttaaatatattcttggggagttagcacttcctcaagtatcatttctatatttaagaaacataggtggccgggtgcagtggctcacgcctgtaatcccagcactttgggaggccgaggtgggcagatcatgaggtcaggagatcaagaccatcctggctaacacggtgaaaccctgtctctaataaaaatacaaaaattagccaggcatggtggcgggtgcctgtagtcccagctacttgggaggctgaggcaggagaatggcgtgaacccagaaggcggagcttgcagtgagccgagattgcgccactgcactccagccagagcgaaactcagtcttttaaaaaaagaaagaaaaataggccgggcgtggtggctcatgcctgtaatcccagcactttgggaggccgaggcgggtggatcacctgaggtcaggagtttgagaccggcctggccaacatggtgagactccgtctctattaaatatacaaaaattagccaggtatggtggcaggcgcctgtagtcccagctactcaggaggctgaggcagggagaattgcttgaacttgggaggcagaggttgcagtaagccaagatcgtgccactgcactccagcctgggtggcaccatctaaacacacacacacacacacacacacacacacacacacgaaaagtatttgcgtagtgctctagcagtagtcccttcgttcatcatatgttaggatagttcaacagttttaagtatgctctgggctgggtgcagtggctcatgcctataatcccagcactttgggaggccaaggcaggtggatcacttaaacctcagagttcaacaccagcctgggcaatgtggtcaaaccctgtctctacaaaaaatacaaaaattagccaggtgtagtggcacacacctgtgatcccagctactcaggaggctgaggtgggaagatcacttgagcccaggaggtcaaggttgccgtgagcccaaatagcactactgcactactccactccagcctgggcgacagagtaggaccctgtctcaaaaaaaaaaaagaaaaaaagattgatgctcattatgtttacaaaagcactgcattttttgaaaagtgtctcactgtgctattagctcacttcttgagatgtggttcttaggaaagagaagccttagtaacttagtttagagacgacttgggcactcgggagattttttcaatatcccgtggctatggagtgcgggagaatgatgccattaactaccagacccttgaggtcagcacagctctggcatcttcctgcaggcagaaccgtatactcctgaggatttgaatgctgtcctgctgctgactcacaggctaataaatgcatgtgttaaattacttggacatttagcagacatggtgatctgtatatagccatgccttatagtccacagtggagcatacatttcctgagagcgtaaatcagcattcgcctcctcatcctcctcttccttctcttctccctctcttctttctcgtcttcagtagttattgagcattcacctcagtgtcaggcaccatgaagtactttcatgcatcatctcatttgatccctgcaacttcactagaatgtcagttccactgatgacagtgtattcagaattaattttctttaagaaaacaaaaaggaatttcttgaggggctttctactgtccagtactcagtgaatatctgttgaattaatatactccaatcccatgagttagatatgattagtgatgagggacctgggattgagacattagtctaatgacactacattctagaccctgtttctaagcacttcctgtattgcatatcaactcatttaatcctcacagcaatgtgagatacatactatcctccccattttataattgagggaactgaagcatagacaggttacatagctggtgactggcagatgaattgacttatccgtggtcctgcaggtgatgagtggcagcactgtgctcttatcaccagctcttgagcgtgctgcatcctctcatttgtcgttggtctcccctagtgttcagtactgtgccttgcacgtgtttatactcagtagcttttgaatgacagacttacattgcaaatacaacagatttccatgtcttattagaaactgcttttcttgaattactacatgtaacttgaaggattggtgaatatttacagttgttgaaatacaaaaacaggtggctgaacttagaaaccaccaagtggcaggtgactttgcctgacatccgtgttcacagacctccacagcccctggtgaaaaccacttcttcatgtcccacgtccatctaattacatgtgttattttttgtcatttgcagagtcaacggttgcaggaaagtttgaagaaagtgaattacatcaaaatcttggtatagtatataagttcatctgttttcaaaatataactttttttgaacctcagcaactttgaatgattttagaactttagaatgattttctccacatttcagtggaattgtggcagctccagtaaaaaaacaaaacaaaaaaacgaaacaaaaaacaaaaacaaaaaaacctgcttatatttatacagtgagtctgaagcgaagaaatttgaaccatacaatgtttaattcctatggtgcttttcatgtacttcatttattgtgttaaagttcagaattgcacaaagataaacaccattgacttcagctgcccaaggccttgggcacactcttcttcccaaaatgaaaagtcactttgtgcctcagaatgctttggggttctctttctgcaaccttctgccatcagttttcatttgcatgaagtgggagaaagagaaaagcaaatggccctgctcttgtcttctgatatcttcctgaagtgaatccaacagattgttccctaggcataactagacaaggaaataaggacttaggagagaatggggatcagttcaggtttgaaagtttttgtgttttgcttcatggtattttagaacttcaggaaatatatgtcaaattctgatttaaataggttcattgagtgtttctttgacaattctgcaaggtatgcttaagtttaacatttgagtgtatttggggttcaagtcagtaggtttatttttcttttagaacatggtttggtttaaatacaaaaagtagccgcgcatggtggcacacgcctgtagtcccagctactggggaggctgaagtgaaagaattgcttgaacccgggaggcggaggttgcagtgagccgagattgcgcctctgcactccagcctgggtgacagagaccctgtctcaaggaagaaaaaaaaatgcatggtttggttgaagggggtgtggctactctgccttctgagtgggagtctggagccagttgacccgagttctagctcagtgggagttctatccttggacgaggaagtggaccactggagaagcagaagggatgaatctaagttcagaggcctgggctctgctctgagcagtgccacagggtggccctgtgacattgagtcattttctttccaagcttgactgtcaaatgaaagtatgccggttggtctcctctgattgcaaacagagaagcaaattatggcctagattgagcaagctgttaagaatccaggcggtgctgggcccatctgctttcctgcccctgccatgttgagcgcacttggcttttcctcagtcatcgctgctcccttattctcaaattgggggacccagtggtgctagttaatcaccagttgttttggagcatctctgtaggccacactggcccaggcagaaagcctgctctgtcccttcttccaatggctgttttttcagtagaggatacaataattggctaataccatgaggcattatggcctgtgagtcctcatcatcaccatcaccatcaccaccattccagctgctgcttgtgaaattcatgtgtggtactaagtaccttacatgaattatttcatttaaccctcccaacagtctcctttgtatgtgctgttctctctgcctggaaacactgtttcccaccccccgtccccaattcttctgtttatttttttttgagacagagtctcactatgtagcccagactggagtgcagtggtgcgatcttggctcactctaacctccgcctcctgggtccctgttcaagcagttctcctgcctcagcctcccgagtagctggggttacaggcgcatgccaccatgtccagctaatttctgtatttttagtagagatggggtttcaccatgttggccaggctggtcttgaactcttgacctcgtgatccacccgcctcagcctcccaaagtgctgggattacaggcatgagccaaagcgcccagcctccccagtcccaattcttctcatgactggtttcttatctttcagatcttaattcaaatctcacctcttcagaaaggcctttcctggccaccctaagatcatctcccaccgtcagacatcactccatccccctgggtcgtcttcatcactcttactactatctgaaatcaaatctgtttgttttttcctatagaaggtttgtaaaggccttatacagactcaccactgtgcctcacctgggcattaacacccaagaccctagccctgaaagcccagtgccaggccccagacatgctcccatcccctgccactcagcttacagtcctctttctgtttcctcttctttgtggattcacctttttttgggtgtgagcccagccatggtttaacctttttttggttcttggttatatttaatccagtatttcagatattcagaattgacaacttcagtgttcactcagtctatcacgttactagaaccagaagtgtctccaaccctgtatactatttcttacacacattgacatttgagaccactgagttcaaagaaagaaaagatgatcataatattcatagcagtcttggcactcacctcattctgccatctcctagctgaggatgggagaatgggcggattattttgttgcctttttgttcctccttgcttattgggcgtgcgcccctatttaaatattaagcaccgcccccctgccgcccgccgccgtacctttaaaagtatcacgttttatttgtctctgtgaaagttaaagatgatagatgtgaaggcacttagcacaggactggccccctaaataattggcagatttgaattcacatcctgcttggtatgaatactgtccacacggtcctttgaaaagttagtagaaaagatcttgggccactgcttcttgtctttccaagttagcatttcctgttgcggccctaccagtgagtcatcacactcagagccttggaacataagttttattactagagctatagtactgggattgttggatgcttagagatcttccccctccagggccacccacactcccctacagtaccacagagcctgccaaggacatggatgcttacggtaccctgaccccatggcttgaccaagtcagggtatactgtttgatgcaaaacaggaactcgctgctggattatcataatacataatgcagtggatgttttcaactgttaggaaacccactaatgaagttagtcgtcttcggcctgtctttaataataattaaatatattagaaaatacacagatccagttctcagctgtgcttgtctacatcaccagcaggacttgcatcttgttctgaaagttttgcaaaggggaggaaagtacttgttgccccctctttttttctatgagtatgaaaaattctagttggccaggcacggtgtctcacgtctgtaatcccaacacttggaaagccaaagtaggaggattaattgaggccaagagttcaaggccagcctggacaacatagcaagaccccatctctaaaaaaaccgtttaagtttcaataaatcctgcataatttctgggattcttgaaagcatgggctctctccgcactgagtctagtttcactgcttcttactggttttaatctttaatgttagacctatgtttatcccttattaaaatttccccctgctttaatttcaatgtaccagggtcaaacatcttataattcacagtgtactctcaaggctggctcatagttattttttaaaattttactaaacatttgatttttctctagcaactgaaattaacctctgaactttttagtgtgtttatttacaaatagagcatttctaagcgagtttttgaactcagcatttcattttgaaggcgtctggagtttaatgttacttggtgatatgagacttccattcttccaggtggaagatgagctcagctccccagtggtggtgttcagatttttccaggaattaccaggctcaggtcggtgaattttaaaagagggttattttcatatctgtgttaaaggctttgaatttgataccatttcaagttaaatagttcaaaatatttttattgctgacaatcttcagtcagcatttcagaaaaatgtaataattttcatgaaaactacagtccgaaacgccttagcaatttgctgatagtttgcggtgattaaaccaggggttcccaaatgccagtccctggaccagtgctggaatggctaagaaagagttgcttgaacataaagatttgtgggtcttacttcccacatattttgagtcaataggttgtgcccaggaatctgtatcttaaagaatgacccaagtgccaccagtctagtccagggcaccactctttttttacctggttggccattgtcccctgtcaactgacctctgactttcatacattctacacagcccattccagaccattctccacctggcagagagggttataagtggaagtcacatggtgttgaaaccggaaaggttcccttgtccccctcgcagggcatgtgatgggggtgtggctcgcttcttcagtgccccgctgctgctcagacctctaggagagcatacagacgggcaggctgtggggctccgaccccatggcagcatctgggggtgaatgttttacagctcctaaggctccagcgggcatgtgttacagtgtgctcttttaatttagccgtctgtaggcagcttgttttagctcacttagacccccttccttatcacaaggacagagggattaatgtatcccaggttcttgtcttggtgtaccggaagaatgggatcacatgtgggcttggagaatgagtgcaaggttttattgaatgaaagtagctctccgctgatgggggagccagaagggagacagatttcccttggagttgggccgctcagcggccctggccaaactccgcctcgtccccgtggttgatggcctgctggcttgccggggcctgtcggggtgctcttctgccggcctgctctccatgaccagccgcttgtgtctttttccaccaatgtgttcctctggccatccagccacttctgtctgcccactagggtctcaggtttttataggcccaggatggtggtgtggtgggccagcgtggtcttgggaaatgcaacatttgggggaaggcaggagtgcttgtcctcacctaggtccgtgggggtagagtcctagccagggacccgcctttctctccccagcacttcccttccccgcttctgtgtcatttaaagggaccacgctcttcccttcccagcactcccgtatcagtgtcacttccctgcccagagcccctgggtatcttaccatttcggtcgaacaaaggccaggctctcccatgccccatgaggcctgcacactctgccccgaattcgcttctgccttccccccttccactctccctcttgttcgttgtgcctcagtcagaccagtcttctccgcgctccagaacactctgccctttcctaccgcaagggcttaacactcggcgttccctctgtcttacacacatttctctcttctggtgccagctcctcctcaccatttcggtctccactaagtatccacatcctcagccttccctgcctatcgtgcctgaggggactccatcattttctatcagagcccccagcttcacttgtgacactaacaaccacatggagtgattttctttctttatggtctgtttcctcaactaaaatgtaagctccaagatgacagaaaccttacctgccttctgtcccaagtgtcgggctctgtgcctggcacgggttggcacccactgtgaggcctagttagatgatcgtggcactcacagacctcgcacggtgcttggtaaactagttagtaacttaaaacaattgctgtttccccttgaaatcccttgaaagcaaaccttttcaaaaatgaaattaataattctgtcttatgtgaatgtattcaagtgttacatagatcacgaggaaaaagaaatgtagcccttctgtcagataatacatgagaattcagtaatacgagtcagtgccctggggctaatattgggatgggaatgatgtggggtttggagggtgttttttttggtcagccgtgtttctgggagtgactccctttctgtgttttggtgtcagatccggtgtttaaagccgtcccagtgcccaacatgacaccttcaggagtcggccgggagaggcactcgtgtgacgcgctgaatcgctgggtgagaatggcagtcacccccctttcctttcaggtccccgtccatcaccatccgacctgctggtgagggtgacgcgtgctcgtgtatgggaactgaggcccacaggaggagccgccctgccagtgctgggcctgctctggagttctgttccccattgcgttaccacctcacgagctgggtcacctctggcaagtccttctggcattgctccctcactttccttgctgctgtataaggctgtgagacaacaggcaaaaggtgggctgcagggcagctgcggtgggttctggtgagcctgggcagcacagccgggagccccaggcagagtctgccgagcatctgcagctggcagtgtggagccaggcctgcactttgatagcgttttgggcactgaatagcagctctaggatttgagtctgaagggtcttgtgaacagtgtgggatggcggcagcagcagttctagccaatgctggacacgcccagcctagcagggttggcagataagtcctggtacatccatgctggggctcagcacagctgtgagagaccacagagctgagtgtctcaagcagaaaggaactggtcataaacgaaatgaatcaatgcaggttactaagcagtgtcaagtagcatgttttatgacaacaactacaactccctgcccgccactaggagaaaagacgctgggggcagaccacatgtcagcagtgggtgtcgcttagtaatatattgtgggtcattgttattttcttctttttgtttacttgtatttcctaaatttttctacaatgaacttgtattaataagaaaaaaccataaaatttactgtttttaaaaagctgctctaagtaatcagacagtcaaaagagcaggaatcagctctccaggaggctctttggtctggggccgaggggatgagggtgggtcctgaagacgtctgagtcccttgttacaggagggtgttcattgtgtcctcctcacagctgggagaacagctgaagcagctggtgcctgcaagcggcctcacagtcatggatctggaagctgagggcacgtgtttgcggttcagccctttgatgaccgcagcaggtaaaccaggcttggtggacatcccttgcttttgttctggggctgctgggtagattagcttgcccttatgatactccattctcctagagttattagcagctctttttggaggggcattttcttttcttttgggctaaatttaggtagattagcattcccatgtaacttaccagaatcagaatgagaattcagaagtcacctgaattggccgggcatggtggctcacacctgtaatcccagcaccttgggaggccaaggcaggcagatcatctgaggtcaggagttcgagaccagcctggccaacatagtgaaatcccgcccctactaagaatacaaaaaattagccaggcatggtggtacacacctgcagtcccagctacttgggaggctgaggcaggagaatcacttgaacctgggaggccgaggttgcagtgagctgagattacaccactgcactccagcctgggggacagaggagactccatctcaaaaaaaaaaaaaaaaaaaaaaaaagtcatcacatgaattccttttttgttgttgttgagacagggtcttgctctgtcacccaggctggagtgcagtggtgcgatcatggctcactgcagccttgacctcctgggctcaagtgatcttcccacctcagcccccgaggagttgggaccacaggcatgagccaccacactggactaatttttgcattttttgtagaaatggggttttgccacgttggccaggctggaattcctatattttgatgtcttgtgactctcgattttccactacaagggttctcactccccactgcacattagagtcatccgggagctttacacacaaccagtggccgcccacccccagagattctagaatggagcctggggatctgtgttttggtttttattttttttttagaaacagggtctcatttgtcaccctggctggaatgcagtgtcttcaccatagctcattgcaacctcgacctcctgggctcaagcaatcccctgcctcagcctcccaaggagctgggactacaggcgagcaccaccacatctatttttttttttttttttttttttccatagagacgtggtctcactctgtcacccaggctgctcttgaactcctggccttaagtgatcctcctggctcagattcccaaagcactggccactataaggattgcctggccacagctctagatacttagtctctaaaactgcaaaagtaagccagtgagccctgaggcccggcgctgtcaccatctccctgtccttcctgtgtggggacagcagcccaccacagtacttccctttctctcagtcataggaatgtacagaatctgtggttgcctttttgtgctgaacctatggtgtgatgtctccagcctgcctgaagtaggcttgctgtgggaagagtgatttctaacactggagtatgtcattgtgggccacatctgtgagagaaacactccacacctgctacagccagctgtgtctgtttctaaccctaattcttccatatctgtgttgagggcctttttttgtttaaatctccatggctcccggtaactggagtacctcgagcttttgaccttcccagtagtggaagagggagccctgccctcttgtcattggccatctcgtgagcatttctctgacattgtgaacatcttcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtaaagtcttggcctgccgcttgatgttggagacttttctgtataaagaacatgagtgggtcattttctgaaccaccttagaaatccaagatgaacgtgtagtcacaatatgcttaacgaaaatgcaactcggttttctgggcatttacaaaagcacagtgcaagcaggcaatttggccagcgtggcgctcagggaggggagttgctgaatgttctgtctgtaggtgccgactctcagctacctaggagaagatgccaacaggtatatatcactcactgagaatggttactatccagggcatatagagaattgcaaatcagtaagaaaaagaacccagctctcggggagagaactgggtgcagtcctatggctgctttctcgccttcagaggtgaggcaaacctctttttgtattgcccatgagacttccagaccttgtatggaactaaagacttaggctttcagctgggcacggtggctcatgcctgtaatcccagcactttgggaggccaacaggagcatagatgacttgaggccaggagcttgagtccagcctggacaacatggcgaaaccccatctctagaaaaaatacaaaaattagccagaggtggtggtgcacacctgtagtcccagctactcgggaagcttagatggaaggatcaactgagcccaggaggtggaggttgcagtgagccaagatcatgccactgcaccccagcctgggccaccaagtgagaccctgctttaaaaaaaaaaaaaaaaggctttcctgtgactttctctttactcctggcacacttccagaaagtttgtggtctggagacactcgcagtagctcttttgcccactggttccactgcattgtcttgctaatatttagaggtttctaatcctgtatcagaagagacatttgatcttttaagctgaaatgctgtggtttgatgttgttttaggtatgaacatgctaatgatgataagagcagtttgaaatcagatcccgaaggggaaaacatccatgctggactcctgaagaagttaaatgaactggaatctgacctaacctttaaaataggtaactgcttactttgtaagtcagctgtggggtttggaaggacacttggtaaccggctttgaagacgacggctcatcccttagcgggctagcgcctctcgggctgggttccaggcgaagatgcggttctgagacctccctccccttctgcagccttgccaggcctttctctccgcccttagaatctccatggaggagacccctttgtgtgtggtcaggaccctgaacaggagagtaggtccacgtctcacccatgacagaggactgagaaactcaagtttgtctcgttacctttgcaggccctgagtataagagcatgaagagctgcctttatgtcggcatggcgagcgacaacgtcgatgctgctgagctcgtggagaccattgcggccacagcccgggagatagaggagaactcgagggtccgtagcacccatcagtgttcattcctcttctgagttttgtcccaccaaacagcaggggccacgaggaaagcagctgcccttgggatgtctgttcgttgtctctcaaagtctgtcaatgtttcctgtaagctgggccttgtgccaggtgtcagagatgccaagtaggtttgacacagcccatgccccagtgatctcacaagctcagggggaaagatccacatagccacgctgtgtagtaaccctgccttagagaagagggcgggtagctggacactcaggcagacacattcacccctgccaccaaggtcagggaggacttctgctctggagctgtgtcctgagggtgaatgaaatgggctgttgtatgtgtggttccccctacaccccttccctatagcacttcccaccaggaatagacctactgctgtgggtcccttagcatggaggaccaggatacaaggctgataaggtatcctccaaacagatgattacttccctaaaaatcactcaaaaggagagaagagggaccaaggtaagactgctctgaaaggagagagacacgagccattggacatgcggccgagaagccagcttcattcctttctgggtggactccttaaggtttctttccagcctgactttatgacttctctgttttcaagaatacgtagcaaatgaggctggtcaccaaggtgtgtctgcctaggcctctatgagcatgttatctgcttgtctttgagtttctgttcgttttacgccggcttttcaatgcaggatttcattgacctgcttttgaaaaattccctcagtgctgtgttactagctcttctgggccccaggtgagaaccttaaacaagtaatgtctttcttggtcttgccacagcttctggaaaacatgacagaagtggttcggaaaggcattcaggaagctcaagtggagctgcagaaggcaagtgaagaacggcttctggaagaggtgaggcccccgatgggcagcaggctgggggagccgccgtgaggccaggtggccctgaactctggtcctgtcttgcagggggtgttgcggcagatccctgtagtgggctccgtgctgaattggttttctccggtccaggctttacagaagggaagaacttttaacttgacagcaggtaggacggcatagcctcttcccaggtcttgctgaccttgggaggtttcaccaaatgcccttgggtcccaacacttcccactgagaatcccgccctggttcccgttcttcatcactgggtgtgggccggacatctgaggagacaagttctggtgtgccctgtcctcctccccaccgcaccctggcggctgaaacagcaaggaagcagctacccactctccacagctgtcaccaccgcaaggccatgaggacacgcccactcagccgtgcagactctcagggtgctgtgtcttgggcattttggttcagggttaatacttcttgtcttcatgtgtgttctgccccagcagaggacagcttttgcaagtggcaatgcagagactgaagcatggagtgctggcacggtttattttgaaccaggcagccagcaagcgtttcagccgctggaatgtggggagggtgttaacagtccgtgactcctttcctgttctaccaaggaaataatttcctacactcgagccccttccttcattctttcccaggaaacgatgactccattgtcatgaaagcaaaagataatctgatttctaatctgccaagccttagccttcagcaaaaaggcacccacttcttgtggctacagtacgtttccctgttgggcctggctccctgggtgtgcttacgccatactgctggcggatgctggcggtactggccctgtgaggtggctttctctagctcacggcacattcataagtgcccttctctccaccagtctgtggcaggctcagtggctggaaggaggttattggggagcaaggctgtgtgagggcaggtggtgtcttcaagggcagcctgtgcctgtagcttctacccagccctctcctctcccgcaggctctctggagtccacagaacccatatatgtctacaaagcacaaggtgcaggagtcacgctgcctccaacgccctcgggcagtcgcaccaagcagaggcttccaggtaagtgacgcctctgcaccgagttcaggtaacaggtttcccctgttgactgttacttgcgtttgttttctgggttcttgaactccagaggtctatttctcttaagaccaactactaccatctctttaaccatcttggtagccgtgggattcagccttgaagaaatcccacggtagtgcgctaaggggaagttggggtcttgaaagatgacattgtcactgtggtgtttaccctcctgggcgtttcctaatgaagatgaccttagagttccccggcctggggagcatgttggtgtcaagctagcagctctcggttttctcatctcctaaaacacctcagagccagtaaaggtttctgctgaagctgtgttgtgaaataaagcaattatctgttgcagagacagcctgtgttgcagaagtatcctcactgagtttcagcgcagtctgtctgccctttctgtaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaccagtgaattcagtttataaatcttattacaaaagacttacccacgtacctgaaatagctgccgatagaccagtgagaggtaggttctcctctgcccgttattaccgaccaaaaaaaaaactggacatcaattttttagtaaaccaaaaaataagtctcaacaaatgcctttgccaaaataaggttttattttgaaagtcatttgatgaaagtcatttgaaagacactgaggagggaaggaggcctaagacccaacagatgtaggatccagatctggattcgtgccagccccaccaatggtctgtcaggccaagaaggtgctttctttggtaattcatgttttttaacttcctggagaagagatcttttcccacaagccatcttcattttttttgtagagtagggctttatttccagaaaacagtgtgtgagctggagatgggtgtttttttaaaaacatcaaggtagatctaatatgttcaacaaagtggggtggctcagccagaggcgaagtggaaagattctgaaaacacaagatggtgggcattagagaagccaaccttactgtcccctgctgtgataaagatgtcaaagtatctttgttcttggacacaaatatatataataaaatacgttaagaaatgaggtggcctgaattagtaagaaaaaagttgattgcttactgctttacccacacacatttccatctaggacttgacatatccccatttgatatacaagttaaatggggtctgtcaatggcatccaaaaagttactacccgccaaagggaaagcagctatgacctggtctaaaccctttttttcttacagatggggaaaccagggtgcagagatttaagacttacccagcctgtaaactctcacctctagtatttgcttgtcatcttggtgcaaccagaaatccacatgtggaaatggtgtccaggagtacggtcctatacgaagttgttctgtctctgcatcataaatgctaatcatctaaaaaagaacgtgtcaaggatagaatttcaggaatgtcacccacttttcaaaccctcccagtaacgcaagctccagtgtagtcctttcatgcatttatctgcctaagcttcttaaaacctgtctcaaataacaaaagctgccagctactgaacacgtccagtgtgtctgcttctgcacactgtggggcacgcacgactgctgagcgccaacagcagtcccacaggacgagggtgttttttcccatttggggtgaaaacttgaggctcagagaaacaaggcccatttcccaggttacgtgtccagtaagcctcagagctggacctcaaacccaggcgcttctgactaaagtctgtgttcccattgcctcattatttataccccaaacaactgatcaccttgcaatttaaaagcatacagtgcctgctgccccatcaaaagaagaagctaatttgccaaatgatccagtccctgaattcccaaatttgccaatggcagcctcagcttacctagcaatattcactttggtaactgacactgaaatatgttctgaatatcaactaaactaggcctgttacactccttgagaagtcctaaaaatgttaaaagggttggctccgaatccaaacacatttcccagtgaaaacatcagcatttcataaatgagaagatttctttggggtggcctgaatgtgatttccgttttttcacactttgagcatttttaaagaattctttcacccattcctcaaatggcatataaaccttgggttttcagttttctaacttttaaaattacagtgtaatttaattaagcaccctaagggaatcagactttaaattaatttgatcattattttgggttaattaaattgttccagcaaattgctcttcagtgacccggtccaaaagaatgcatagtcctgagtgcagaggggagaaacctctctcctgcgtcccagttctcctctctttgtagaactttatagaaaagctcttacaaagtaacagaagtttgttctctttgaattcggatgctggggttcacacttacctcccacaccttttaggcagagaactggagctgatgacctaaagatgttcattactattttgagacagcaagtgtggggaggggtatatgtatgtgctggtccctgataatgtacggctataaagaagctgacagcataaacttttctaagatcccaaaaacttaaggccttgacatttgatgcctttttttttttaaccccttaacaaagatgatttgaaactcactggtcctcctgctaaagttcgcgcagcacgaagctgctcctccggaccccgatcttgaaaggatgctctgtaaatctctgcagtcttaatgttgacagctgtgagggacaacaggatgactctgaattgacaaaagaccaaagcggaaagtctgcacagtcttacatttctaccaccactcctaagagaaagataggaaagtgaacagaatggctcctaagtatctggacttccccctccctggagggggaaaatgcaacctttaccccaagcatctcggtgaaaatcgctgaggctcgagctggactcggtgagattttgttctaaaccaagagctgctttccacatgggaggcagccattccttcagtcggacatgtagcaaaacctctggtcatccctactggtgtacggccaggggtggctgggtgaactgtgatcgttctgtttgaatcttcacaatttagtattttatacatacacgaagttacagagaatagaacagtgaacactgtgtacctaccacccagctaaatcaatcaagtatcaccgctacagcagaagccctcggaaatagagccgattccatgatgccttttccgcgggagtcctggggctgccaagcagggaggatggttctaggttttctctagcctaagagttttacactttggaggatttctgttctcaagcaaaaccttcctcagttcctgatgtataaaaggattccagtgcctgccttcctcccccagagcactggcaggagaaaagcacgccgggcctggggtgctggggggagagggaaacaaaaccaggcactttcccagctcctgggaagggtgggcatggcctgtcctttctatttgctaccacgttgcttcttcaaagtcttaagaagtgaatgttatctcagttttataggtaaagcttagagaagttaagctacttgcccaaggcctcacagcagatgttcggagtagctgggatctgaacccaaagctgtcccatcctgacagcagtggggtcattggtttgctgaattagactttaactgcacatgtgaccaagactccaacccacaaaagatgcacactacttaccaatgccatatattactggaaagtggttttcgttttcttcccggtcatttaattctacaaaataagaatgtttaagatacactttttaaagaaataccaaatgattatttttactttgtataataaaggcgaaggaggagctcctcgatgcagaaagggaggaaaattccagaaaatgaaagggattgtggccctgtttccctaccctgtcccaaggcaggggggtttatactgaacaaactggcagctgcagaatcggtccccactcccaccccaccttctctgtgcaccctgtctgccacacgggtggcagctcctctgagatccagtgccctccttcctggtagacgagggggctgcactggaactgaggctcggcagatggtggacgagggcaaggggaaggggaaggccatcccaccacaggaagagccggaacagatggtggccaagcagtgacagcagtgtgtgccggtgcttgggcccactgcaagactggggacaaaacggtcctgagacccacatctttgctttggggcaaatggcaggacttacctgtcacacataatgtcactaagtgaatgtcatcttcttgcctgtcaaattcacctatgatgagaattttaagaccagaagtcagaaaagttcctctagttaccagaacaaactgctgagcaagccaacgacagggagggacggcagccaactgagtgtgctccgccctacagcccgcgcccacactgccacagcctggcctatggggccagacactagggagctgacaccacagaaccctgaccgccaggagatggccacattctcagcctcaggcccgaaggagcctgggctgagccttcccatttttctcttcattctgagagttttgcggggacccatggatttataagatttttacttttctcctaactaaactgttttcctgattatcagaattacaaaaacaaaaatctggccactgtaacagatctgaaaaatacaagagaacataaggaagtcggtttttaatgtccataatcctaacactgttaataattagtgtattttcttccatatttttctaagctcagcagagctgactataaagacaattttatatcttttttttttttttttttgagatggagtcttgctctgtcacccaggctggagtgcagtggagcgatctctgctcatcgcagtctccacctcccaggttcaagcgattttcctgcctcagcctcccaagtagctgggattacagacttgcgccaccatgcctggctaatttttgtattttcagtagagacagatggggtttcaccatgttggccaggctggtctcgaactcgtgacctaaagtgatccacctgcctcggctgcccaaagttctgggattacaggaatgagccactgcgcccagtcgacaattttatatcctgatttgcttgtgcataggtattttcccatgtaattctcaccctttcatgtgttattttttagcgactacataattattattctgatgacaccagatttcctgttataagtaatgttctaccgctcatcttcaggttcaaatctctatgcacatttcagattattttcttagcatatatttccacaaggggaattactgggtcaaaggatgaactatttatttatttatttatttatttatttattgagacgaagtctcgctctgtcacccaggctggagtgcagtggtgtgatctcagctcactgcaacctccacctcctagattcaagcgattctcctgcctcagcctcctgaatagctgggattacaggcgtgcgccaccatgcccagctaattttttttttttttttttgagatggagtttagctcttgatgcccatgctggagtgcaatggtgtgatctcagctcaccgcaacctatacctcccgggttcaagcggttctcctgcctcagcctcccaagtagctgggattacaggcatgcaccaccatgcctggctaattttgtatttttagtagagacggggtttctccatgttggtcaggctggtcttgaacttctgacctcaagtgatcggcctgccttgaactcccaaagtgctgggattacaggcatgagccaccgcacccggcctaatttttgtaattttagtagagacagagtttcaccatgttgcccaggctggtgtcgaactcctgaccttaggtgatccacctgccttggcctcccaaagtgctgggattacaggcatgagccaccgtgcccggccggatatgaaccttttttaagagttatggcgagaccctgtctccacaaaaaatttaaaaatcagctgggcatggtggcatgcacctagtcacagctacttgggaggctgaggagggaggatcacttgagcccagtaggttgaggctgcagtgagccatgatggcgccactgcactacagcctgagtggcagagtgaggccttcagtcatgatgccaaattgcttcccagacaggctgtaccatcatatgagtaagcttgcttcatggcctggtggttagtcaacacacgacaatgttttctttctttcttttttgaaaatatttgctaatttaggccaggtgtggtgactcacacctgtaatcccagcactttaagaggccgaggcaggtgcatcaccaggtcgggagttcacaaccagcctggccaacatggtgaaaccccatttctaccaaaaatacaaaaattaggtgggtgtggtggcgcacgcctgtgatcccagctactcaggagggtgaggcaagagaattgcttgaacccaggaggcagagcttgcagtgagccgagatcatgctactgcactccaacttgggcaacagagcaagactacatctcaaaaaaagaaaaaaaaagaaaaaatttgctaatagggaaaaaatggtatcatcagtgttttaattttctgcagattaaaatggacatttttgccaggagggagggtggctctgctttcacacaattcagagcacttactattttggaatgtgttcactgctgttttagtagaaaatcttgtccccagccctgctacccctccctacacatgagctccacgcattcagtctttctgtgaaattccaagctgggcagtctgtttctctgtgctgctccaagtgggtgtgcccttcttgggttttgtaccaattgggatttttaacccaagcaaatatgggtacatatttatgtccaatttgggggaaagaaaaaaaaaatgaacttactaagaagttgatgagtgagtttttgtgacaactgcctgtcgtcactgaagcctccaacaaggtgtacttccagcctggcaaagagatgagacgggtcagaggccagaagaagacaccggtgcgtgcgctggtctcactttgaactttcattctcagtttccatgaacacttgctctacagcagagctgcaggtcatcttcgtgccaccgcaaaagaaagtatcggcagcacactgccaaggccagtggcgagcttctggggaccctgcccaggggccctgatgactgaggggatccgtatctgaacacaaatgtgatgccgcctccatgcaccagtggggaactttgctctggaagagcacaggcacaggacaggtgcagtggctcacatctgtaatcctagcactttgggaggctgaggtgggcggatcacttgaggttaggagtcttgagaccagcctggccaacatggtaaaaccccatctctactaaaaatacaaaaattaggccgggcgcagtggctcacgcctgtaatcccagcactttgggaggctgaggcgggcagattgcttgagctcaggagtttgcaaccagcctgggcaacaaggtaaaactccatctctactaaaatacaaaaaaaaattagctggacattatggcatgtgcctgtagtcccagctacttgggaggctaaggcaggagaactgcttgaccctgggaggcagaggttgcagtgagtcaagatcgtgccactgcactccagcttgggctacagagtaagactctatctcaaaaaaaaaaaaaaaaagaaaagaaattagccgggcatggtggcacacctgtaatcccagctactcgggaagctgaggcaggagaattgcttgaacctgggaggcagaggttgcagtgagctgagatcgcgccactgcactccagctctgggcaatcgagcaagactccgtctcagggggaaaaaataaataagtaagttgggcgtggtggtgggcgtctgtaatcccggctactcgggaggctgaggcaggagaatcacttggacccaggaggcagaggttgcagtgagccaagattgcatcactgcatgccagcctgggtgacagagccagactctgtctcaaaaaaaaaaaaaaaaggtttgaggccaggtgtgctggcatatacctctattcccagctacgcgggaggcagaggtggaaggaatgcttcagcccagaagtttgagactagcctgggtgacagggtgaaaccccggctctaaaacaaaaacaaaacaaaacaaaaagactgggcaactgcctgctggaagccctccttaggagtcacactgcgcattgcacagtgaagctcttgagaagtcctgcgactgaaaaatccaactaactttcttgaacccagtgtttcccacactcatctactaacccccttttccacagcccgtcaagtgggcgaattcacgctcggcaaagtgttgccagactttacgctgccttctcagacacaaaatcttcctaagggatgaaccagaagcttggatgtacccaacatagggcacagcctcaaggggcctcataataaactccaagtagtagcagtaaggagagctgcgaccaccatggctttgccactgggccaccaggtttgcctctgactccctgagcgatcacagttctacaacagatcaggaagagctgacaagcacgttctgagaaccacggagcagagtgtgtggcaacataatggcattgattacgtccccctgcgggggccaagatgataggaaaatgaaaataccattttgggcctgcatgggtcacgtgtccatgaagccagcccagccttggcacagaccacagagggagaatttagaatcgaccagtattgactagcaaatctctcccagagaactctctctttcctttttagactcctaggattaagccttcgtatatgatgggagtagttcactcaatggctgccttagacttccagtaaaatgagagcaacacctgccaggtctccacaaagagcaaggagaggggacaggtgtgtgaacagtggtcttgacagcaggcctgtgtcgtcggcctccacctagctcctgtgtgctccagcacatcgagcctcagttgcccgtctctgtcaaatggaggcagcggctactttactgcagtgagagaggatgaggtgctgtgggggcacccaggctagaggccgcttcttatccagcaatccttggggaaactaccaatctgctggaatttaaaactatacccctcagctgggaggatcacttgagcccaagagtttaagaccggcctgggcaacttggcaaaaccctgtctctaccaaaaaaaaaaaaaaaaaaaaaaaaaaagctagctgggtatggtggtgtacacctgtggtcccagctacttgggaggctgaggtcggagaatcacctgagtccacaaagtcaaggctgcagtaagctgagatcacacaactgtgctccagacagggcgacacagcaagaccctatctcaacaacaaaaagagaacaagaaaaaaaactacatgcctcgccccctagcggtccccacatcttcctggcctcgttttctccacagccccgcctcaccacccaacaccccatcttgtgtacagtctctcggcttcggaatacaaacaccttgggccgggctttctgtctactcttcactgctgtgtccctagaaactacaaggtgtaggtgagaggaagcatttaacaagcaactgcgggaggaatgactgcatggagagctaccacacccgggggagagcaaaacgatgtgaaaatcgcaacctcgacgttcctgagacgacatcaagttcaaagtcaagccttccatctcaaatccagcacagactccttgcctgtgcccagcacccactcattcactcaaccactgctgacgcagtgcccacgtcgtgccaggttctgttccaggggaacgaggcagacacggcagtggtggcatcctgtgttcccctaacagcttccacagccacgtcctgtatgcgacggttccaagatctcaattcacctatgagagcagcgtagatctcaccttccacattgagcgtggtcagaaaaggattttatggagttcatgatcaaggggacctcagctttggtgtcggttccgtcacaatgtgtcaagcaggtggccccattacctgaagaacaagggtgaaaggactcaagttattccctgatgcgagtgcagtgcgcaggccgagactccgcctgtccctccggaccgcctcatctttgaatatcctgtaggggaaaaacggacaggtctgtgctccccagccaacccattctgaccaggacaccagggagacaccatgcagaccagaaaaaaggtaagcggagtccgcttccaacaagacaccaggaaactcaacacgagaaattcaatggtcccaaaggttgggtcagtttaagtaatggtttccttcacctctctcatcatacctgtgtgcctcaggaccacaatgtgacaagtagtggcatcatcagaacccagaatggagatggagcctgtttaaaaaagaaataaaataaaatatccaatagccttttgggataacgcccaattcactgcttcctaacctaccatcctttggggaggtcactgcaagctctctttgctgaacatacagaaggccctggggtcccacttgttgaacagactgacctctgagaagtctggctctttcctgtttaattaaaaaaaaaataaaatagtgatgtaaattagtgaggatggaaaaactaaagatgtggagagagccaaagtgggctctgcgtgggcagcacgctagtgtgtggggagtgtgttagtggacagagaggctcaaagaaaaaggcagcagccacggtcattcagaacaatgcagagaaaacgatgcggttctgcgcggtggtttttttaacctatgaaatcggatgtcatagtaacctatgaaatgagatgcaaaaatcctttattatagttttttgtttgtttgtttgttttttaaagacacagggcctcactatgttgcccaggctggtcttgaactcctgggctcaagcaatcttcctgccttggcctcccaaagtgctgggattacaggcatgacccaccacacccagctatcacagttctttactaaagagtgtgagactcttaacaattttaccattgtaaagagaatcagattacacaggaatagtggatggatggctctgaaatcacatcccctcttttttattttttgagacagtctctcactctgtcacccaagctggagtatagtggtacaatttcaactcactgcagcctccacctcccaggctcaagcgatcctaccaccttagcctcccaaatagctgggactacaggcttgcaccaccacacctggctgagttttatactttttgtagcgacggggtctccctatgctccccaggctggtctcaaactcctgggctcaagcaatccacccaccctggcctcctaaagtgctgggagtacaggcacacaccaccacacctggctgatttttatactttttgtagagatgaggcctccctatgctgcccaggctggtctcaaactcctgggctcaagcaatccacccaccctggcctcccaaagtgctgggagtacaggcacacaccgccacacctggctgagttttatactttttgtagcgacggggtctccctatgctccccaggctggtctcaaactcctgggctcaagcaatccacccaccctggcctcccaaagtgctgggagtacaggcacacaccgccacacctggctgatttttatactttttgtagagatggggcctccctatgctgcccaggctggtctcaaactcttggactcaagtgatccacccaccttggcctcctacagtgctgggattacatgcataagccaccatacctggcctccgcttttttaccttagtccctaacctagtaatttcacttctggaaatctgtcctaaggaaataactcaaaatatgttcatccctgtgttatttcttttatcttattttttttttttgagacagagtctcgctctgttgcccaggctggagtgcagtggcgtgatctcagttcactgcaatctccacctcccaggttcaagcgattctcgtgcctcagcctccccagtagctgggattacaggtgtgcgccaccatgcccagcttttcgtatttttagtagaaactgggtttcgccatgttggccacactggtatcaaactcctggcctcaagtgatccacctgccttggcctcccaaggtgctgggattatagcatgagccaccatgcccagccccctgtgtaatttgtaatggcaaaaagctgggagcagcaatggaaaaggtaagtaaattgggcacagaaccaagtcacagccactaactgcacagtcatgagaaatgaaaactatgggaaaaagagttttgaaatgctaattgaaaagcaagatacaaaagtataaaaaatgttttaaagagctataaatgtgccataatacaacaatgattaaatgcttatacccatagagaaaaatactggaaggaaatttcaccagtacaaccatggctgtgccaaaaaagcaaacatgagtgatttcctgttgctgttgtcctctcttctctcaatgttctatcacatagttattgttagaatacaaaaacaaaatggataaggcaaatttacgaaaggtatgttaatactaagtgtcaataatctgagtgtttgtacacacttatttagtaagcttgtaaaaaaaattcagtggttaaaaattcagtggttatttaacaaaaactttttcaaaatattaaattgatacaacactacaatgtatcataatttccttcttacttgcaacaaactcctggatgaacaaaatcttcctcaaatgtctagacaacgtatgtatgtattgcctacacaggaagacagttttgcagtcttagtcttctatcagcttcttgccatttcgcatgactggtgctaatttaggttagcgctcacttaataaaacataagagcagctgggtgtgatggctcccaactgtaattccagcactttgggaggctgaggagggaggactgcttgagcctaagagttcaaaaccagcctgggcaacaaggaagatcctgtctctacaaaaattacaaaaattagctgggtgtggtggcatgtgcctgtagtcccagctactctggaggctcaggtaggaggatcacttgcagccaggaggtggaggctgcagcgagccatgattgcaccactgcactccagcctgggtgacagaccaagaccctgcctcaaaaaaaaaaaaattaagattaaactaaaagaagagatgtaataaacataatgatcagcttgattacttacatggtgttttcttctgtttataaacttccattaactggaagcaaggtatcaatgaaaatgagacaagccccttaatttaagaaacaaactaaagattaaatgaactgcagtgtaaaattagatgggcaagacagccttgcttgctccagaagtcagtgagaaacaggtgtgactgctctaaaactcagaacacctgtacaggtgacagcctctcattttctcattccacttcttgcctcatcttagttcagaataacaggggagaattcagaattccctcttgattactcctgagatacttaccttctgctttgttctttgagggaagggaagagaagggagggcgcaaaggcgaatttttaacactcatgttcacaattgggtcaccactcaaaagcaaagctatttgtgagaaattaattactgctttcacaaagaccaaaaatcatgtctctcttcaacacagctcctacgatttcccaaagaaataaaagcaaaaattatcagaagagagaatgccagaaaactaaaacagtagactgctttgctctattttttaatttctttttttaaacagggtcttactgtctcccaggctggagtgcagcggcgagatcgtggctcactgcagcctctggcctcaagcaatcctcccacctcagcctcccaaggagctgggaactacaggcatgagccgacacacctggctagtttttgtactgtttgtagagatggggtctccctgtgttgcccaggctggtctcgaactcctggcctcaggtgatcctcctgcttcagcctcctttgcagtagctggaaccacaggcgcacgccaccacacttgtgctaggattataggcatgagccactgtgcccagcctctactttatttttaatttttttttttttttttttagagacaaggcctcactctgttgcccaggctgaagtgctgtggccagatcatagctcactgcaacctcaaactcctgggctcaagcaatcctcccacctcagcctcctttgcagtagctggaaccacaggcgcacgccaccacacttggctaatttttgctcttttaagtagtaaaaagagtttagccaaacttcccttctttggaaaaccacacagtcctactttataaattcatatgcaagtagtcccagttttcttaacctctaatatgctctagacactaatatttgcttaaaaaaaaaaaagcttttccctcagtccctcatccctatttcccagttcctattcaatggcagtattctcttaacccagtgaccagcagattttctgaaaaaggccagacagtaaatatttggggttctacaaggccgcagtctctgtcacaattgctcaactctgctgttattatgaagtgaaagcagccatagacaatacagatgtggctgtgttccaataaaactttatttataggtgacaccgaagttttaatttcaataccatttcccatgttacaaaatattattttgatttttctcaacctttgagaaatataaagaccattcttggcctataggctatacataagcagggtccggcccatgagctgtggcttgttgacctgtgtcttagccaatcacctagctgtgacctgggggatgatcatgtgaccctcacccctgctgtcctgtttatcaattcttcctttataaacaggagaggggcatgaaggtgatctgtgaactgtaaagcacaatgctatataagaaattatgaggcccaacacactggctcacgcctgtaatcccagcactttggaggccgaggcgagatgatcgcttgaggtcaggagtttcagaccagcctggccaacatgttgaagccccatctctactaaaaatacaaaaattagccgggcatggtggcagatgtctgatactcaggaggctgtggcaggagaatcacttgaacctgggaggcagaggttgtagtgagccaagatcgtgccattgcactccagcctgggtgacagagcaaggctctgtctctcaaaaaaaaaataaataaataaataataaaagcaggaactaagctacgctgcgagcatcttgtagactctgtggaaccgtattacccaagatgttgcaggactggttaccgagtacccagtgactggttaagagtgactaagggagggctctaaacagctctggccaaaggaacttcatgctgggatggccaccgtctatattcacactgtctcattagtagccatgctgtctgctcggcacttgaaatgtggctactgcaactgaggaactgagtttcaattttatctaattttaattgatttttaagttaaatcctaagtaaccagatggctcgtggctactgtactgaatagcgcagctccagagtcaagggcaggctgccagggttccaatcctggcttcaccactcccaggatgtggggcctggggccagtttcccagcctctctgtgccccacagtcctcatctgtaaaatgggaatagcagtaactcttgctgtggtgcttggcagcttccactgtatgacttattgttattatttgctagtcatagctacacacaggcttctaactgttggtactccatactcagaacacatcgttacatgaaaaagacacattataaaacaacatatagtaagctatcatttttttaaaaaaagtaaattatatacaaagaaaaaccttcattaggactttcaccaaactaaagaatggttgtagtcatacttttttttctgtattattatattttgctttcctacaaagaggacaccctgttttattatataaaaataatccaggccaggtggagtggctcacaccggtaatcccagcactttgggaggccgagacgggcagatcacttgaggtcaggagttcaagaacagcctggccaacatggtgaaaacccgtctctactaaaaataaaaaaattagctgggtgtggtggcatgcacctgtaatcccagctacttgggaggctgaggcaggagaatcgcttgaaccttgggagacagaggttgcagtgagccgagattgtgccacagcaatccagcctgggccacagaacaaaactaagtctcaaaaaaaccaaccaaccaaacaaacaaacaaaaaacccaacctttaatgtctccctgttgctaagtaggtgaaaggtccatctaagccccttggtcatttggtcatctgggtacaatccacccctgtaaggttactttccatgcttcccctcctcacccgggctgctccggagaaactggccaggacacccacccactgggcccttcccctcctgcccgccgcgccccaggcggcttgcccagctgcgatgccctcacccttcttctccttttcaaatctctctcgtgcctgcatccttcttcacttacactgccgcaaatcaaagtgatcgcccccttccaaagttcctgtaacacaaactggtccccagtacacagcctttctaggacatgtcttcttaaataggccaaaaccttccttcgagagaagcagccccggtatgtcaccaaatctccctccacacttaagtgtgcagcccgggacacccatctaactttctatcacggacattttcaaacagacataaaagtagagcatcccctaaattcttcaggcggctgaaattatttttccttggtgagtcctactcttgacttcgctagctaacaggacagtaacacaacgcaaggataaagtgacacgccaccacgcctagctcggtgcatgttggctaacagacgatggtcggtcctgaaatgcaagctgagaatcacacagagctgtctgccttctccccgtcagtaagtccttgtcacccttcagaacacgttcaggggtcattttgtgacctcatttatgcagcaaatctttactgagcgccaattctatgccagggaccgtcctacactctgaggatacaaaagtgaggacactactcttatctgccttcaggaggcttacattctggcgacagaccaatagagaacaaacaagcaaacaaaataatcacaaactgtacagctgtgacagatgaaacctctaaatgccttccccaacccaacacacttggtcaggttcctgtgcttcccatctcagagtgaaaggggacgctttttctttatggtacttaacagtttatagtatctgagccttcttcatcagaaaccattctcccttctagactataaacactccgagggcagggacagtgatcagtacgttgcccaacagatattaggggctcgatatttgactctcaaatcaaggaactgattgattcccctttaacaggatctatggcaaataggacgtctgcccccgccgccacgccccgctctttttaaaacctgagaacccccttgccaacagtccctgcataagcgtggacaagagttcagagatctatttgagcacaaaagcagaaaaaacaaaaacaaaacccgtgcatcagggcgtggtcctatggcccagctgcggaaagcagggctctctctcccggctaaaaataactcggcgccctacgccccgggggtaggggagagagaggaggaaggactgggggtccccgccaagatcccccaggccaaacgctctccgaagcccaccctggaataacctcctgcttcacggggacgcaaggacgaagcaacgttcaccgcaggctgcgggtccccgaaggcgggcggccggatttgcctaaacggacccagccctatgggggctgcagccgccccgtcggggaatgggggtcccggcgtgtccccgagccgcagtgctgtgcgaccttgggcaagtcacctaacctctctgggcccccgtcccctcccttgtcagagagtggcctccggggcagcccgctgaagtctaaagaaggcaaaaactccccgacccctcaaggggaagacgcgagccgacggccggggctccggatgtgccaacagcgccaagtttcaagtctgtgtcgcgtgaggggggcgctagcccgccctgcagcttcccctcgggcccgccccgaagccccgcgccgcgccccactcacctccaaaggcgggtgggctcggacgaggtccccggctgactgcggcagccgcactcgccgcccctcgacgagcagcggcatcgcggaggcggccgcccaggcaggcccagggaggcggcggccccccgctttgcagccccgggccgcccgccgcccccgcccctcgggccgcgcgtcccgcctcgtcctgccccgccccaccgcgggcgctgccgggaagtggagtccaggcggaggcggtgccggccgaagagactggagaaatccaggacatggccgcaaggcctcacgggaaatgtagtccaaagccaggaagtggccctggaagcagcgcgcggcccgcctcctccgcaaggggcgctgggaagtgtagtcccaaaagcgtgggagtgaaggagcggggaaaggagagctgccagggagcagctgcaccagccaagagagcctccgggcgagttcctggggcgggttctggctccgactgctgcgctttaggtcattgctccacgcttcccaggtgtgtgaccttccacaagcttgagtttgggaccctgctgtgcagctccgtaggattgcattcaatgagtaataataaacctaatcaggcgggcacggtggctcacgcctgtaatcccagcactttggggggccgaggcaggaggatcgcttgaggccaggagttcgagaccagcctgggcaacatagtgagacccaccctcccccataccctcgtctctgccaaaaatttaaaaattaactgggcacggtggcatgcacctgtgatcccagccactctgtaggctgaggcgggaggatctcttgaccccaggagtgggaggctgcaatgagctatgtttgggcactgcagagggacactctgtttctgaaaataataaaaataaatgtaaacggtcttaaactgagaaaatagatcctgaactgtgctagccccacgtactaaagagatcatcgattaacacgtcgtgattggaatgcaataggccactcacaggtgggctgggaaccgtgggggaaggatttgcggatactgactgcagagcccctaatctgaggacaggtccccaaggtgagaggcgtctcaccgtggagctctcttctaaaacttggaaatattgctcaaattcatccaactctgcagcacattaacaaaaagtaattttacaaaagatacagaggagccacatgatacagcagaaactttattagaattttatcatctgtattcatcgtcttctttcataaatctccccctcagcttacacaccccgttcaacaaaaataccaggaaatttactaaagaaatgactgtagaagatggtgttcccatcgccaggttacccaacttctcacccaaaataactctatttctagctaccaggaaattatttctctgtattattacacctacatttctcatttgtccttacaaatgtaggagctactatcaacacctcatttgtcatttgtcctcacaaatgtaggagctactatcaacacctccgttataacagatacagtaacttgctcaaagtggtagaaataagtagtagaacgaagactgaacctagctttgcatgattccaaaggcagtgctctccatcactataagatgctcctagactgtactgtaaacaactcattctaatgcaggtgacattaagtaagtcccaactaggaagctcggagctaaaaacagggtttgaaaccagggtgatcaatgaccagcaggctggcctggagcaagttacttaacttccctgaactggttttgtagaatagcatgtttgtttcacctggtacatactaaacactaaagatagctattattggaattgcagagcaaagagtagtcaatcaaagtgaggcatttggaagtgcaaaggtgaagaacaaggttctgtgggttctgcctggggctggtgcagtttgcctaactggtttttcacttttgggtgatcttttttcaagtaatctcaggttatcaatctcctaggctgagtactgtgttaaaggactaaatgagccagataacaagcaggaaaccactcccctacctctcttcccacccagctccacaaattttggtctacaggcaatgaggaagcaatagcaggtgtgtggccagcactgcggctcatgcctgtaaccccagcactttgaaaggccgaaggaggactcacttgagcccagaagttcgagacgagcctggacaacacagggatccctgcttctccaacaaatacaaaaattagctgggcatggtggcaggcctgtagtcccagctactcgggaggatcaatcaagccctagaggtcaaggctgcaatgaggcacgactgtgccactgcactcctgcctgggtgattacagcaagaccgtctcaaaaaaaaaagaaaaagaaaaagaaagcactaattacaatgttggaaagcctgtttctttaagataggaaaccaacctgcctcacaagatggctgatggcaaagttcaaagaatatatacagggaaatattttttaaattacacttttttgaggccagacatggtggctcacgcctgtaatcccagcactttgggaggccgaggcggacagattgcttgaggttaggagttcaagaccagcctggccaacatagtgaaactccatctctactaaaaatacaaaaattagccaggcatggtggtgcgtacctgtagtcccagctactcaggagactgaggtgggcggatcacttgagcccaggaggcggaggttgcagttgttgagctgtgattgcaccactgcactccagcctgggtgacagagtgagactcttgtctcaaaaaaaagaatgatgaacattatacagaaccttagtaaatatttagtgaaaggatcccaatttgtgtttcaaattttttaatgtagagatgggggtctcactatgttgccccagctgatctcaaactcctggcttcaagagatccttttgctggcctccccaagtgctcagattacaggcatgagctaccacacctggccccaaattattagatacattataaatcctactcaaccatccagagtcagactgaaacacacaaaagcatttgatggaagaaaacatggtggagctttggatgttcaattagttgaaacaagaaaagtatgcagttgtacaccaatgaacagttctcaaggcagcctgcaccttcgaatcaccagggggctttaaaaaccatccatgtccagacccctcttctggagactgattcaatcaaaggttgagttggtgtgtgacgtgagcctgggcatccttagtttctcagcactccaagggactgattctagggcacagccagggttaagaaccaccatcgtaagcactgcccggcaagggaaacacgctggttcctcctctccagttcagatctaagttggtaccagggaggtaggtattatggaagaaatagaagttatctttaaccaaaaaaaacttcccatggaagtgcttcctttcttgcaagaaaacaacagccattaacttgtacatgcatcgaatccttaaagccttacactagtatcttattcccattttacagtttaattagcgctcagagaggttaggtaacttgctcaacgtcaaacagctagctaggaaaggaagcccatggcacttggtaagttgacttgtaaaaattcagccacttctcatcaaggaagaccaaaccagagcacacagacaaaaggacagaccctggagactcctacaactgacagctttttagtgaaaggaaaaattcccattgttggcatgtaatttataaggagatttcacagtatttttccccatagatgtcccttcaaagcatgtaactttttgaaagaagtgtctgcttcccttggacctgctcaagcctcaatcactctttgctgggtgtgattaaggagagtcgcggatacttcatatagtgcacacggaaaccatcctcaccccggcatgcaatgaattccatcaagctccccgccacaccagcactatttctccctcttcaacagcaatgcctcaggagttttccactgcaaaatgctttaatacattaaattaaaaaaaaaaaaacaaaacagaaattgaaagaacatgtattgaggtaccttttattggtataagaacgtaagttccagattaaccatgtcattgtttcattttcaccatggattttttttcacaaactcctttgaaattaaacagacttatatgtaaatgtctttctacattaaaactacttcccaacccacaaagaccccacttactactaatttctggggaatttcgtttactcgttttatctaatattaaaaaatcaacattttgccagcagttaaaaagacaaccttaaagttctcaaattactttccaccaaacccggaaaagaaaaccacccatatccaaaactttaaagcaataaaaatttctattttccaaaaaagtatttacagactgaaattcaaactctacattgccatcaatgtaattatacaagtgcatacaaagccctggaaaagaggaagtatttcattacaaaatatttatgatcaagaaaatattgcttgcctttaaataaagtggcagaaaataaatatgcttaaagatggccattttcacaagtaaacaaaaaagtacacatgtaagaaacaaagtgaaaatgcttgagcttcaaaatgactctagcagtgtttgcacaaatttgttttaaagcgaggtcttctgaagacttcctctgtttagttataaaaatacaaaaagaggctttagagaaggatttcaccaagccgaatgtgcgatgcacacagccatcagaccaagactgcactagcaacttccacctattgttgtgagcaaaaccgtacaccaaataatctaaaaaaattttcctgtttccaacaaagaaattcccaataactaagtgatgcagatcaaaactgactcgatctaatggccaccaaggagcagttctagatctaaggggacacttgagagccaaggggtcaaatccaatctcatgtgttttacacaagcccgaactcactttcagtctgtgtgaattacatctacctggacctccatttttgtcttttaaatccattttttcgctgtgccaagtatattacacatctgattctgtttccctatatcctctctctcttccctatgggcttttattggtctctgaagtccctggagatcttcagtgccagctccaactctgtgtcccagaccatgtcgggccagctctcagctttccttctgtcttctctacactcccttgaaatcccaacagacaaataccaatacagcagaaggtgaacaatgtagccaaaataaacactttctagttaaagtctttaaatagaagttttatcttagaggattcttcactgaaagctcatcagtcaagtcctaagaccatggatctgacaaaaacccatgttaaaacagcaacccgtaaaacagtctgctgcctatattagaaattacccagtaattgtgtcaaaaagctgttaacacaaaaaatgtacatattaaacaagcaaatccttccaaatgtatcatcaaccccactgtaaaagattgcacatgatagtcttcattttgtctgtaaggggaacaacaacaacaaaaaaacccagtcttcagatgcttgattcagtcgaacctggaagtgccacagccgaggcaggcactcgctctagttcaatgccatcaatgcccaatggcacaagctgggtgctgagggcatgacaagtgatggggaatcccaaatgtcacatctcagtcacaaatttctgccgtcagaggggactgggttgcatgtacaacacgggtggggagcccacactacttgaaggacttcggaaatgcgtgtcaaaggagcttggtgtgatcccaatcacggtatcattctggggcacttcgcctttcagaaagtcatcatcttcatcttccactatgtcctgcagaaacatcagaaatcatcagtaacatcaccagtgctgactgaaaagctttcaacaattccttcctcaggaaggtgttaacgtttgtaaagatggtgaagaaaatatcttaatttcaaaagaaagccagtgtagtggcacacgcctgtagtcccagctactcaggaggtggaggtgggaggactgcttgagctcaagagttccgaatccagcctgggcaacatagcgagaccatgtctctagaaaaacagaacagaacaaaagctccctctgataagcacttccttcttaccaacatacccacataactgctcatcacacattgtaatcatttgtttcaagtctgacttgcaaacagatttgaagctcaatggggacaggaaacatgacgagtcattcttgcccagtgttaggaactcttgtacctaacacaatgtgaatgaattacacgcccctcaacaaatgaaacataaagaaaaagatgaaaggggctttccaatgattacttattaaaaacaacaacaaaaaagccatcttgaagctgcttttaatgagaaaacaaatgtgctcccaagcaacagagcagcgaaattctttattactggattctaactttcctctctaactgtaactgtctcagctccacctcatgtgacctggagggtatgttgcaacctgcgtcttcaccacccattcatgaagatctataaaactaatgtaaactgctggggcaatttcaacatgagtcaactggagattgttacttggtaagaatgcgcaagtggcaaagatctaaattcattcagctaatttgtaattaaccttcgcttctcacatgtcagtatgtgaagtgtctggtttaagcaatttatccaaaaaagccatagactctttaaataacaacaaaacctgggcctggaattttataaaggcagaatgagtaagacacggttttggtgtgcttttttaaagaaaacagggtcttgctctgttgcccaggatgaagtgccatgctgcatttacagctcactgcagccttgacctcccacctcagcttccagaggagctgggattacaggtgtgcaccaccacgcccagctaattaaaaaaatttttgtagaaacagggtgtcactgtgttgcccaggctggtctccagcaatcctctggccttgaccccctaaagtgcggggattacacgcacgaacgacttgccacttactatctcactgtgacctggaaccagaaaggagattccgagagtgtgctcaatcaatcacaaactgacctttttcatgggtttcttgaactcctgtagctcttcagcactcatgtcttcccacacctgataaataggatcaatgaatttctttgacctgtcaacaaagatcacatttcaaagtcaagttaaatacttcggcagaagtcaaaattggtttggatcttttctcacaagatctattacccaaaaccaagaagtgaaaactacagcttaaataattacatttaaaaaaaacctggctgggtgcagtggctcacgcctgtaatcccagcactttgggaggctgaggtgggcagatcatgaggtcaggagatcgagaccatcctggctaacacggtgaaaccccatctctactaaaaatacaaaaaattagccgggtgtggtggcggacacctgtagtcccagctactcgggaggctgaggcagaatggcctgaacctgggagacggagcttgcagcgagccgagatcgcgccactgcactccagcctgggagacagagcaagactctgtctcaaaaaaaaaaaaaaaaaagaaaaaaacaaaacaaaaaaacaaccctctatgtaaatgctgtaactaatgtggctctttctgtataagagttcattcactcatgtcgatggagtattgaactaccgtttttcatctttccattttcatgtgaaattgtttctaaactttacaaagactcacaagtcagttagatacagtatatccaaatggaaatgaaaccgtaatattctggaactctcttttttatatttctgtagtaatttgctgaaaagtaagtctaggaaaaacaactaatctggtttcagtcaaccaagacttcagggaccagacaatcccagatggtcatgatgctgctagttattttagaaaccataataagcaaaaatcctgcttccttatacaagtgccaagttaaggctggcccagtggttttctagaacaactcatctagataaatcgctttttgttttttttttgttttgtttttctgagacagagtctcactctctcgcccaggctggagtgcattggtgcaatctcggctcactgcaacctccacctcccgggttcaagagattctcctgcctcagcctcccgagtagctggaattacaggcgccaccaccacacccagctaatttttgtatttttagtaaagacagcgtttcaccatcttggctaggctggtcttgaactcctgacttcaagtgatccgcccgcctcagcctcccaaagtgctgggattacaggcatgagccattacgcccagccaatcgtttgtttttcgtttatcctgtgcaacagaatggtatgtggtctctagaggaaggaacaagacacttggcagaaaattatgaagcaagaaaagacagcaccctcccctatcctggcaccattatccccattaaccttacatgtttaaataacagtttaaagaaaaacaaaaaacaaaaaacccttgatgtcagtctggctcctagtgaggcaaagatctacccactctggggtgcctgcgccactcggcaagtcctgctaggcatcctctactttgcatctggtgaaatatacgcagggagaccacgagatgctcatcaacagcgaggaagggccacttctggtgaagagccctaaatcccaattttgggaaaagcaaacatgtatcacgtttaaatccacctcctggccgggcgcggtggctcacgcctgtaatcccagcactttgggaggccgaggcgggcggatcacgaggtcaggagatcgagaacatcccggctaacacagtcaaaccccgtctctactaaaaatacaaaaaattagccaggcgtggcagtgggtgcctgtagtcccagctactcgggaggctgagtcaggagaatggtgtgaacccgggaggcggagcttgcggtaagccgagatcacaccaccgcactccagcctgggcgacagagtgagactccgtctcaaaaaaaaaaaaaaaatccacctcctccagcgtcaatgtttaaaagtacctacctcttcagcacacagggatcaaaggggaagaaggtgtccagcgggtttgtgcagatctgcactgagtctcctccagcggtactcctaatgactggcagcatctggcgattgttcctctcaatgatggtgtagcagaagacgagctggtacttactgtggaacaaaaaaacaacacagacagaggcattaacatgctggagtgactcggtgcagatgtgagctgcgtgtgacaactgtacctaccacagagaaattgctgaatataacaagtgctagtaaaaataacaatataaagcagaaagtaacacttttagggtaccgttctatgggtcttctatttgcaagtttgctaaggagaaagaaaacgtggctatcactcagaatgtgaaactgggcttatattttaatgagtaatagatattattcattatattttaatgagtaatagatactattcattaaaaataaatgtttgcaaggcaaaactcttagattacgtaactataggtgtctttatttttactgtttgcaaaagaattagaaggttggtggtaaagggattcaggagttactcaggaggaaatagtggttggtgaagagacttgctgaagaagcactgaaaaagaaataagcctttactgaaggagggacacggggttgactaagtcatgacctcaaaaacaggcacagaaaggactaggcatgccgagtgagaacagttaaatgcatagaagaaaacataaaataaagacaattatgtttttaatttttccagtagttgtctctaaatgattgagcaacttgaaaaattatctattggacagcttctccaagatgaggactcagatctcacttctgtcactctccatctcaggttctcaggtcaccatggcaacttcaagccacatactttgatttctgtcctgttagccaaggctcacagcacttgacccctcctcctggtggaggacacatcagcaaaaccacactggagggtggtttgcactatcaggtaaagttgaagatctgcatctcctacaaccccgcagctgaccgcacttccgggtgtgtgacaaggaagcatgtgcccacacacaagaatgttcctgagcactaaaacactaacacagccggctgggcacggtggctcacacctgtaatcccagcactttgggaggttgaggcaggcggttcacttgagctcaggagtttgagaccagcctggtcaacatgatgaaaccccatctctactaaaaatacaaaaattagctgggcgtggtggcaggcgcctgtagtcccagctattcgggaggctgaggcaggagaactgcatgagcctcggaggtggtggttgtagtgagctaagatcacgccactgtactccagcctgggtgacagagcaagaccttgtctcaaataaaaaaaaaaaaaaagacaaaaactaacagatgaaatcccaacaaagactcaataaaaaagattcccagaacataacacagcagttaaaatcaaaataaagctttgtgtcaatatggttcaatctcaaaagcatcaagcaggcaaaagcaacagctacagaatggtacacgcctttatttaccatatctgtacctaggcagagacttttatttcaatcccctgctcttagcctcacatcgcatcacactctgtgcctccaatgcgcatgccaaccccaaatcgagagcccctggaccagatggttcacaaatgcagtcctctgtccccaccccgagaacataccaggggcagcggcctctgctttgcttcatccatcctcactctttgagctgctcaccatcttaaccaacgtgctgaagcctccacccactcactgccgttgcttattggtctctttatgccttttcctaatcctttactatcactgagactcagaagagaggacaccttgaaccagacgcctagcaaaggagaactaaagaggctgacggagctcagcaagctgttggctcttatctgttgaagattttaagctatgatccggcctaaatatcctcattgaatattcaattctccaattcgctttctccataaagcagaataacttagtgaaagcttacaaaggagccagactacatttaaatctgtgctgccagtctagctctatgactttaggcaagtgatttcacctctctgtacctccacctccctgttgataaacagggtttcatcctagaggatcaaatgagttctatgtaaagtgcttagaactgcctggcacagaggaaaggctatggattagccatagctaccagacctgagagaacagaactctctaaaccaatctcttacaggtcaacatttgcctcatgtccagtttatttctattactattacaggagtcactctaataagcatctatggctttgcccctctcagcttactggttgccatacttatttcaaagtgctgccctttggataagaagtagtagtaatttccaacgccatcaaagtataaaaacaatagctgtatcacagtatttcctgcaaggactgggttgtttttgtttgtttaagagacagggtctcattctggagcccagactggagtgcagtggtacaatcagggctcactgcatccttgacttcctgggctcaagtgatcctcctacctcagcctcctgagtagttgggactacaggcacaggcaaccacacccagctaatttttaaaatttttttgtagagatagggtctcactatgttgctcaggctggtcttttaactcctggcctcaagcaatcctcccacctcagcctcccaaaatgttgagattacaggtgtcagccaccacgcctggccttttataatgttactaatttcatagaaatttaacactcttacaatactagataaacataaataaaaatattttaaataactcccatcaagaaagcgtaaataacttactttgtgattgcagcaaaaaagttaaccactgagggcaggcaaatcttcaggggatttagctggctcatcactatccgctcaaaattcagactctgaagatactgcaaacctttggtttaaaaaaaaaaaagatttttttaaaggtacaaataagtgaaaagtgtaagatacttttaaaagcacaaattatcacacatttaaaaaaaactttaaaaaattatttgcagaaatgctttaaataaaggtccatgcagatagtcacacagtatatggcccagaagagtatcactaggctaaccacattcattggtcaccaaggcagcttctctaaagaaaacttaggaagtagcaggctgtaagattccacgacaatgtgaaattcatatgtttgcaagctcagtgtatgctgagataatacagagggagaaaagaccttgtgatttggtttcagctaacaatcatgacaggcaacaaaacaaaacagcaatttgattctagcttgcatgtcttgttagtgaagctgagtgctgttttcaggtgcacagtagtcatctgtagttttttttctaaacaagaaaactccaaatttgccttctacctcaacggacggcaaatttagacagaaaccactttcttagacttaatgaatataattcttttctacatgagtaaaataaagacatcacatttattttaagaggcaagctgaccaacttgtacttaagtatattttcttaggagtttctttgatacgtatttcaataaaaattacctaaatgggatgtcacagcttacaaaaacaagatatttaatccagattcctggcattaatttatacaaagaaaagcagagcttgtatttacttaccttgtgataaaacctcatcctactagttcatacaacatcttttagaagcatgtaggatgtaggtaaacatatataatgcaacacatacaactttcagtttagagctgtggctgttaacccaaggagactgcgacccccgcagaggacacctggcagtatctggagacacttttagttgtcacagctgggggtggtcggggactgctgttggcagctagtaggtggaggctgttaaacatcctacagtgcagaggacagcccccgacgatgaaggatgatgcagcccaaatggcaatcgtgcagggttcagagaccccggtttagaggaagtgacccacaaaaccataagaattattcataaacataaacagaacaatttacaatgacttataaacactgttcttggagactctcttcaactaaaatacactaatctaataagtttcaactgacagatttgaattataagtaactcttagaaattagcaaaacaatactggtcaattaagtctcaaggcttcaggcagagtttaatctatataaactcaaactttagggtcagccaaacctggcttcagttttctaatcctgccactaaccatgtgatcttgggaaaatgactttcctgtgctttagtgctgtctgtaaagggagaatacctgccatttactgggctgttacaaggacaacaaagagaaggtgcatccaactgaagctttgtacagggcgctggcacagcccagggctcagcctcacctctggagacatcttcacatttcaaactttcaaaggcagaaacctctttcttaacctcaaatccatcttaaggggtttgtagggttctcaagctcaaatctatcttaaggggtttgtaggggcctatgagctgcttgaaattattattaaaagtttgagtgcacatgcagttttctgaatccagtttttataaaaatctcaaaaaagtaatgaatcaccattctgaagggtgacaagaacacaaggaaaatccagtccagcactcccacaacactgaccttctttcaggtttccgctcaaaagctgcttgtgtctaaaaacaaaggtgtagaacacagcttggcaggctgagtaaaatggtccatggagagcaacatcgcagaatgcctttgttcccgaatcctggttattaaggtatatgtgcagccagttaaccaaaagatctaggcatgattttacagtactagagaaaagaaaaattcaagtcaactttacacatcataaaaaaaccagaataacataaaaacacacaactgcctttcattacaaaccatgctaagtaagttcataggtttctttaaataatacccatgggtacagaggaaaagcaaagaaaggaaggataaggatgggtgcgtaggaagacaaccttccaattacaaggcagagtagctctgaccttctaggaacaggtgagcccctaagaacgtcccaagggatggaaagcaggttctcctaaccatctcaaaggcacccctcttaaggtgattggccaaacaggacacgttcaccaacacctctcaagagaaagacagtctggtggacttcagtattccctgatgcatcctagtcaagtcctatggtgaataattttgtggttggggaagggtttcaacagcatccttgtccaaaggtatctttatgggccactggaagaaactggcctcctagataggtctattacctttaaaagggtttttcttcagctttaacagatacaatagatttggaatgcaaatgaaaaaatgacaaacctacaaaaagaatcaaaacagtatacaacactgtcctctatccacaaaacaaatggatctttaagtgcaaccaaaagagatgacaaaagccttacatacagggttttatatataaaaaaggagacactttattctaaaatcaccacttagaaatataaacatcttgcacagagtagggattttattcactttaaaaacatgccaaaaaaaatgggagatatttctgacttgagacaatgctatactctttttaaagcatgatattaaaaagtattcggaaaattaggctacttacataagaggaataaatttagctcttgccaaaaagcttccaatataatttccagcagcctgcctgatgatggcaggattacttgggtcctgcaattttttccagagatgttccaaaaatgcctctgcgaatccctataaaaagagagggcgtcggtgtgatcttttttaatgcctaagataatctggctatcaaaatcccaagatttttacttcaccaatgtagggaaaagttctactatctcataactatctcatgggcttcatttttaaaacacattgagagaatatcattaaaaacaaaaggcacctcgggtgttaaataatccagtggatcccaaacctagctaagcatcacaatcaacccggggccaggcacagtggctcacgcctgtaatcccagcactttgggaggccgaggcgggtggatcacccaaggtcaggagctcgagaccagcctggccaacatggagaaaccctgtctctactaaaaatacaaaaattagccaggcatggtggcaggtgcctgtaatcccagctacttgggaggctgaggcaggagaatcgcttgaacccaggaggcagaggttgcagtgagctgagatcatgccactacactccagcctgggtgacagagtgagactccatctcaaaaaacaaacaaacaaaaaacaacaaaaaattcaacctgggaggtacaaattcaataggtttgtgacagggctttggaatccacatattacaaaaactcttcaagtgattccaatgtcagccagaactggtgaccaacaataattcacatcccatggagctccacatgggcactcctgtgagtgcaaagcaccttccggtctctggacacactgaactcaaccacgaacagaaatacggactaacgcacagctggtatttgagttaattatgccaatcatggaaaaaaacagacacagcttctcaccaaagggtgtaacttccaacttctcctaaatagcgctgttctaaagctaggcacacccatgtgggcagactgaattcaaccttctttcccatgaccaacactctcctgatctctaggaagccacaaaatcgttgcagagaaggaaaagccttctacattctttcccccaccaaaaaaaaaaaaaaaagaagaagaagaagaaaagacaaagcctaaagtttttaaaattctagattaataagttggtttgggctagttacaactcaacccttggaaagaataaaggaaatacagttaattaccccatatgagattttaatagagaaaggcttaagggaagagcaccacctagtgaccaaaaggcaggatgacattttcggagcacctagctgggctggcaggcagcaatctgttttctctccaagtgtactgagaagggaacgtgggccaggcacagttgttcacacctgtaatcccaacgctttgcggggcaggaggcgggcagatcacttgtggtcaggagttcaagaccagtatggccaacgtggcgaaaccccacctcttctaaaaatacaaaaattagccaggcatggtaacctgtggtcccagctatcgagagggtaaggactgagagtccgttgagcccaagaggtggaggttgcagcagtgggcagcagagcgagactgtgtctcaaaaaagaaaggaaaagaaaacaaaaaaagaaaggagaatgcgattttattaagcagactagcaagtaagctcaaagaaaagaattatttacttcatggtctccgtccaccccagtttttagggaaaatttttgggcaaaaacaaagtaagctaagataatgttaatcacattcttactcaccaatttgaaactacagaggtaaaacatgaaaaactgtacatggcaggaggcatgggtgggcaacaggagtttgtcaaagatgtttatcaggtcgcgatatagatcctttgttttgccgttatcaaccttacctatggagaaaatctggcatctcagtttttataaagacatattttcaagtttcatctgccatattttttataaacacaacaccattaaaaaacaacattatccagccaagcacagtggctcctgcctgcaatcccagcactttgggaggccaaagtgagagggagcccgggagttcaagggcagcctggggaacacagggaagctctgtctctacaaaaaatcaaaaaattagccaggcatggtggcacgcctgtgatcccagctacatgggaggctgaggcggatgaaccgcttgagcccaggaggtcaaggctgcagtaagccatgtttgtgcgactgcattccagcctgggttagagtaagaccgtggctatttaaaaaaaaaagaaagacagacattatccattaaaataccattaaaacaaaatgctacttttagtttacacagattttcctctgaatataataatctaacacctgcaaggaagcaggccctcacctcacacactgtggcaaggtcagaaatgcaaacccttctgaagagcaattctatcattcgtgtagcaaaagacctctaatccgatcattttactgttagtaaacagctgaatatataggcacaagtatgttcattataactgttacttatcatggtgaaaacagtaaaagacagttaaacccatgtgaccaacaacatttattattacgacttttttttttagagatggggtcttgttatgttgcccaggatagttagtcttgaactcctggcctcagtgatcctcccaccttggcctaagtgctgggattcaataacaattattttaaaacaggcaatgatatgagaaaatgtttatcttcagcatccatgtaaagggcagattatgaaacacttgtgtttagtgtgacacccaaattcactaaaaaatactctcctacatatacagacgctaacagaaaagggaaaaaagtcaaacttcaaaatgctcacaatggttctctgaagagtagaaatgtggccatttaaattgtttttatcctttcctgtagtttccaaattctctaatcaacatgtattatttttataacagcaagaccgttaaaacagtaatgcagtcaactcagattccagttctattattctgactcactgagctcatcttaaatcttagcaatgtgaatggaaaaaaattctgttttcgcctggcaaagcctttaaagttccatgaagtcaagaagcacatatagtactaacactggcacaacaatggtgccaggcaaagaccctctaaactcaatacataacggagcaccatatattagtgcaccctacatcattcttcagtgcattcagcaacttgagcgtaatttgatctaaaactggccaaactccatatataatctttcaatacaacaatcagtgaaaagacagaagacaaatataactcagccagaatcccagtcccattttcaagctatgtgactggcaagtaacttgacctctttaaatcatcttaaactcatactcaatagatatttttacaggatttttagtattactagagataatggatggaaaatgcccagcacaaagccaggtacactgcaggtgttcaataaacagtagctactgtgatttaccatctacatagcagacatccttcatgtaggacaaaaccaaagacatcaggatgtccaggcgctcggctacaggatgcaccatctggtcgagccgttcaggaccagcctttgtttcatgttcagtttcttcatcttcatcctttgaagacaaaaagtaaatactaacattaaaaaattcaatgtcaaagtggtttagtaggaaaactgtcataagtgattatttcccttaaaagataaaacaaagaggctggggaaagcggctcacatctataagcccagcactttgggaagcagaggtggggggatcacttgaggtcaggagtttgagaccagcctggccaacatggtaaaactctgtctctactaaaaatacaagaattagccaggtatggtggtgcacgcctgtaattccagttactcaggaggcagaggcaggaaaatagcttgaactgggaggtggaggaggctacagtgagccgagttcgtgtgctccagcctgggcaacagaggaagactctgtgccccaccaaaaaaaaaaaaaaaaaactaaactaaaacaaagaaatggaccacgcacagtggctcacgcctataattaccaacactttgggaggccaaggcaggaggatcacttgagctcaggaacttgagaccagcctgggcaacacagtgagacctgtctctacaaaaatagaaaaaaagtagctgggtgcggtggtacactgtagtcccagctactcggggaggctgaggtgggcagatcacttgggcccaggaggtcgaggctggagtgggccaagatcacacactgccacactccagcctgggcaacagagtgagaccctgtctcaaattaaaaaagaaagaaaagaaagaaagaaatgcagacacctttccaggcaggggtctcattcagggatgtgaatcagaaccaccagtgaaatttaaaataaaagccaagactcacagcaccagcttctgattctcattgagaagacccaatgagacctatccatgcaaaaatcacagatgccccctacctctgctcctggtgcccaccatggcgggtgcttttggtgccgggcccccttttgcaggtcgggatatccacctccccactgctgtgagtactggcggccaatagctcacagccgcctactttctccagagctgccctgagcagaaaggagccaggaccacccttgcactctttccagcccctcccccttagaaccaatgactgattgacaaggcatcagaaaaggacatctccttggtctcaagctgggaacaaactctgtagaccaatccatgccccagaatgcctggtgggagcaggctgtagcgacctcccaagtgagacccggcccccgtttagctcccctgccctcttctgctccctgacaccctctgtcccaagggcacctgaatccctgtctcagactctccttccactgaacccaacttcagataccacccaaaagaagtaatgctataaagtgtacaagtggtaaaatgcagaaattaaacaggtatgcttttctattaaccacgccctcacagacagcatctggcttacaaaaacaaacactgaaagttacaagaacaaaagtgaaacatacttcaccaaacccaaattcaaagccttggaaatagaccaactatgctaagtgctaaatgacatggcagcaaattactcatataaggaatcgttttcaagtttgctgaactattttaattctttcaatctaaagccttaacaaagatgagcagcactagctgtttccaccctttatgataaacttcatctccactttcattaataaactgctaaccatattaaacaatccttccgtggaatctgtcccaccacaagtttgagttgctgtttcttcagcatcttcaataccctgccgggatgcattcacctataacaaagggagaaaaaaaaagaataaaaggatttaaaaaatacaactatgttattttgggatggaaattcatctgatatacgcatgttcaaggtgtccagattagtgccttatatcacaccccaacacaatacacaattatggtgcaagcctgtaaactgacctaggtcatgaaggaatttaaatataataaaccaagccccttttactacatacttatataaaatcgacaactatcacatgatgctctatgccaggcagcctcaacaaattcaacatttattctagctctgatatggtctggctctgtgtccccacccaaatcacttttttttttttttttgaggcagagttttgctcttgttgcccaggctggaatacaatggcaagatctcggctcaccgcaaactccgccccccaggttcaagagattctcctgcctcagcctcccgagtagctgggattacagtcatgtgccactgtgcccagctaattttgtatttttagtagagatggggttactccatgttagtcaggctggtctcgaactcctgacctcaggtgatccaccggcctcagcttcccaaagtgctggaattacaggcatgagccaccgcgcctggccccaaatctcatcttgaatcgtactcctcctgtaagtcacacatgttgctggggggggactggtgggagataatttgaatcatagggtaggtttcccccatactgttctcgtgatagtgaataagtctcaagagatctgatggttttatcaggggtttccacttttacatcttcctcattttctcttgccgccaccatgtaagaagtgcctttcacctcccgccatgattctgaggcctccccagccatgtggaactgtaagtccaattaaacctcttttttggccaggtgcagtggctcacgcctgtaatccgagctctttgggaggccgaggtggacggatcatgaggtcaggagattgagaccatcctggctaacacggtgaaaccccatctctactaaaaatacaaaaaattagccgggcatggtggcatgtgcctgtaatcccagctaatcaggaggctgaggcaggagaactgcttgaaccccggaggtggaggttgcagtgagccgagatcgcaccactgcactccagcctgggcaagaagcgagacaccatctcaaacaaacaaacaaaaacatctctttttcttcccaggctcagctatgtctttatcagcagtgtgaaaatggactaatacaatctctatgcacaagacactcacagacacattgtgtaataaacatatcgtcaatcaactgagcagaaaaatgatgaactgccagccaaatgtgcatgatgcaatatttattttggtatatcaccattcaaatatcttaacataccactcaaaccatgccattttttattatctatgcttgaccttctttgtaaacattctaaaatgttccttaagtatataccagagaaagactataaagagtacatatacagttggccagagaggtgcaactccaagtgagcactgcaccagtgagcccaagctccagctcttctgagaccttgttccatcttcctgctttcctatagcatcaatgttttcctccaccaaagctcctctcccctcagtccacaaacctgctcacgtctctccactcctaaaccacgcctcttagccctgctccatcccctccttccaccacaaccctgcaccaaggtctctaacagccccaattctgcttccccaccatccacatcctctcccgaaatgcagtttctgcgtcttcactgacatggtcctccagaaagcaacaaagactaccttctaaccactaaatccaaggactgttgctcttttcatctttctaaaaaatgacagcagtatctgatgctgctgaccaaactcctccttccggcggatccttcctgagcatccaggctcttggttttccccatacttctgatcacccttctcctcccctgtcctaaactgcatctttccaaaggtttatgctcaggtccccatctgcagccacgactgcctgtgagtattctctggtaggctgcccaccagcaactgaacctggccaagatggaactactcttccaactgcctcctcttcgtatttttttctttttttttttttttttgagacagagtcttgctctgtcacccaggctggagcggagtggcgcaatctcggctcactgcaagctccacctcccggattcacaccattctcctgcctcagcctcccgagtagctgggactataggtgcccaccaccatacccggccaattttttgtatttttagtgagacagagtttcaccatgttagccaggatggtctcgatctcctgacctcgtgatccgcccgcctcggcctcccaaagtgctgggattacatgcgtgagccaccacgcccggcctcctcttcatatttctaactaccattaatggcaacaccaagattcaattccacagggagcaaagttgaaggattcctttcccttactgtctgcctcccctcctccaaaccagtctcaagcaccagttcatctttcctgacaatgtcactagaatctactacttcctttcattcccactgcaccttagtgcgggcctccttaaacaaagttttaactgtttataattataatctgcccttaagaaaggccaaacaggaaaaatcacttccgtaagaatcccttcctgaccccactgtgattctatcaggttctctaactcataatgtatgtttcattcatagcattttccacaaccatacttttacatttggataactatgtatttaacgccttgttctccaatcatgagaaggaactgtctacaactcccagcacatgcacacattcaaagaaaggaagcaaagaatggtgctagtggtttcttttcttttttttttttttgagatggagtctcgctctgtcgcccaggctggagtgcagtggcacgatctcagctcactgcaagatctgcctcccggattcaagcaattctcccacctcagcctcctgagtagctgggattacaggcacccaccatcatgcctggctaattttttatttgtatttttatagagacggggtttcgccatgttggccaggctggtctcgaactcctgacctcaggtgatctgcctgcctcggcctcccaaagtgctgggaatacaggcgtgagtcaccacgcctggccaagtggattcttttctatcactgactattgtttccacatactgtgattataacaaattcaagtcagtaaatgaaaataaaaatagattactcaatacttacatccaacttgagtagtttttcaataataagctccagaatttcatgcctcaaggttggaaaatatacactaatccttagtaagttatgaacgtaacattcctaaaggagaaaatgtaagataaaacatttcaacagagaataaacgtttcacagttatgtaagcaaaacatcaattacatgacctttagtttcaaatatttaaaaagaaaaaaacagactatccagcaatacaaaaactatactgtttctacatgtattatgttcggtataatcatttcaattattcccagtaaatgaaatttttaatttgcataactataggtttttaagtagctgtattgataaaactcatatatcatacaatcaccaacttaaagtatacaatttaagtttttaatatattcagttatgagaccatcaacataatcaatttcagaacatttatttttcttttagagacagggtcttgctctctctctcaggatggcgtacagtggtgcaatcatagctcactgcaaccctgaattcccaggataagcaatccttcctcctcagcctccctagtagctagaactacaggtgcacaccaccacatgaggttaatttttccttttagagagacattttctcactatgttgcccaggctggtcttcaactcctggatcttcccacttcagcctcctgaagtgctgtgattatgggcataagccactgcgcccagccagcaattttgtaacattttaatcacgctaaaaagaaatcctacatccattagtgcacccctaaaaaatgaagaccttggcaaccactagtctttctatgaatctgcctctttgacatttcatataaatggagtcatataatacatgtttttagggttcaatcatgttgtaacatgtaaaccattcctctcatatcaatggagtcatacacagtttgtggcatgtttttagggttcaatcatgttgtaacatgtaaaccattcctttcatatcaatggagtcatataatacacagtcttttggcatgtttttagggtccaatcatgttgtaacatataaagcattccttttcattgctgagtaatattccattgtaccatgttttgtctgttcatcagttgacagacatttgagttgcttctacttgaggctattatggatgatgctgctatgaccatccatgtacaagtttttctgtggacatatattttcatttctcttgggtataaacccagaaatggaactgctgagtcacgtgttaattctacatttaaccttgaagaaatgccaggctattttccaaaatggctgcaccattttacattctcacagcaacatatgacagttccaacttcccatttctccatatccttgtgaacacttgttactgtcttctcgttctgattatagccatccttgtgggcatgaagtgaaatcatttccctgatggctaatgatgttgagcttcttttcatgtgctttttttgcagaaatgcctattcagatcctttgcccacttcagttgggctatttgcccttttattattcaattataagagttctttacatatacaagtccattaccagacataaaatttagaaatatttcctcccattatttggggatccttttcatcttcttgaagatgtcctatgaagcataacaacgtttaattttgaagtacaattgatgcatttttttctttggttgcttgtgcttaggcatcaaatctggaaattactgcctaaaccaacatcatgaaaatgtactcgttttcttctcagagttttacagtttttactcttcatgtagggcttttattgagttcatttttaaatatggatatccatatgcttcattcttttgcatgttcatatccacttctgccagcagcatttgttgaaatgactattctcccctattcaattgtcttgaacaactggttagtgtatgttagtcttctgtcccgtaaccatgctgaactcatttattatctctaaaatttcttgtgtgtgtgtaaactccttagaatgacatataaaatcaccttgcaaaagagagtttacgccttcctttccatctggatgcttttaattctttttcttgcctaactgccttggctagacaagcagcaagagcggacatccttgttttgttctttgtcttaggaaaaaacttttggtctttcaccaatgaatatgatgttagctgtgggtttttcagatgccctttatcaggttgagaaaatttccttctgtttttctcgtaaaaggatattggtgtttgtcacacacttctgcatctactgagatgattatgtggtttttgtcctttgttctattgctacaaaatattttattaattcattttcaggtactaactcaatctcggccggtcacggtggttcacgcctctaatcccaacactttgcgaggtggagacgggtagatcgcttgaggtcaggagttcaagaccagtctggccaacgcggcaaaatcccatctctaccaaaaacacaaaaattagcggggtgtggtgccccatgtctatagtcccacctactcgggaggctgaggtgggagagtcacttgaaccctggaggcagaggctgcagcgagctgagatggtgccactgcactccagcctgggtgacagacggagactgtccccccacccctgaaaaaaaaaaaatcaatcttgcattcttaacatcagtcgcacttggtcatggtacataattctttttgtatgctactagattcggttttctactaaggcaaccactattaattattaaaaactgcacagatgatctgaacattgtacaaaaacttaagcagaattcttctatggaaggctttgtcttcaggttaaaataaggcatgttcacaattagtaatacatgaactattatcttctagtaattcttgtccatatgagcataaagccactacagatattcctgaaatgaactcagaccttgacttgcacatagtaataacagaaaaaggcactgggaatccccaatagccgctttataagaaaggaatctgagtcaaattcttagacgtcagtttaaagtctagaagacaaagtaacctttaagaaaaagacctaacattagctgggcacagtggttcactaatcccagcactttgggaggccgaggcaggcagatcacaaggtcaggcgttcgataccagtgtggccaatatggtgaaaccttgtctctactaaaaatacaaaaattagctgggcatggtggtaggcgcctgcagtcccagctaatggggaggctgaggcaggagaatcgcttgaacccgagaggcagaggttgcagtgagccaagatgacgccattgcactccagcttgggcgacagagtgagactcggtctcaaaaaagaaaaagaaaaagaaagactggaaaagaaagaaaaagacctaatatcatctaaaatgaaatcgtacaaacaacttttccatgatgttctcaatgaaaagatttcttaccagtgttctctctgattttcgaacaaatggaaatttttccaccagtattggcatgagaaaccacggtgtcctatttttaaaaaattaaatcaatccatgttaactttactttctagaaaaggaataaaaaggaaaactaccattctaaaagcaaatattgatagacataggaggcaaacaggaacccctacctcaaagaactggaactttttttgttttttgagacggagtttcgctcttgttgcccaggctggagtgcagtggcgcaatctcagctcactgcaacctccgcctcccaggttcaagcgattctcctgcctcaacctcccaaacagctgggattacaggcatgcgccaccatgcccagctaattttgtatttttagtagagacggggtttctccatgttggtcaggctggtctcgaactcccgacctcaggtgatccgcccgcctcggcctcccaaagtgctgggattacaggcgtgagccaccgcgcccggccagaactggaacttacaatgtatagcttctgagaaaatctataacgacttagagaaaataaggttctgttaactctgatatcaacagcaaatcaaagagggagcttctctcccacagaaacataacagcacttttgctgacatttcccactacacatgtatattatttttaaaagaagaaaaaatcatcaagttggattttttttaagttaacaaataatcaacggacagagggaactagaggtccacccctccaaaagaaacccacaaacctgaaaagcttttcttagaagtgcaatttttattcatatggcatgacacaaacacacccaggggtttctcactgaaaaattttggatagcatatctgttgaagataaaagcaaaattccaaccaccatacaaaattgggggaggatctgcatacaaactttgaaaaacaattaaagagaataaatagaaaatggaaatgccactttttgtagaatgtaatgtttcctcaagtggatacaaaaaaaacatgcaatgtaagactcaagctttaatactattaacattttataatttttactaattgattacaattttcttgagaattaaacattcaaaataaggaaaagtatactcacgatggtacatatcttgctattatttgcaaggctctgtgacatgtgtcaaaatttgcaggaagatctgaaaggagaaaagttcagagtatgagcatcaaaacaaaactgaagggcgacacgcttgaagctaaaaataaatgctggctgggcacagtggctcacgcctgtaatcccagcactttgggaggccgaggtgggtggatcacctgaggtcaggagttcgagaccagcctgaccaatatggtgaaaccccatctctactaaaaatacaaaaattagccaggcatggtggcaaatgcctgtagtcccatctactcaggaggctgaagcaggagaaccacttgaacctgggaggtgaaggctgcagcgaaccgagatcacaccactatactccagcctgggcaacagagcgagactctgtctcaaaaaacaaacaaacaaaaagtgacatacttgaagctaaaaacacatgctaaccaaaacggaataatttatcagagaaataataatttcaagatttttctccaccagcatcaacgaaaattaaatggactaattatataaataatgcattcaggacaaatgactgcatatcaatggtaaatataacaaaaagattacatcaaaggttgtcatttgttgcagtctacttattagaataggtgccaggtattctgtgctttacttttttttttaaagaagacagtgtcttgccaccaagcagggcttgaactcctgggctcaagcaatccacccacttaagcctcccaggtagctgtgactaaagacacacactaccctgcctagttctactttaagccttttttaagaaaatatttgaaaaaaaatgtttttttgcagagacaaggtctcactatgttgcccaggctggtctcaaactcttggcctcaagtgatcctcccgtcttggcttcccaaagtgctgggattatgggtgaaagctactgtgcccaggctttaaacctttttatacttactatcatcttcatcatcagaatctgaaacatctacatcgccttccttaatgatcactcgggcttttgagggaaaaagaaaatatgttattctgtcattgatctagacaatgaatggctatacaaaaaaagttactgacctagacaatgaacagctataaaaaaagttatttttccataatccaaagttagcccaatgattaattaaacgcacaatctgaaaaaaagtaaagcaactttatagtttttaaacggctaaaaattcctagatttcaccaggagttcaataaagcaaataaattcataaaactcacagcaacaaatgaatctagacacctccataggggtcattacggggaatatatgtctaccagacctggtgccaatatgcatctggaatcttccatggtagcagtctctcatatataaggggaaggtagtattttaataaagaagtattaaaaagaaaataaaattccaagcaatgacttacgaggcacaaaatgggaagcaatcatgctgagacacggtctgaggaaaacagtctgtgctgatacaagattaccaagaaaagccaaatactcttccactactgtttgacttctattcaaccaaggcaatctctagagtgggggaagaaagataaaagcagcatgttattaatataacatatactattaccaaagttctgaattacatactttacagtaaaataaatggtgaacttactaatataatactgataagttgctcaaagtcttttgtcaagtacatgatagaagaacggaattctagcagccagttgatgatctggtcatccttaagttaaacaaagagtactttcaaaatcacaaatcctctaacataacagaaatttacagctatcttatatcaatcatttatcaagaataggttggggggaaaaggtcacaaacttggaaggaactcaaaactgggtattaaaacagaaaaagatgtcacaataaattacttaactgttttaagaaagtaatctagtaactctaatacacaggagaaagacttaaatgcaatacttcagcctgatcacttctgtttgccctgaaaaagcgaaatcacctcaaatgttgacacctgggacttttaaaaactgcagcattctagcagactgaaatattagaagatcacaaaggaacaatagctacctctatttcctctatattcaagctgaccaggaagcatgctgataaaactcagtcgaggctgatcaattggggtcatgaataaacataacttttctaaaccaaacctgtggctgagtttaaatatattatgatgtgattgttctgtataaatgatagccccattcctccatgaaatatttttcgggcaatcaaattactgttcatagtaattgttagtgacatgagaagaactgctaaatttgaaacgcaatgtataaaatacagtgtcaattatgtaaaatattactatattaattatattcatgcatatatactgcacaggaaaaaaaccattaagaaaaagcccctaatttgtggaaggcttagacatataaataaaagcaacacaaggtcatacctacagggatattcatatggagttatcatttagtgagaatacaccatatgccaggcatggtgcctgacactccacatatatatcttcttctaatcctaaaaactctgcaagatgtttagttattcccattttgctgttcaggaagctgaggctaagaacgattaataagcaatctgcccaaccaagaggccagtaaagaagcaggtccaaacccgtctgtctcggtcaaggctatcctctgtccaccgtcccacacgcctccctatatgcggagaagaagctgtccccttttccccaccttaattcagctactgagtgcttactatgccatatccatgtgtcaaactcccacagatcaaccattttctgatgaaatcccaagtagcctggcagtaaaataaagtaaaaccacaactcatttgtactatggtaatttcatatgtccacaactgttaaggataacattaacggtagctcactaaggccaaaggcatgtagaaaacaagctaagttagtgtacaaataaaataaactatcctatctcttttccactaaaaagactgcaacaaaactataaggataacatttaaactgtaccatttttaaaagtaaatcaggctgggcgtggtagctcatgtctgtaatcccaacactttgggaggccgaggtgggtggatcacctgaggttgggagttcgagatgagcctaaccaacatggagaaaccccgtctctactaaaaatacaaaattagctgggcgtggtggtgcatgcccgtaatcccagctactcgggaggctgaggcaggagaattgcttaaaaaactcggaggcagaggttgcagtgagccaagatcatgccactgcactccagcctgggcaacaagagcaaaactccgtctcaaaaagaaaaaaaaaaagtaaatcagttgcagactttgatgctttagtactgaactattattatttctactagcaggcaggaacagtggctcatgcctgtaatcccagcacttttgggaggccaaggcaggaggagactgcttgagcccaggaatttgagaccagcctgggcaacatggggagacctcatctccagaaaaattagccaggcatggtagcacatgcttgtggtcccagatgctcgggagcctgaggtgggaagattgcttgagcctgggaggttgaggctgcagtgagccatgatcgggcccattacactccagcccgggtgacagagcaagaccctgtctcaagatggaaaaaagttctacttgcaacactccacacaactagtgcaattcttggtatgtcaaaataccaagaatgagaactgctgatacaaaatacagtggaacacaaagaaaatgtccctttgtatctgggaaagaaggcaggggtcaggaaaagctttaaagagaaagtgatgcttcagctgtctttaaacagtaacacagttgagtcttttctggaagttctgcttcttacagaaggaaaagtatgttttcagaaaactgaaaaacgttcagtatggcaggcatgtatagtgaccaagccaacagataataaatctggggaacaaagaagcaccaaatagaccatggggggccttgtaaaccagatctgtaactagagagatctggaagtgtgggaaatggactcaatgaaggaacaaccatgtgcttagagagaaccagggaaagctccatgaaagatggagcccagccaagagtggacatgctaagtttggagcatctatgatgattctgggtaaatgcatctaacagacagttaagaaacaagtctaggccgggtggagtggctcacgtctataatcccagcactttgggaggctgaggcgggtggatcacttgaggtcaggagttcgagagcagcctggccagcatggtgaaaccccaaatctactgaaaatacaaaaaaattagctgggcatggtggcacagctactcgggaggctgaggtgggaggatggcttgaacccaggaggcagaggttgcagtgagccaagatcatcccactacactacagcctaggtgacagagcaagactctgttctgcccgtccccaaaaacgaaaatgaaataagtctggagcccacaagagcaatcttggctacagacacaaatatattaggacacaggtagatttcaaagccatgaagggagatgaggagatcacacagaagaatcaacagagtgagaaaagagtcaagttttgaagcccaatcaacaccaaatttaagatcaagaaactatcaagaaatactagcgattaaaggatcactggccgggcgtggttactcacgcctctaatcccagcactttgggaggccaaggcgggcggatcacgaggtcagaagatcgagaccatcctggctaacatggtgaaaccccacctctactaaaaatacaaaaaattagctggcggtggtggcgggcgagtgtagtctcagctacttgggaggctgaggcaggagaatcgcttgaacccgggaggcggagcttgcagtgagccaagattgcgccactgcactccagcctgggcgacagagcaaaaaaaaaaaaaaaaaaaaaaaaacagattaaaggatcaggagacaggaggatcagaaacgctgaagttttaagaagtgggtggccaacagtgtcggctgatacaaggaatacaaggcttaaaaaagtaagtccactgaggctgggctcagtggctcacacttgtaatcccagcactttgggaggccaaggcgggcaggtcacctgaggtcaggagttcaagaccagcctggccaacatggtgaaaccccgtttctactaaaaataaaaaaaattaaccaggcatggtggcgggtgcctgtaatctcagctatttgggaggctgaggcaggagaattgcttgaacccaggaggcaaaggttgcagtgagcccagatcacaccactgcactccagcctgcgtggtaagaaggagactttgtcttaaaaaaaaagtccactgaaatcagcatgtaaaaaaaaaacatgggtaacctgtcagggtaattactacagtgataagaacagtggacttaaatgtgagtgagaaatgatacagcgcagtcagctggaacaaaaacaacagatgacaattattgcccttactttgagtcagagactgttctaagtgcttcttgcatattagctcattgaatccttgttaagtatttccatgtttaaagccaggcactttaaacatggcatgcacctatagtcccagctttttagaaggctgaagagaaaggatcatttgaggccaggagttcaaggctgtagtgcactatgatcacacctgtgaatagccagagcaacacagcaagaccacatctcttaaaaacaaaacactccatattttttaaatctctattgttttcttggtttcacacagtggaaaatagaggcagagaggttaaaacaatttgctcaagatcacacactggataataaaattggaatttcattccaggcaatctaactaccactgccatagtaataaaccattctcttcaaaactgggcagtaaaggaagaatggtgaaacaaaatgcattcagcttttactacatgataggtgtatctcgaacctggaaatgctgaatcagtggtttgttttttttttttttttgctttgttttagctttaaagagacaagagagttgcatgcagcatggaggaaagaggtagtaatctaatagaaaggaagcattagagcagggtttcccagcctcaacactgttgtcatttggggctggatcactcttggttctgggaggctgtcctgtgcactgtgagatgtttagcagcatctctgtcattcacccactagatgccagtagcaccctttcctcccagttgtgacaaaaatatctgcagccatcaccaaatgtcttctagggggtaaaactgtccctggttgagaaccaccagattaaaataagggaggaccatggagagagcaagttctggaggacagaatgggacccaaagagcaaactatgtctgtatacagtggcaataattttgctaatgatcaaacacaaaattaattacctttatgtctggatctaacagctggttcttcaacaactcaaagtcatttgtttcacccttaacaagaaggggaaagaattaagttatgcttttgtttcctgtttagtatcaacagcaagacttttaaccgtactttaacatcagatgaaattataaaaggaacactaactttcacatgtcaattgcggattataaaatcatgactacaaaaatttaaacactcatgttagtgcagccagagggcttggaaaaaggaaaatgataaactacatttagctatacttctgtattgacatttgaatataatagttgatactcctgcgaattctcaaaaagcatgagggaaaaaaacagccagctataatgatctaattcaggaggatctaaaaaagtattcactcaaatatggatacaaatggatattacatataaacatatggttacttaacattttccctctactgctgagatacagtagaaatgcttctaaactaccacaaaaacaaaaatccctactcagagaactggtttactgtcccaaagtaatgcttaggtaagttcctcaaaaaataaaatgctgtaggccaggcatggtggctcacgtctgtaatcccagcactttgggaggccaaggcgggtggatcacaaggtcaggagttcgagaccagcctggccaacatggtgaaaccctgcctctactaaaaaaataaaaaaattagccaggtgtggtggtgtgtgcctgtaaccccacctattcggaagactgaggcaggagaattgcttgaacctgggaggtggaggatgcagtgagccgaggtcacgccactgcactccagcctgggtgacagaggaagactccagcacaaataaataaataaataaaatggtgtaattgtttttaattctggcacttgctaaagttaaaagatgcttcgtaaataaagcatttgaagaggtgaaacctcagtaaagacattattactctctcattattacctgtgaaatgggccaaggtgggggaaaaaaaggacactattactctaattttgcactgacggcatcatgctattattaaatatttgatttcaactggtatcttaattaatcttgctatttctattggtctttagtataacagcaatagttgtattctgacctaaccaaaagcaaacctcacacattatctccccttacctttttgtacttcagcaagacttctgtcacagttccaccaaaccgaacagtttttcttgggggagaattgaaaaagtcattctctaatgcacgcatatttgaaatcctgtggaaccaagattaacaagctattaagttcatgaaaataataaaaattataatagccaacatttattgaaccaacataattcagtggaactattgttaaggcctctttactggtctccctgcttccactcttaaccaacaatccttcctttgctcagcaaccaataactgtcttcccactgcacttacagtaaaaatccaaatctctcagtgtggtctttaagatcctacattaatctggcccctgcctacctctctcacctcatctccaacaacttgttttactacagccataacgtcttttctgctcttcaaacaagccaagctgtttttcatttcacttactgttcactctattggaaatactcttttcccaaatctctacgtggctggatttttttttttgagatggagtcttgctctgctgcccaggctggagtgcagtggtgtgatcttggcttaactgcaacctccatctcccgggttcaagcaattatcctgcctcagcctcctgagtagctgggattacaggcacctgccaccatgcccggctgatttttgtattttcagtagagacgaggtttcgcacgttggccaggctggtctccaactcctgacttcagatgatccgcccgcctcggcctcccaaagtgctgggattacaggcgtgagcaaccgcgcccggcctagatttttgtcttcattcaagtggaagctcaaatgacagatgtcttcccaatgagaaatctcaaaagctccttctctcccttctccctcccccattaccttgttgtataactgaaatcatcgtgttcgtttatttattggcctatgtactgcctttcccccctatgctgtaagctctgtagaaagcagggacattagtgtctttggataaaccactgtccccagtgtttaacacagtaagcaggagctcgataattattatgaatcatattacgctaattgttttacaaggtttgcttcacttacacgtagtaaattaatgaaaaaacatagcatcctaatgactctgaaagttaaacgccaagagtgctacgggggttagggattttaaaagtggagcaaaataaagactgcgaaacaaatacgtgtgtcgaaacaaattccaaacaaaaaagatgtaatattcaatttgccatgagtgacgacgttcggctgataacccacatagcccagggaaatcccttccaaatttggacgaagaagagggaaggaagaggggtcaaggcgcagaaggcagtacccaggcctgggaaatcacgaagagacacagtcgggaaagggggcctccagaacagagaacatagtcacttttccaggccccacccatgtctattacccagttaggaggaatgagctcatttctgtgaacgtgagatgaccctccaccccgtgctcctatcacacgccatgagctttgtcccacatcctttcaatccgctcctctaagcgccgtcctgagctttcgtcccagatacgcagaaggaagcggcctgaatcttacccagtcctcgacgcgcccagcttcttaactgcagaggacgaagcggccgcatctcccggcaaacgcgtgtgaagcagcggtgccgccattgggccgaactaacgcgaccgctgcgcctcaggccggatgcccagctccttccagccacagcctctgtcccggaagttgcgcgtgccagcgcaaccttcagccaatcagcggccccgcgtggggagggcgtatgctctcggcgggctagagcgccgctgaaacccgctcctcgttctacttggaggacttgttccagccagcgctagtgcgtgagtataaggagagacgggaaggaccggctccatccagccctgaggatcccgaagaaagggtggaaacaccctggatgtgctaagctgtggccgggtacactcaagtgttaattttttggagtcaaagcctccctcagtcaaatcgaagaaactgaagcacttgtgactgacccagatcttcacggaggaaaggggattcgaacccggctgacccaggagcctgggctctatactcagtgcagcagtctcacagacacccaagataacgttatcctcacggaaacgagctcgacgaagtgacctacctcagagcctcaaggctatggtgatgctggcatgagaaacaacaggagagttacgaagaggtgttacccccttgactttatttatttatttatttattttcttttgaggccgagtcttgcccttttgcccaggtggagtgcagtggtgtgatctcagctcactgcaacctccgcctccccagttccagcaattctcgtgcctcagcctcccaagtagctgggattacaggcgcatgccaccacacccggctaattttcgtatttttagtggagacggggttgcactgtgttggccaggctggtctcgaactcatgacctcaggtcatccgcccgcctcggcctcccaaagtgctgggattacaagcatgagccaccacgcccggccaaacttaaatttttaaaagaggaacaggagtcagccagaccaacaaaagagccactggcgttccaagcataggaaacggaggaaacagaggccaaaacctcgggactgtggaggatgtagagggagagcaggggctgcccctactctcagggaggggaaaaggttgcaactttggaaactgtacaggcctatcaaaaatacaaaaatatccagcctgggtgacacggtgaaactccatctctacaaaaaatttaaaaaataaaaataataaaaattatctgggtgtggtggcacacacctgtagtcccagctactcgggaggctgaggattgcttgagcctgggagatagcaccactgcactcctgcttgggcaacagagtgagaccctgtctcgaaataaataaataagtttttaaaaatgcatatgtatgggcccggcgcagtggctcacgcctgttatcccaacactttgggaggccgaggcaagtggatcacctgaggccagaagtttgagaccagcctggccaacatgacaaaaccctgtctctactaaaaatacaaaattagccaggcatggtggcagtgcctgtaatcccagctacttgggaggccgaggcaggagaatagtttgaacccaggaggcagaggttgcagtgagccaagatcgtgccattgcactccagcctgggtgacgagtgaaactgtgtctcaaaaaaaaaaaaggtgtgtgtgtgtgtgtgtgtgtgtgtgtgtgtttatatgtatctctctccaggagttcaagaccagcctgggcaacatatggtggtgcatacctgtagtcccagctacttgaaaactgaggacggaggatcacttgagccctggaggtcaaggctgcagtgagctgtgattgtacccctgcactccagcctggacaacacagcaagaccctatttcacaacataaaatacagcaatttggtttttttgttttttgttttttttttgagacagagtctcgctctgtcacccaggctggagtacagtgtcatgatcttggctcactgcatcctctgcttcccaggttcaagcgattcttgtgcctcagcctccccagtagctaggattacaggcatgcgccaccatgcccagctaatttttgtatttttagtagagacagggtttcaccatgttggccaggctggtctcaaactcttgacctcaagtgatccgcccgccttggcatcccaaagtgctgggattacaggcatgagccaccacgccccgccagcagtttgttaaacataaaccatagctctgttttgcaacagtgtaaaatcagtaactgtctttcctgagtctctatttggtccttactgagttccttgggaatgttggacaggaatcatctgtgtctcaaggacagaggaaataattgcaccgtagctcacaaagatacttcaagataactgtttaaatgagaatctcttcttcacttccaagggaaagcaaagcaaaaacaaaaagcaacaatagcaaaacagcaatctgacaattatctgttttgttttgttttggtttgagacaggatctcattgtctagcccaagttagagcgcaatggcgcgatcatggctcgttgcagcctcgggctcctacagcttatgcaatcctctcacctcagccgcccgaacccacaccaccaagcccagctaattttttgtatttttggtaaatacgaggtctcactttgttgcccaggctggtcttgaacccccggcccaagtgatcctcccaccttggcctcccaaagtgtgtctccccacctacactcccattctttcccttaaaaaaagtctgagtctgggtgcagtgactcacacctgtaatgccagagctttgggaggctgaggcaggaggataacttgaagccaggagtttgagaccagcccaggcaacacagccagactccgtctctacaaataacacttttaaaaaacttacccaggcatggtggcacgtgcctgtagttccaattatttgggagacagaggtgggagaatcacttgaacccaggagttggaagctgcagtgagctatgactacaccacgacactctctggcctgggtgacaaagcaaaatctcatctcttaaaaaaaaaaagggaaaaaaagcttgatatgtacaaaataatatgttaatgtaagttataagaacataatgggccagacacagcggctcctgcctgtaatcccagcactttgggaggccgaggcaggcggatcacgaggtcaggagatcgagaccatcctggctaatgcggtgaaaccccgtctctactaaaaatacaaaaaaaaaaaaaaaaaaaaaaaatgtgccgggcgtggtggcaggcacttgtaatcccagctacttgggaagctgaggcaggagaatggcatgaacccgagaggtggagcttgcagtgagccgagatcgcgccactgcaccccagcctgggtgacagagtgagactccgtctccaaaaaaaaaaaaaagaacataatgaacacctgtgaacatatcgcccaatttaagaagccgaacattaactaggacaattgacacttactctgtgctgctctcggatcccaccttctacctgctttcctcccaaaaatagtcaccatcatgatttttaaaagtcattttagttttctttgaataattatcatatttatactcctaaacaatgcactatatttacttttatttgtctttgcattttataaagttatctccatgctgtattatactgctgtttgttttcaacattatgctttttttttttttttttttttgagacggagtctccctctgttgcccaggctggagtgcagtggcatgatctcccgccgtcctcccacctcggcctcccaaaatgctgagattataggcatgagccaccgcgaccagcctgaatattcttgtatcatgtcctgatgtatgtgtacaagtgtttttctagggtggaactgttgggttggagggggcaccaaaagcttttaggaaaggagaaaggaacaaattggatatctatgattttttttttttttttttgagacagagtctcactctgttgcccaggctggggtacagtggcacaagctcagctcactgcaacctctgcctcccgggttcaagcgattctcctgcctcagcctcctgagtagctgggactacatgtgcccgccaccacacctggctaatttttgtatttttagtagagatggggtttctccatgttgcccaggctggtctcaaatgcctgacctcaggtgatctgcctaccttgacctcctaaaatgctgggattacaggtgtgagccatcgtgtctggctactattagtttttctatttagaaattgttcatctggatcctccctacctttcagccatttgcaatacatttgttgagcataaagagtgaccttcttggccgggcatggtggctcacgcctgtaatcccagcacttttggaggccaaggtgggtggatcacctgaggtcgggagttcgagaccagcctgaccaacatggaaaaaccctgtctctactaaaaatacaaaattagcctggcatggtggcacatgcctgtaatcccagctacttgggaggctgaggcaggagaatcacttgaacctgggaggcagaggttgcagtgagccgagatcactgccattgcactccagcctaggcatcaaaactccctctcaaaaaaaaagagcaactttcttgtccacagcaaagaatcactggaagccatttgatgcaatatgacctcatctctctagccagtgtcgattgggttacaggagggcaccaagaagctttttgaaggctgtgccaatgtacacttccagcaatatcttcttaagcttgagtgcagctccttattttcccaaagcacagctaagactaaggctgccaagtttttaaaaagatttaaaggaaactctgagcattatacaagaaaaatactggccgggccctgtggctcatgcctgtaatccctgtactttgggaggctgaggcaggtggctcacttgagatcaggagttcaagaccagctgggccaacatggtgaaaccccatctctactaaaaatacgaattagcaggtgtggtggcaggtgcctgtaatcccagctacttgagaggctgaggctggagaattgcttgaacccaggaggcagaggttgcagtgagccaagatcgcaacactgcactccagcctgggcaacagagcaagacttggtctcaaaaaaaaaaaaaaaaaaaaaaaaaggagaaaaagaaaaccttaaaactaaatgcataatttctgttgtaattctttgaccatgtccgttctttgtggagcctctattcagtcaaattgtcctgtgggccaactcatcttggcaggataaaagcctccttatccagtcttgccttccccagagaaaataaagggggtgggggagggataaagaaaattaagaccctccccctccaaaaagagaaacaacaaaaagcatgcaaggattaacatgctatctgcaaagtcaccaccctgcccacagtgtggcctttcacttcactgagtaatatattgtttgtaatacaacaatgtaatcagcttcttcattccagaacaaaattttgctttactatcatcatatacccagaagacccattaaactgttatttcaaaacagcagcctttccttagagataaattttacagctacccctagagtagttctgttggccaaagcctcttagcttgctagtgaaagaaacaaagtcaagccagcttaagcagaaaaggagaatttgttctgaggatacaaatatatagtaaggtaccaaaaaagaatttatcattggccaatttggataaggtgccctcctgtaaccctcctgtaatctaatcaacactgttagagagatgaggtgacagtataccaaatggcttttgatgaatctttgctgtgaactagaagggattaagttatgctcaactaatggtttgcaaatggctgaatggtagggcggatccacacgaaaaatttctaaataacaaaaccaatagcatgtatctcatttgtcctttttcctttccaaagagtcaacaattattgtatgagtcaattatctttataaaaactacattcattaacacaaatgcaagatctcaactatatatctttagttatatacatgtatacacatatatgtgtatgtatacatacattatcctcaaagacaactaatttagagcgttcctcatcccagtatctcagagaaatacaaagcagtttcttagatttggcatcattgagattttgggccaaccagatacttctctgttgggtggggaggaggctgttctgtgaactgtgggatgttcagcagcatccctggcctctacccagtagatgacagtagcactcctctcctccccacagtaacattcaaaaatatctccagatgttgccaaatgtccctggggtacaaaactcttccaattaagaaccactggtataaacaagtcagctgggagtggtggcacacacctgtggtcccagctatatgggagggtgaggcaggagaattgcttgagccaggagcttgagaccagcctagccagaatctctgcctagcctaggcagatctctacagaaaaatacaaaaatcagccatagtgttggtgtgcacctgtagtcccggctactcaggaggctgagacgtgaggatcaattgagcccaggaggtcgagactgcagtgagctatgatctccccactgcatcctgcaacagggacgctatctcaaatagttaattaattaatggaagaaagaaagaaatcctagctttgtaatttactctattactttgggcaattgccttatgtttccagaacttcaattttcttatgtacaaaatgggaataactttttgagctattttagagctatcgtaaggattagagcacataaccacaaaccacaaaatatgtcacggtgtacaggacagggcaggttctccgtaaatgacagtatttgcccatttattttcctgtaaatatgaaatatactaggatacttgatgtggttacactcaggtggaaactgacctatgagggagatagacagataggcacggtcttttttgtttgtttgtttgttttttgagacggagtctcgctctttcacccaggacggactgcagtggcacgatctcggctcactgcaaactctgcctccaagatgcaaatgattgtcgtgcctcagcctcccaagtagctggaattacaggtgtgcactaccatgcccagctgttttttgtagagatggggttagtagagatttgtttaatagagacggggtttcaccatggtctctactaaaccctgtctctactaaaaatacaaaaattacccaggcgtggtggcacatgcctgtagtcccaggtactcaagaggctgaggcaggggaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaattttttgtgtgtttttattgtctcgagacagagtcttgctctgttgctcaggctggactgcaatggcgtgatcttggctcaccgcaacctccacctcctgggttcaagcgattctcctgcctcagcctcccgagtagctgggattacaggtgcgtgccaccatgcctggctaattttgtatttttggtagagacagggtttcgccatgttggtcaggctgctcttgaacgcctgaccttgtgatccacctgcctcggcctctcaaagtgttgggattacaggcatgagccactgagcctggcctggtgagctaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggaggaaatccaattttacgagagggtgtagcctggtgaggcctggatgacctccggaggcaggggcttgtgcctgggctgaggcctaagggtcaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcaggacagggcatggtggggccaaaggaatcattacccaagacggggattttcagggaaacagcttagataaggccaggtgtacagtagctcccacctgtaatcccagcatttggtgaggctgaggtaggaggactgcttgagcctgggagttcgagaccagcctaggcaacatagtgagaccccatatccacaaaaaatttaaaaaaggagtttgtgttcctgtagtagcagacttgggaggttgaggtggcagtatcacttgagcccggaagttcaaggctaaagtgagctgattgagccattgcactccagcctgagcaacagagagatacgctgtctcaaaggaaatacaaattaaaaaaccagccgggcatgctggcgtgtgcctgtagtctcagctacttgggacgctgaagtgggaggatcgcttgagcccaggagttcaaggctgccgtgagctatgattgtgcctctgcagtccagcctgggcgacagagaaagaccctgtctcttaaaaaaaaaaaaaaaaaaatcttagataagaggatgctgtgcctccctgggggtcttcagtcacccatggtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctggcatagccagatgacttccgtgcccctgtggcaataaccactgcttccaagtctctatagaccaccccttgggtatatctaatgtaagtgatatttattttatttattttttgagtcagagtctcgctctgtcacccaggctagagtgtgctgatgtgatctcggctcactacaacctctgcctcctgggttcaagcgattctcatgcctcagcctcccaagtggctgggactacaggcatgcaccatcacgcccagctaatttttgtattttttcagtagaggtggggtttcaccaagttggccgggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaaacaaataataatattttacataaccaaccacttctaaagattaaaaaaacccctacgattaaaaacctcaggtccctcaggcaatcataccagatattgaaacaaagcaataacataaggactgcagtattcattttatttttatattatttatttattcttcgttagtttcttcagattatcatccactgagggtggaaggggagtgagcagacacacttgggaggtgtcttgagattatcatccgctgagggtggagctgagggtggaaggggagtgagcagacacactcgggaggtgtcttgagattatcatccgctgagggtggagctgagggtggaaggggagtgagcagacactcggaggtgtcttgagattatcatccgctgagggtggaaggggatagagcagacactccgcaggtgtcttgaggctcagggagttatcagttatagaatgttgttgagttggaggaggtggctggtggcccatcctgttttttaaagtttcagctgtgaggtagggccagcagggcaatcctgaagaatgacgatgctccgctgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtatcagtgtcatatcacccttccactgagtactgccgacagctggggggtaaagaaaagtcactgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaacagacagtaagagacagtaagagaggcatgaaaagcccattgtccacacatgttgcagcttctttttggagaatgttttccaggccctttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcgcgtgtaatcataggactcggcagcttttgaaggtacagaggccacacaagaaccagcttagctgagcatcatttaaggccctcatttggaattgtccctgtgggtaataagttacattcactcttcactaatttacagtcagggcccatttgttattacaaatacggaacctctgacacttagaatattagatgggggccccactgggtggggatgaaggtgtttttgcgcaacacggttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctgtaagagtacagtctgagccggtcacggtggctgatgcctgtaatcccagcactctgggagggcgaggtggatggatcacgaggtcaggagattgagaccatcctggctaatacagtgaaaccctgtctctactaaaaatacaaaaaattaggcgggcgtggtggcaggcacctgtaagcccagctactcgggaggctgaggcaggggaatcacttgaacctgggaggcggaggttgcagtgagccaagatcacgtcattgcactccagcctgggtgacacagcaagactccatctcagaaaaacaaaaacaaaaacaaaaaaactgtacagtctgatccaaactgttgctatattgattcctcctcttgcttactgcctgctgacttctgagatgatagtttccttccccattctcagtatatccctaattcatccttcattgagcatcttttatcataaagctgtattctctttgtattaatatctttactgtgtttcacagggcagaaacagctgggcttataaacaggaatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtgctttgttttctgttttgtgaactctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctccttttctccgtgctcacgttctttcatgcttagtttcctcagactagaagggagagaaatgcacacacatgatccaccagcccgtgtgggattccctctgcccttctggcatctgaaggctgattcaaagatcccccctgcaaccttcccacaaatgaaccaactgattctcacaagcaaagggagaatggacacctcccattgagggacaaaaaaaaaatcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgctggaactgagaccatcagccatagagagatccttccagaatatggtgtcattaaccccgcagttcactactgcactttgccatgattcaggactggaactcttgtcatcgactttaaagatcctgaaaaggcaatctgaatgctgggcgcatctattgaattagaaatgatcggaatggctcctaagtcagggtgtcatgtcctgaaaataggtgacaactgcaaaccatccaccctggtgttgactgactttaacaaggttcagttcacagagattgagggcagaaaaaggaaatggcctcaaaagggtaagtttgctgtgttgccctcacaccacttgattcatggtcctgatcctaaggatctcacctgatacttggttttataggaaggatgtataaaattcccagaacgctaggaaacagggacgaaaacacttcaaagagaaagttaatgaacttgtttctgaccacagggcatccttcagcacatgctgtctggagtggcctcaaacaaggagtgtgtggtgaggtgctgacaatgcaatgggagcagggtcctgtccccacgctaaagaagctcacagtttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgacccatactgaagtccactggctctggttgagacccagaagagtcatgcatcagaatagaggtggacaggaaataccgtggcctttgtagggactgagcctgcaccgacgacctcaattgcagcctgtatggaggacccctgaccatcccccagaagtagactcccatctcttctgcagcaagataacatgctactaggcctcaattcattgctaaatattttttaacaagtatctcacatttaacaaaaaaagatcagtcatatgggcagcaaaatacaatgtaatatgaccaaaacatgaaagactgtgaaaatgaatctggaggtgacccaagcattgaattcaacaatccaggctgggtgcggtggctcacaccgggaggctgaggtaggcagatcacctgaggtcaggagttcaagactagcctggccaacatggtgaacccgtctctactaaaaatacaaaaattgggctgggcacggtggctcacgcctgtaatcccagcacattgggaggccgaggtgtgcggatcatgatgtcaggagttctagaccagcttggccaatatggtgaaaccccgcctctactaaaaatacaaaaattatctgggcatggtggcatatgcctgtagtcccagctactcaagaggctgagggataagaatcgtttgaacctgggaggcggaggttgcagtgagccaagatcatgccactgcactctagcctgggtgacagagtgagactctgtctcaaaaaaaaaaaaaaaaaaaaaaaaaaaaaaaaaaaaaaaaaaaaaattggccgaatgtggcggcacacacctgtaatccaagctactcgggaagctgaggcagaattgcttcaaactgggaggcagaggttgcagtgagccaagattgcaccacagcactccagcctgggcgacagagcgagactctatctcaaaatttaaaaaaaaaaaaaaaaggctgggtgtggtggctcacgcctctaatcccagcactttgggaggctgaggcgggtggattacctgaggtcagaagttcgagaccagcctggacaacatggtgaaaccccatctctagtaaaaatacaaaaattagctgggcgtggtggtgggcacctgtaatcccagctacttgggaggctgaggcaggagaattgcttgaacccaaaagacagtgagctgagattgtgccattgcactacagcctgggcaacacgagcaaagccccatctcaggaaaaaaaaaaaaagagagagagagacaaaggaaaaccaatgccagtactagcaactcctcttcccctgaaaaaatgacaaacaagaatgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaaccttggtttccacctgtctccataaagtaaagatgtcttccaggacaattttaattcctggaaaggaagaaactcttttctttgtgtgcatacaaatggacttcagcccttggtgagagtgaggagaggagaaggtgagaaacctgagggcaagaagctgttctttccctttccagggcaaactcatttccacactatggggactccaacagaaccataccttcctgtctacggcggttggacctcctggctctctgctgtacatccgtggatccatcatgtccattttgagacgggaagatagtcttcaggaaagacacctaggaaataataatataagaatgacggctgggcacggtggctcatgcgtataatcccagtactttgggaggccgaggcagggtggatcacggggtcaggagttcaagaccagcctggccaagatggtgaaaccccatctctactaaaaatacaaaaattagccgggcatggcagtgggcgcctgtaatccgagctactcgggaggctgaggcagagaaccgtttgaagctgggaggcggaggttgcagtgagcggagatcacaccactgcactccagcctgagcgacagaatgagactctgtcacacacacacacacacacacacacacacacaaaacacacaagaatgacgaggctggcatgttggctcactcccgtaatcccagcactttgggaggccgaggcaggcggatcacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaaagttgtgttgagctgagattgtgccattgcactccaacctgggcaacaaaattcaaactctgtctcaaaaaaaaaaaaaaaaaaataggccaggtgtggtagctcacgcctgtaatcctagcactttgggaggccgaggcgggtgaatcacaaggtcaagagatggagaccatcctgggcaacatggtgaaaccccgtctctactaaaaatacaaaaattagctgagcatggtggcgcacgcctgtagtcccagctactccggaggctgaggcaggagaactgcttgaacccaagaggcagaggttgcagtgagccaagatcccaccactgcactccagcctggtgacagagtgagactccgtctcaaaaaaaaaaaaaaaaaaaaaaatgacatgaatatacttcacacaactgaactgtacacttcaacacggttagatggtaattatcatcttgtaagtattttaccacaggttaacatgtttcacaacttgaaaaggaaggaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaactttacgcaaaacattctcactaatgactgaattcccaccaaatttccatattatcacagtatgcttttaatcttctcagatattaagtatttgttctcatcatagctaaaatgcaaagcaaatcccatctcagatgtgggtcagatacctatgaatctcctgaggtagtcattgaaatgacttttttcttgagacggagtgtcagtcaaccatgctgaagtgcagtggcgctaccttggctcacggcaacctccacctcccagattcaagcgattcttgtgcctcggcctcccaagtagctgggattacaggtgcctgctaccatgcctggctaatttttgtctttttagtagagatgggatttcactatgttggcccatctggtcttgaactcctgacctcaagtgatccacctgcctcagcctcccaaagtgctgggattacaggcatgagccaccacacctggcctgaaataatatctttcaaattctttgtagaatttgttttttcctgatttctgcacataggataaaaaaaaaatcatgtactaggatttcgagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatggcacccatgatgtccctgcttaggaggtaatggtatagatgactagatgacaaggacaaagatgagaggtacaaagttgtccaagtccaacagctcaactgaactttcctaaatggaattgttaaaaagtggtaaatttaaaaacttcccctggctcacgtggtggctcacgcttgtaatcccagcactttgggaggctgaggcgggtggatcatttgaggtcgggttttgagactagcctggccaacatggtaaaaccccgactctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcgtcttgggggtgagaaaagaaaaaaaaaaaaaaaagcttcctccaatttataccaaaaattctctgttcaggactaagtggcatagagaatgttaaatgtgcctagatatcttcataactcatatattttctgttttccacatatcttgaaaggcagtgccaaatgacgtgtaattatctaggtggtaaaactgaaacatacttcctcttcccttgaatatcaaaaagcattgtggtattagtacttttatcttggatcattgttcagaaggaggttcagcccccacacaaccacatttttactgtcatgagtggcaagacaaaatgtagagctcaacttacccaaaggaaaaaaggctcaaaagacaaattatgccacaacttagcagccaaattcttaccaagtacagacttttgacatactgatctctctccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctcccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaatagtttagaaagactttcccatttaagtgacgaaacctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaagtgtttcatataatttattcttatttgtgattacaagtatacctctacagaaagttagtatactcacacaaaggtaagttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaaaaatttttttttttttttttttttgagacagagttctgctccactcagtcgcccaggctggagtgcagtggtgcaatctcggctcgctacaacctccagctcctgggctcaagccattctcctgcctcagcctcccgagcagctgagattacaggtctctgccaccatgcccgactaatttttgtatttttagtagagatgaggtttcaccatgttgcccagtctggccttgaactcctgacaggcgatctgcctgcctcagcctcccaaagtgctgggattacaggtgtgagccaccgtgcccagccattttttttctttttgtttgttgtttgtttttgagatggggtctcactctgtcacccaggctagagtgcagtggtgtgctcttggctcactgcaacctctgcctctcaggttcaagtgattctcctgcctcagcctcctgagtagctgggagtacaggtgcctgacagtgcactcagcaaatttttgtattttttgtggagatggggttttgccatgttagccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttctttttgttttgagacaaagtcttgctctgtcacccaggctagattgcagtggcatgatctcagctcactgcaacctccacctcccgggttcaagcgattctcctgcctcagctactgagtaactgggattacaggcgcctgccaccacgctcggctaatttttgtctttttagtagaaacggtttcaccatcttggccaggctggtctccaactcctgacctcatgatccacctgcctcggcctcccaaagtcctgggaatacacgtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcgaattttagtgcttaaaaattaacaaggtgggccgggcgtggtggctcacgcctgcaatcccagcactttgggaagccaaggtgggtggaccatgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccgagatcgcaccactgcacttcagcctgggtgacagagcgagactctgtctcaaaaaaaaaaaaaaaaaaaaaaattaccaaggtggagatcatgaaaatggcatgaatagtgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccatacaacaatggtaatgatttcagaaatatggtgttgagcagaacaaagcagacacaaaagagtacctatggcatggcatgcatctgtatacgtgaaattccagaataagcaagctaacctatgataagaaagagactggctgggaagagtgagagttcactttctggggtgacataatagtgtagatcttggctgggcacggtggttcacgcctgtaatcccaacactttgggaggccgaggcgggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattggcccattgcactccagcctcagcaacaagggagaaactgtctcaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcggatcacgaggtcaagagatggagactatcctggcgaacatggtgaaacccagtctctactaaaaatacaaaaattagccaggcgtggtggtctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcgtcttgggggtgagaaaagaaaaaaaaaaaaaaaagcttcctccaatttataccaaaaattctctgttcaggactaagtggcatagagaatgttaaatgtgcctagatatcttcataactcatatattttctgttttccacatatcttgaaaggcagtgccaaatgacgtgtaattatctaggtggtaaaactgaaacatacttcctcttcccttgaatatcaaaaagcattgtggtattagtacttttatcttggatcattgttcagaaggaggttcagcccccacacaaccacatttttactgtcatgagtggcaagacaaaatgtagagctcaacttacccaaaggaaaaaaggctcaaaagacaaattatgccacaacttagcagccaaattcttaccaagtacagacttttgacatactgatctctctccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctcccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaatagtttagaaagactttctcatttaagtgacgaaacctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaagtgtttcatataatttattcttatttgtgattacaagtatacctctacagaaagttagtatactcacccaaaggtaagttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaaattttttttgttttttttttttttgagacagagttctgctccactcagtcgcccaggctggagtgcagtggtgcaatctcggctcgctgcaacctccagctcctgggctcaagccattctcctgcctcagcctcccgagcagctgagattacaggtctctgccaccatgcccgactaatttttgtatttttagtagagatgaggtttcaccatgttgcccagtctggccttgaactcctgacaggcgatctgcctgcctcagcctcccaaagtgctgggattacaggtgtgagccaccgtgcccagccattttttttctttttgtttgttgtttgtttttgagatggggtctcactctgtcacccaggctagagtgcagtggtgtgctcttggctcactgcaacctctgcctctcaggttcaagtgattctcctgcctcagcctcctgagtagctgggagtataggtgcctgacagtgcactcagcaaatttttgtattttttgtggagatggggttttgccatgttagccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttctttttgttttgagacaaagtcttgctctgtcacccaggctagattgcagtggcatgatctcagctcactgcaacctccacctcccgggttcaagcgattctcctgcctcagctactgagtaactgggattacaggcgcctgccaccacgctcggctaatttttgtctttttagtagaaacggtttcaccatcttggccaggctggtctccaactcctgacctcatgatccacctgcctcggcctcccaaagtcctgggaatacacgtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcgaattttagtgcttaaaaattaacaaggtgggccgggcgtggtggctcacgcctgcaatcccagcactttgggaagccaaggtgggtggaccatgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccgagatcgcaccactgcacttcagcctgggtgacagagcgagactctgtctcaaaaaaaagaaaaaaaaaaaaaaattaccgaggtggagatcatgaaaatggcatgaatagtgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccatacaacaatggtaatgatttcagaaatatggtgttgagcagaacaaagcagacacaaaagagtacctatggcatggcatgcatctgtatacgtgaaattccagaataagcaagctaacctatgataagaaagagactggctgggaagagtgagagttcactttctggggtgacataatagtgtagatcttggctgggcacggtggttcacgcctgtaatcccaacactttgggaggccgaggcgggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattggcccattgcactccagcctcagcaacaagggagaaactgtctcaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcggatcacgaggtcaagagatggagactatcctggcgaacatggtgaaacccagtctctactaaaaatacaaaaattagccaggcgtggtggtctactaaaaatacaaaaattagccaggcgttgtaatctgagctactcaggaggctgaggcaggacaattgcttgaaccccggaagcggaggttgcagtgagccgagatcttgccactgcactccagcctgggcgacagagtgagactctgtctaaaaaacaaacaaacaaacaaaaaagtcatcaaaccagatgacacaaatcaaatgacatttcactttgttttggtccgttttgtttgttagagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcggccccctaaagtgctgggattacaggcctgagctgtgtaatttcatgccgcgtgacacagcccagtaaaaaggaagaaaccccgcgggtccagcgtctactcacacaggtggactgatggctgataaatcccagcaggagccgaaagagcagccacagcacccatctactcacacaggtggactgatggctgataaatcccagcaggagccaaaagagaagccaaaagagcagccaccgcacccgcatgtcctggtcctttcagggcgcccggaggtggccaggacagaggtggaggtggcttagggcaggggggagggaaggggacggggactgggcgggatctgagttggggagggggaggggaaggggaggggaaggggaggggaaggggggagtaagggaagggaaaggagaagggggctgttgggtacctggaggaggtggaggaggaggaggagaagaagaaaggggtctgggaaaggatccggttcaaattaagttctcaagcgctggtggaaggtttagctacaggtcacggagaagatcagggaagcaacaggacacgcggggcaagggagcgtgaggcttaggagcaattagagggagacaaaggttctgctttccaccaaaccttcttcggtctgggccctcccttagcaaccctggggctttagactctctctccaccaatccctgatgaccccggtggtgcctcacaatggacattccaagtagcgcccgcatcatcccaatgacccctcccccatctcagtcccccacgctcctcccaagaccaggtcctctctggaaccttcacaaacctgatttctggtccaccccaaccagctccctgtccctgcttctgggcgctccttccttcctgagctcccagggttcctcaaggtcacttttggtgacaaaacataaaaaacaaatgatggcaggatggcaggaagaacctcatacccaagcagagtgccaggttttacagcctccgctcagccattcatatcctaagcaacaaaacatcagcaggatgcggaaggtcccgatagtaaaccatctccatcacatccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcacccctaacccacctagacattttaacatccgaaaccgagtgatgatgtccttatctatatcatcttactgcccgtgtgtgtggactttaaattctgaacccaaatgagggggagaaaaccaagctgactttcatgactggcctctcagggacgtccaaggaatctatgcatttcaagaaacaaagttcatcagcttctctcctaaggtgtttgcccacaatacccagagggcttggccgcatcatgtgtgatgggtggggagctccaagcaggtgggcaggacccaggggcctggtgaccaggacagacccccactgtccatcacctttcctggccctgtcctcagctaaacttcccacaggccttctgcccaatcacacagagtgtgcccaaactctctcaggcctctggcagctgaaaaccactgctttaaatccctttaccatttactatgacataaggttattgtaaacaggaaatattctattgatgctacaaatagaaagccaatgcctttaccataaatagaaaaacaaccctaagaaacaagcaaaacaaaaacaaaacaggggctgggggtggtggctcacgcctgtaatcccagcactttgggaggccgaggtgggcggatcacaaggtcaggagttccagaccagcctggccaatatggtgaaaccctgtgtctaataaaatacaaaaattagccgggtgcggtggtgggcgcctgtagtcccacctacttgggaggctgaggcaggagaacagtttgaacccgggaggcagagtctgcagtgagccgagattgcaccactgcactccagcctaggcgacagagcgagactctgtctcaaaaacagcaacaactacaaacaaaaaacagggttaacaaaagtatggaattcaattctttttatatgctgcagccatgttccagccctagatttggctgggcatggtggctcacgcctgtaatcccagcactttgggaggctgaggcaggcggatcacgaggttaggagttcgagaccagcctcaccaacatgctgaaaccccgtctctaccaaaaatacaaaaattagccaggcatggtggcacacgcctgtaaccccagctactcaggaggctgaggcaggacaatcccttgaacccgggaggcggaggttgcagtgagccgagatcgtaccattgcactccagcctgggtgacagaatggaatgagactctgtctcaaaaaaaaaaaaaaaaaaaaaaaaaaaagaagccctagatttcggttgtgttggttgtaaaaggagagacccagtaagtgggggttgtgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccgtccagtcacgcacggacaccctgggcttccgagcaaacctgctcccacgtggtgtgaccacatggagccacagacacccagcaaggacacgcagcccgcacacccccggtactccagacacagtgacctgcaccagggctcgaggtttctctaggggaacccacctcttagaatcatccagaaacaagtcactcttcacctgtccagcaaaggcctgctgagaggtgcacagtgtctggagtccaagctgcgccaaggcggcaggacccccagcccagcccaggacccccagtagagccctcacctcagcgtggaggcctgagaacgtgaggaaggagctgtccagcacggacgagtccaggcagctgtcgatgtccagcacctgctgcccggcaggtgtggggctcgggctcccagccacctgcaggacgacagcagtggtcagcgggcggcagctcagacctgctcaggacctggatgagaagccacctcctcagcagacaggacagagcccggtgccatctgacagaatgtcctagaatgctggatatatgggacatctgcaccgtccgtgatggcagcccctcgcgacgtgtgccactgaacacttgacagcagactggtgcagctaaggaacagagttttcaatttcatttttttttttcttagatggagtctcgctctgtcacccaggctggagtgcactggcgcaatctcagctcactgcaacctccacctcccgcgttcaggcgattgtcctggctcagcctcctgagtagctgggattacaggtgcctgccacgatgcccagctgattttttgtatttttagtagagacggggtttcactgtgttggccaggctggtcttggaactcctgacctcaagtgatctgcccgcctccgcctcccaaagtgctgggattacaggtgtgagccaccacacccggccatcgttccattttaattaacttaaatacgagcagccacatgtggcctctggttcctgccacggactcgggagcaacccctcctggtcgcggcttatgcgccttctctgtgtgctgctggggttagtttgcatgtaacctcttgaggaccccacgtgtgcattcctaaggggtgcggcctcccgtttccgtatgaatgggaagagttcccacctgctgtattcttggaaagagtctgtgaaggattggtgttaattcttccttaactgcttagaaaaattctatcgtgaaggctctgagcctgagcttttctttgtgggattttttttttttttttttggagatggagtcttgctccgttgcccaggctggagtgcagtggcgcaatctcggctcactgcaagctccgcctcctgggttcatgccattctcctgcctcagcctctcgagtagctgggactacaggcgcccgccaccatgcccagctaagtttttgtatttgtagtagagacggggtttcattgtgttggccaggctggtctcgaactcctgacctcaactgatctgcccgcctcggcctcccaaagtgttgggattacaggcgtgagccaccgtgcctggtcctttttaatgttttatatagatgtggtcttgctatgttgcccaggctggtctcaaactcctggactcagatccgcccacctcggcctcctgaagtgttgggattataggcgtgagccaccacacccggcccggccactgggaggtttctaagggactaactcggcctcttcacttgctatagacgtactgagattttcttctggagtgcatttcggaagcgtgcacagccgcgtgcttgcttcttctgagttatctggcgtgctgctgtgcagttgtccgtggcgtctgcttagcgaagtgccctcgttctttcacgattctggcttctgagtcttctctctttctccctggtcagtctagctaaggctgctcaagtgtgttgacccttcccgagcagcctttggtggacgcctttccctctggctgcagcactggaaagtggcggctctgggcatggtgccgaggcccaggctccattcccagtactccccggtccccagccccagcccaccttgctccgggacatccagaagagaaagaggatggccaggtagacgggatagacaaccacgctggacaccaggccaacagcgactgtgtcgacgctcagcgggctcagcctggacacatgccccgtgctgtgtggaggagaggaggccacacaggtgaggctgaggggcaggaagggctgggcaggaagaggctgtcccgacccctacggcacccacctgtaggcagagtcaccaacagccccgtaccacacggcgttggcgcccaggaagaggcagatgaggagaacgcagcaggtggccctctggatgcgagtgaaacagctacgaggcggccggtcccatatggagagccagatgtgcttgtcaaagaagccgcactgcagctcagccaccagcaggcgccggaagcgcaacagggctgcgtgacctagaaggcagggagggccgcactgcaggaggccacggggcaggaccaccctgcccaacctcccacggagtgggaacatggaacgaggccttactcgcggccagcacctccttctccaccaggcccccgttggcctccgtctccaccgaaagccagtcattgaccaggaagaaggtgctgtgtgccgtctgcaggtccctgatgatgacgtgctgcaggaaccaggcagggctgagccctgcagaggcgcgggagggaggtcaggctcgcagggcgccccaacgcgggggcagaggggcagagcttggcagggtccgcacagacctttgtcgtgccacactcggatcttccacacgctacccaggctgtgcggggtggcgatccggaagatgtccaggctgttgcggtggaaggctctgtcgccatccaggtgccggtggccgctccggctgtccaccccatacagcatgatgcccacgtgggccgtggtacctggagggcaagagggaggggtgggaggctcggtctgctgcccaacacgtgtggcatcccaggcaagtcatctcagctttggcctccgcgcactcaaggagccacacaggcagtcccggctttgcacggctctgccatacacgaggagctgaggttactgcaatttgtccaataaacagcaggacctcaaggacatgattaagttacatggaaagaactgtaacttgtgacatgcaaacatggctgcacacgcctcagtccacaccacaaccagtgacccgcactgcacacctgtccacgcctcagtcacgccacaaccagtgacccgcaccacacacccgtccctcagttcatgcatagactgcaaagcgtgaagctgtgtcacctcctctcccagtgacagacccaggtgacagtattttttttttttttttgagatggagtcttgctgtgtcacccaggctggagtgcagtggcgcaatctcagctcactgcaagctccgcctcccgggttcacgccattctcctgcctcagtctcccgaggagctgggactacaggcgcctgccaacacgccggcctaatttttttgtattttttagtagagacagggtttcaccgttagccaggatggtctcgatctcctgaccccgtgatttgcctgcctcggcctcccaaagtgctcggattacaggtgtgagccaccgcgcccggccgacagtttttaaaagtaggtaatcaaaagaaagaactgggaaatgaagataaaagcagcacggaaataaaaaatgggaacacggccaggtgtggtggctcacacctgtcatcccagcactctggcaggccgaggcaggcggatcacctgaggtcaggagttcgcctggctgacacggtgaaaaattaactgggtgtggtggcgtgcacctgtactcccagctactcaggagaatcgcttaaggggaatcgcttaaacccaggagctggaagttgctgtgagccaagatcacgccactgcactccagcctgggcaacagagcgagactccgtctccaaaaaaagaaaaacgaaaacaaaaagggaatgccagaagggcaattccaatgaaaggaaaatagaggtattgaagaaacagccacggggagggtgctggcgcctccgtctgagagacgagctatgcagtcaggatcgcgggtggatgcacggtctcccacagtggtagcgatgctcatgtcacttgtggggccacgctactgtgcagaatgtgggctgcccaccctgactgactggcacctacttccagctaggagctgtcctagtcctcagggacagtgagtgctcacgaggtcattcccaggatgaacacacgagcccttcacacagcactgcaaaaactgccttgttctgacgtctgcgatgagactcactcccagagggtgcaaccagcacagccagtgagagcaggggaggccctgccaccccgccgcgcccctcacctgagccccggccccagcctgtcttgacgaggatctcgtacttgaagcggccccgctgcccacagaaggggatggcgcggccccggctggcatccaactggtccagcttgtgcaggatggcggccatgaccatgtaggtcaccaggcacacagcacatgtcagcatgacgatgtagtttacatccgctgtcggctcctgtgaggacacagccgccgggcccaggaggtcacgtgcaagctgtgccttctcaggatagagccgagcccacccaggccctcctcgactctgcagaggctcccaggagcacagggtcactcacaggaaacacaaagcgtacatggcttgggggcacgaagaggctggcgccgaaggcggtgaggtggcgggtgaggcagacggcctggcggggcgaggtctcctccaggggcagcagcccctctgtccgccacaccacgtcctcctcgctgaagtactggcacagggacgtgtacaggcccacggacacctccagcgccgacaggcggaagtggctggagaggttcagacggtaactccccactgggtctctggtcctgggcagggaaggggcagtggacgtgagcccaggctccgccaggttggatatcggagtcccagagcccatacccggtccagtcccctcgctgcctgccgtccccacagggcctgtaacccgggcaatgctgacccatgatgccctgccctgccctgccaggccggcccgcagagctcaccccggggaaatgaagaaggtgtagggccggtggtcggcaccctggagggactctgggcggatcctcctgctagccgagcagttgtgctcattgggccggggctccgagtgcaggtagactgccaggtagggctcgggttcctcagacaggtagcggcctggggcagaacgcgcaggtcacacgcctgctgggaagctcaaccacccgggggacacccacgatggccctcctgagcccaccctctgccacgggcctgaaaggccataggagcctctgcaccagagctggcacctgcttctccgtggcccccagctcctctccggccaggcccccagcagcccatgaaacagaaagcaaatttcaccagagacacccatggaagccctacgagaaacgccttccccccaagaacaaggccagggggccgcgtgtgcctcacccgctgcacgcaccgtccagcagcgtatagttgagctgcagatgcagcacggccgcagggttgctgctgtccagggtgaccacagcaccgacggaggcctggggctggaccacaacggagttggcagagctgcggtggccccgggcagcccagtccgagttgttgggcaccttcacggtgatggcgcgctctgaggccagccgctcgatggggatctgggcgccggcctgtgtctggaacgccatcgaggccaccttggtggagacggtgtagttgctgatatagccaaagggaaagggattggagtccaccagaaagatgagctgcaccacgtcactgaggttagccggggccctgctgaaagcctaggggatggagaagtggcagccaggccctggggcgccgccatagcacagcaggctccgcgggtccgagcgcttgccctgggccacgatctcctcgcccgccagtgtcaggggctcctcgttgagcacgcgggagcgcgtgaggatgcgcatgagggcagaggtcaggttgtaggcctgggacgccaccatccgcgatggtgactcggctcccagctctgagcgctgtggtgcccgcacgtctgagctggccaggtggatgaggtctcctgcagacagacgtgaggtcagtgcagagacagggaggcagagggagggtgggggcaggcaaaaagggggagccggagggtgggggctgggagaaagggggaacctgagggggcagagagcgaggtgcaggcagaagaaagggggaagctggagagagagtggtggaggggggagggggaaggggatggggatgaggacgaagatgagggggatgatggggagagggaggaaaaaggaaggaaaagggtagagaaaagagaaaggggagaagaggaggagcagggggataagggaggggaagggggataaggggataagggaggggaaggaggataagggggataagaaagatgaggggaatggacaaaaggacggggaggatcgggggggaaatggagaaaaggggagagagatggagaaaagggatggtaatagggaagggggagggggaggagaatgggaattgggggagggggataaggatgggaagggggaggggaggaagggggaggggaggggctaggggagggaggggctgggggaggagtggaggggctcagcgggaggaagtgaggggaaggtctaggggaggggaggaggagaagggctagcggaggggaggggagggggcaggggctaggggaggggggaggggcaaggggagggagggggaggggaggggttaggggagggaaggggcaggggaggggctaggggagggaagggggaggggaggggagagtggaaggcacagaacagcatcttcttagtccctccccacatctgggcccctctttacaccctgggtcccccgagaggcaccctgcgttcacacaggacagcagaaaggctgaggctactgaagcaggtcagagaccgaggaacgccatggcatgaaggagcccaggctggaggctcagctcctcggccaagctgcccgtctgccctggggggctgaacccagtaccctggcaggcatgcggggcggggtgagcatgtggggccatcctaccatgcactgggccagcgcagcagcgatctgctggatgtcatccacagtgtggaccctcagggacaccagagtctccgtgatgttcttgcgtatctgggctcggcgctgccgctcgtgcttgggctctgccgccacgtccagggcccgctcgtactggggcaggcaggcggcacagcaagctgtcagcagggcaggagaccggcaggaggccagcagatgcccacgactcccggggtgcagttacgtgctagatgctgtgtgatgtgggcattgacccgcaacactgagctgtttcttcatgggcaaaacagggtaagcacatgggccctcctgggcgggggctgcattgtggaaagcagacgccggagagggcccggtgggtgtggctgctgggagcggaacgtcggggtgctgcttcagggtcactgggatttatctctggggcccgggataagccctccgcaaagctccaggcaggggtacaggtcttggtccccagcacgcatgcagcagatgtgaggtcccctgccaggctgcactcacctcgttcaggacggtgaccagggccagcgagtactcgatgacgtgctggggatcggcctgccgcagcagccccgggagcacactagcggtgagcccgtgcagccagactgtgagccccattgcgctgccgttgggctctgggagggtgatggccagagacctacgagcagaggggggtggtgagcaggtggcagtctcgggggcgccctcccacggcctggctcacctgttgagggcgaccacagcggctcccagctggtcctgcaccaccacggccaggcccacctcgaagtgtggcctgaaacccgggggcagcacggctccgtagccggagaggctgcccttgtagacacagaactcctcgcagtggccctggcgacagcgctgcagcagcagggcgtacaccagcggggcgccagcatcctccgcgtcatgccagcctgagggacggtccccatggcatcacgggagggctccgtgacgtcacagtcgggggatcccgctgctccccctaagcaggcctgtactcacccgtgcattcgaagtgcaccttggtggtgagggcgtgcacagcgcccagtgggaagaggcggcaagagccccccagcggcgggcggttgggggacagggggatggaggcgcagccctcctcctcgccagagcggcccagcaccgtcagcgtgaaggtgtatccctcgccgtcccgcagcacgccccgccgcagcaccagtcacatgcctgcgctgcccgtggatgtggtggtctcatccagcaccagtgtcttgttgctgaacgtacgtgcagcccaccgctgcaggcagaaggggtggtgagggggcgcaaccctctgccctgtcagccccacttctgcctgcaggccccgtcccctcggccatgggacccatccccagcccgcccacaccccgctcaacactcacccctcgcttggagccgctgctgcaattgaggcagcggccctccaggtacacgtaggagctgcggctcacttcgtacacggcctgtgccttgcaggacacacactccaaggacacaatgggcacccggccactgcggatcagcacctggcgtgggagtggggttacctccaacacaggtctatttggcctgctggaaggtctgggggacccgtggaggatgctgctcccaaactccaggtttcccaggggcctggccactgccggtgagctcaccccctcccaggatactcatccggtttgccaccttccaacctgggcggcggaagggcatacacagggcagaggacactggggtgtgcgttctggtgtactggagccagctggaccctgacaggaggcaggcaatgctcactgagggcccctggggggatgcgtgtgggaacagacgtatgtgggggtgtgaggaccgcagttgccacgtaggcctgactcacagactcctgcagcccttagccagggcctgggtcaggaggctgagccgggatggaacctgctcccacaccctcccctcagacgacccctctgggcagacccccaatcaggcccgttgaggaaagcagggactggggaacagacacccactctggggcaccagcaggccccgcctgacagcagcaggagcagccaccacgggctcagggtcaccaagcctcctggccggtccagagtggggagcgtgagggtgagaaccggcccaccacatccagcaacagggacatgggctggggacagtggctgcctctggggtgggaaggggctcttcctcactgttggtattgctgggggactgtgtagcttttgtcactagagcatatgtggcttgaagactgtatgtggaactgtggcaggtttggaaggaagcaaagctgaagcaggctgtcgtgttacgtagaatttgcatcagaaacagagagggaagagcgcgcggcctccaccagcactaaaacacggaaaacagtagatgagcagggaggttgggctgtccaaggcaagtggccgaggggcgggcggcacccaccgtctggttggtggcctcctccttgcggccggccttccacacggtgaggctgaaggtgtactccacgccagccgccagccgttcccgtggaatggtgaccgtgctgctcccgcggggcccaaagttcagcgcacacccgccagcctccctctgcaggccgagaacaaggggcgacgtggcccgagaaccccatccagttttaaagcagagcccggcccaggagacagcgcgggagaccccctccccatgctgggacggggcccaccaggcactgaggacgggccagccctggtggcaagctgggtgttctctgggctcatgggtgtggacgggtgaggggcatggaggacggccctgccacgcactgacctgtgtcgaagccacacaggcccactggaaactgagcggcgtctggtcgccatcctccaggttggggtcgtaggactcgctcccatccagcaccaggtcctgtgtgtctgaccacacgcggtatgagccaccctcagtgatgggcaccaggcgctcaggggccaccgtcacattggcctggatgctccgtgccagtggcgtgtccccaaatgacacgacaaacacaaagcagtagtgccccacaggcagcgccagccgcggcagcaccagctgaggccggctcacgtccacgccgggcagggccacacgcgccgggcaccccggctggtgggcccgagccagatgcagtgctcggctgtggctgggtgtggctccccgggcagccagttctggcagctctccaggctgaaggcctcgccctgcggcgctgggcccacctccacccgctgcacagtcgagaagccgatccacacgtctaggctcctgggggcgggtgtgggatgccagggggctcagggcactcctccatcctcccaccctcacagcagcccgctgggagccccatcactgtccccctttccagatggggaaactgaggctcagagcctggagagcagggcccaccaccccaggctcacagcagcacccacccacggggcctgtgggcaccggcagggatccccgcgcaggccacctcccgtatggcgtgcccaggagtgtccggaggctgcccccagctcgcgtccacctctgcatctgcagagctgacaggaacggccccaccggccggcgccacctgctcaccagggccggcccagctcccacctccctcctcctgagactccccagccgcaggctctgccccactgcttcagagatctcccaacctatggcccctcggggggtgggggcaggcacctggtgacccgggagaccaggaagcgctgcacggcgggactgtccaccattgccagggcggccccggcccaggcccgacactgctcctgcgcctgcagccaggccgccttctccaccaccaggcggtagcagtgcccgttgccagagaagatctccgtgtccgaggggcagagcgggtgcaccgctggagaccggtgggaatgagggtgtcaacggtcagtgtgggcccaagacgggggtaccaggctctgccccatctggatggccctggggaggaaggggagtgggcagcagacactcacctcgggccggctcctcgcccagggccacgatgctgtaggcagcctccaggcctgaaccaccgcggttctggatgctgaggtcgaggctctcgtcactctgcaccgaggacgggcacacgagctccagggcggcaggtgccgcttccacctgcacgtctgtccccagcagggctgagccggcccccagggccagcacggccgtcacgtgatagcgcccaggcagcacatagcgatgcgaggcagccggcccagcggcatccacctcgggggagccgtctccgaagtcccagcgtgtggcagtgacagggagcggggcagcgatgtggaaggctgctagctggccggaggccaggggtccgtggggccccaccaggggggcccctggggaggcagggaagacgtgctggaggagggtggggcccctacaggtgggggcaggaggcggcggggggccggagcagagggacaggcaggcgaaggaggcactagagggctgggccgccccacacaggcaccagccctgctccgagagggctgcgaggccctggccggtggagaagcagaaggcgctgcaggcctctggctgaagcaggccttcgtgggcagctgaaaaggacactgctgccacggtgcctgagctgttgtcagggaggcaggcgacatactcctcacctagaagaggcagccactggaccccgggttctgctcctcctggctccaccccacacacccccatccgcccgccgcactcacaggctcccatgctgttcccttggcccggagcccccccccagagaggccttcctgagccctgcccagtgtctgcagggcccaggtcccacctggctgggaaggacagagctggccccacccaccggcactcaccacagccactgtccagcaaggggatgccaagcagaggctggccagccagggagtcaggcccagcacacgtggctgcctcgggctgcaccacccgcacctgctgctcctccgcccatcgcggcagccacgccaggccacagtcacactcaaacgggttcccactcaggtttctgcggggcaggggcaggtgttggggaccaggtctggtgggaagggtctatgccagccccccactggcaaccaggccctggagccaccctgacagcaccgcctcccctgccccaaccaagccggcactggggggctccaagcaggtagtgaactgcccccaggatctggtctcaagcctggaaggggacacagaccaactgggagggcagaagggatactgggggcctggggtccagccaggaccccacccaaagaaccacaacttacatttcacttaaattaaataaattagcaaatattccttcttctaacgtagaaatcttgttgttgcttatatccctggaagagaggggggattcggcaaagctgacggaagcccccacagctgagcagcaagaggcggtgccgccagcccacccggagtgagccccgcatgctggcacgactgggggacactcacagctctgccagcgccgagaggttcgccaggagcccaacgtccagcgcccggagcaggttgtgggagacgtctctgaggagtgagtggccgtgggtcagggccagagcccttagtaggccagaggccatccctgggcccatcccacacattgccagcatccccaagctatggcctcccacccttgagctccccactcccagaggtcaggaggggcctttctgatggaagacccaaatgaacactcatctggggaaaccaagccgggagaggcctgggggcctcagccctctgcacccatctcagccctatgccgagtgccacctggacctgtccacccagggccaggaagggcacggacccccaacccatcccacgcagggccaaggccccccatcccctgtccacagtcccccacagagccaaggtctcccaaccctgtccacagcccccacacagactcgaggggcccccatctcctgttctgaacccaacagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgcaaaatataaataaaattagaaaacaaactacaatctcagaaaagcactagcaacttagacgacatactaaaggccaaaaataccctcctgacacacagctaataaagaaaaagtcaactattccagttaaaaagaagaaaaggaaactggctgtggtggcttatgcctgtaatcccagtgctttgggaaggccaggagtttgagaccaggatggacagcatagcaagaccccatctctacaaggaaaaaaagaatcagccaggcatggtggtgtggagctgtagttccaactactcggggggctgaggaagaaggatcgcttgagccagggaggtcgaggctgcagtgagctatgactgtgccactgcagtccagcctgggcgacagagcaagacccggtctcgaaagaaaagaaagagaaagcaagaaaagaaagatggctgggcacggtggctcactcctgtaatcccagaactttgggaggccaaggtgggtggattatgagatcaagagatcgagaccatcctggccaacagggtgaaaccccatctctactaaaaatgcaaaaattaggtgggcgtggtggcgggagcctgttagtgccagccactctggaggctgaggcaggagaatcacgtgaacccgggaggcgaaggttgcagtgagccaagatcacgccactgcaatccagcctggtgacatagcgagactccatctcaaaaaaaaaaaaaaaaaaaaaaagaaaagaaagggaggagagagagaagaaaaggagaaggggaaagagccgggtgcaatggctcctgcctgtaatcccagcactttgggaggctgaggcgggcggatcacctgaggtcaggagttcaagaccagactgaccaacacggagacaccctgtctctaccaaaactacagaattagttgggcgtggtggcaagcacctgtaattccagctactcaggaggcttaggcaggagaatcacttgaacccgggaggcagaggttgcagtgagctgagatcgcgcccctgcactccagcaccccatcctgcaagagtgaagctccatctcaaaaaaaaaaaaaaaaaaaagaaaaaggacggagggcgagagggagggaggaaagaaagagaaaactccaaaaacaaaaaaagaaaaaccaggcaattaaaagaagcacaattggtcacagccatgggaaagacatcccatgtcagcagtcagtgaagaaaaggcaacagaaaccaaagggcggcagcatgtctctcttttcagagctgcccgagttacaaaccaggtcctggagctggtgatgtggaggtgagaagccagagagctggggcaaaccgagaactccacctcccctcggcctcaagcacctcgggggtcaccctgccgcccaccctgggcacccctcctggtcccacgcactcccagtagtgctcctggcacagggactgtggctccgcaggtctgcacaccacccccctgctccccaggaccccgagacctcacctcctgccacgggcctctacttccccaggtgtcaccctccccacgagtgacccagcaggtgcctctgcctagacttgctcttcccagcaatgaccacccggcagccaggcccaagccggggtggcctccatccctgagcacccgcccagcccctaccggcctccatccctgagcacccgcccagcccctgccagtccctgccaccctccatccctgagcacccgcccagcccctgccggcctccagccctgagcacccgcccagccctgccagcctccagccagccctgctcctcccaccggagctccgctcccgcagcagcctacccggcgcaggagagacgcacacacaggctgcctggtggggcccggggccagggcaagggcttgaaaagggaaccaacaaagaaggggaccagaggccaccccagctgaggggacagagcagccgaggccttctccgtgccaggaagcagccccagccacggacggtggagccgagccctcacctgggctgggcgcccagacagatgagacgctgggcactggctcccggagcttctcgttccatctgcggatggagggcacggttgggggtgcagttcccttcccccaggggctgtgggacactcagagagcctatgcctgtgccctgggctccgggaggggagaggatctgggggccaggcacacagggaacggcccctccggcagggccaccgcttcccccctaactgaaccctgcttctctgccgtcccctcctctacaccaaggtagggacacaggctgaggtgctccccactgcccataaggatgggtgggcccacagccacgctgctaggcatccacaccatccccgccgtggggtgggacagggtggcggctgggagaccagcaagaggccattcacgagacagggtgaggcagctggactcacacccgctgcccaagcaccatgcccgagggggaacactgtgctgtaaggaactgcagttagacctgaggagggacttttcagcggctgcggcggcagcagaaccaatgctttagggagaatgaggcaccaggacctgaggcgcagcagccctaaggggcgagaggtgctgcagaggccacggtgaacacaggcaggccccctggaagggacacagctgtgaaactgccccggggaggggcacaggcatggggagcagctcccacccaggccacgggagaaaggaaagaaggaaaagcctgaagatgtttggccacacctcattttctggaaaatccatcaagagtggctgctgctgggagctgacaagccagggcaggggtgggggcaggtcagccgaggaccccagagcccccccgctccccacccatcccactgtgaaccaggcctgggggtgccatggacacttcttccatgccagcaggcagccccgcctgtcaccggttctggccatgcactccctgcgtgccaggctccaggctggctccttctcccggccctcaccccagcccaaggcccacaaatgcagcaaggtcttggggaccccgctcggccgagctcccagggcccagggcagtggaatgaagctggggcccagacaggagccaggtgcagtcccccagcccccagggtgtggaagcgtctgccctgggtaggactcaggtgccccctgggtgtggaagcatctgccctgggcaggactcaggtgtgggcttcagggacagggaccagtacagggatccccgtggagtcctcaccccgcttgctcccgtacttttccacgtctgcatctgcttttgccatcgccgttctgggggaacgccaaggcctagccaggcagcctcgcgccagcccccccaccccgcccctcgggcttcctctgcacccgccaggtgacatcatcgccgctgtctgatgccctgcccccacgttctggttccctgcaaggatgggggacacagcagggcccaggcatctggcagcaggaccaccgagcggccctaagcccaggcaagagcacagagcagagtgcagggtcctctggggtcccaagcccttgctgccccacgcactcctcaccccagttcctgctataagctggaagggtgggagccaggtgcacagggacagcctgatgggtgcccgagggccaggatgtgctcccagggaagctgaagccaagcttgttgggagaagtacacccccatggggggcaggacggtgccccagccccgggacacaaggggcccccagcgccgagcgtccgatctggaaggcaggaggagttaggaccatcctagcgtgggacccagcgggctccttagcggctgctggggcaccactgggtggagaaggaagtcccaggtgtgtggccacagtacgggtcttcaccccttcccagcacccttgccaatcctggagcaggagcagcaacagcagagggtgtggccaggcctggaggctgcccctccacacccctgtcacaggtggggccacgtcccagggctgtgggcagcagggccagcctgccggcccgaggtatctgacacgtgtctcatgctgcagcgggtctgcccgccacccgggcgtgtgaaccccaggtcgggccccctcgccctggagcctcggcccctcaggggtgttcccagccaggcgctggctctcctgccctccccctgggctctgcccacagttggcgcgagggtgggtgaagcctgaggctggcagggcccgggaagtcttgtggctgggccttctgccccacaggcgctcctgggccgggggagccggggtcggggcgtgcaacagtgggactgagaacttccctgggtgtggggcagctcccggggccctcccaatccacaacagagggaatggccccagacaaaccagacctgcctcagagcctcacactcagagctgagtgccccaggcgcccatttcccagaccagatgctgagtggggtctgggggccggacggagcccccaaagaaacatctgcacattccagacgcgtgtggtcagcggcgggcgtgtgccaggcccggcacccctgcccgcgctggccgcctcactggaaactgggctggggggaccggctcggaggggccacctgcggagcttatgtaaccgctcctccctcggcaggggcaggacaggacgccagacccagggaggccccatgccccctgccaggccccgtcctctcctggaggagccggttcccctccgcccagcaagaggacccccaggcccgtccctcccgagagcaggcccagggtgaggaaatggggtgcagtgtgggcgctggagaggacaggggacaggcagcagtgccacccccactgtggccccttcctcgctgggccagccgagccatgacctcttctgtttccctctgcgctgtgctcctttctatttaaggagagtgaggcggcttccagggccggaaatgatcctgtttaaattaacaggctgcagtttgggacggtgctcatttgaaaaaaaacagtgcagccccgggctgggcagacggctgctggctccgcctaccacttccatggggagggccagggaggccggccacaaccctggccccacgaggggtgggggttgcagcctctgatagaggacgaggctgccaggccccaggcaacagagccctgcacgaggttctctgggtcccggacacggggtgtgagactagccggggagccccaggctcagcggcattctgtccttacagatccctcccatggctcaactgttcccaggatgagacgccgggggtgacatgggcagcctcaggtcctcccgggacccacaggcaggcacagggatggagactccggcctcggaggctgaacgagggagatgagaaaggggagtctgcgatgtccttgcctacacggatggaaaaacacagccagctcaaaaagggccgtttggagacaagcccacctgtgggtgtaggaaggagagcgcttcatacgtatgccacctgccgctggggtcggggccacccttccagttcaaggggagaatgagggccggctcctggtgcccctgcacacagctgacatggagccaggcgttgtgacccccttgcatccctctccactcccacccttcacagcctgggtgggcaggtgctgcactgaccttatgctcctgatgggcacagaggctcaagaggccctcctcctcccccaacaccatcccccaaacacctccccgggcagccagcagggtccagagtgtcaatggaggaagccaaggtaggaagagggtggtggggggggccaagcaaactggccatctgcgcccggctgtgcgggcacagcagtgccctggagagggcagcagcacagatccagcggggcagccggaatcccatcacccactcggctgtgggcacagccaatgatggcacgagccatcctgaggccagggccacgatgcacagtggacgggctcacaacccggagcccctgtactcccacagctgtgacgttccctgggcatgggcttgccccagcgctggcctcattcctgcctcaaccagaaggaagagctggcttccgcctctgcctgggcacaaagccctttccgaggtggcctgacagaagccagcctgtcttcagatcatggcgctgctaaggtcaggaacgccaggctgggccagggctgggccttgggagctgcagggagaaaaggacccagcccgcctcagccccagatgtagcccttctcctgccaccagtgcctgggcaccccggcccctaggcgaggacagctgccaagccatgaagagcgaggtgttctgggaaagggcgtgagctgcattttccagctgcgctcactctgcagggagactgtgacgcccccgccgctgtgcccgcagacgtgcccggcctcagccagctggagcgcaggcagcagagtgcaggccaggcccagacggcagcgggctgttttcattccagggtgcttggcgggctgggctgccgtggccactgcagagctccagaaaagaacacgtgtgtctccctccaaagtatgttcctcgctggaaagcagatcccaggcagggtctcccccacgagcagggggagaggcaccccaaggtgggggagcgagggcagtggcagaaccaccccataccctaggggacccagggaggggcttgcagatgcgggacccacatttggcagcggtgcccggccactgtcacgagatggtggccagcgcatcacccacacgtgggccaggatggcagaggagatccacagagatggctccagcaggaggccctcacagagatgccctggcctcagaagagccaacagaaagccgggaagggggacgtcgaggctcaagcttggcacaacctccccaaagctcccaaaggctcttggtgcccaccagcgacagcgcacaccgccaccacctaacagcaaggatgcagcagggtccgcacgtcagggcgggcactgagcggaactcaggcagtgccactcgccagcttacgtcaaaagaacaaaaggagtgaggacgatactcgcggctctgccaatacttcccagccccgcacgtctcacacacaccagaacgcgtcaaaaggcaccaatgggcaaacacccagaggtaggcacaagcaggagtaggccgggtcttgtgagcccctacagccacgcggccctgcgctgaaggcaccgaggctgggtgctgaggggtccataagagtccacccgcccaggctgcactggctcccgtcgtccagtgtccggtctaagcacaggcacagtgtctggctctcaccctcaggctgttacactctgctctgtggcagggcaggtctcacagtgcatggaggacaggggaatgggcccccggaacccctgagggaaccgacagagctactttaacaaggtatgattgttggggctgccagtggctgagccaggtcactgctacactgccctgcagggtgcatctaatcatggagcccactttacaggtgaggaaactgaggctgagagactggaccaaggtcacaccagaagtggaggcgctgggacgtgaacccaagtctgactccagggcgcaaattccctacatctgggttcccagcctccttcctgaaactgaacaggaaactacagggaagggacacagcagggatgagccagggagggagaggtgggaggggctggcagggagggagaggtgggaggggctggcagggagggagaggtgggaggggctggcagggagggagaggtgggaggggctggcagcacccaagcagctgcacctgggtgcagggcccctcagcccctcggggagtgcaagcacatcccagcccgactcggaagcgccactgccacctctgtctgtctataaaccagggcactagtgtgggccccaggcaccctgtgcggctgcaggggtctgccccagagcatgctgatgaaatcatcaccacggcttctcagagcctcaatttcctggtctgtaaaatgagaccaggagtggctgcaaccctgcagtgccgtgatgagctatggagagacaagaacacagagggctcagcgcagggcccggcgtggccaccgcggggagagggtgcggactcttcctagaccttttctttttgagacagagtttcactctgtctcccaggctggagtgcaatggtgcaatcttgcctcactgcaacctctgcctcccaggttcaagcgattctcctgcctcagcccccaaagtagctgagactacaggcatgcgccaccatgctcagcatttttttgtttttttgagacagagtctcgctctgttgaccaggctagagtgcagtggtgtgatattggctcactgcaacctccgcctcccgggttcaagtgattctcctgcctcagcctcctaattagctgggattacaggcgcccaccaccacacctcgctaatttttgtatttttagtagaacgggtttcaccatgttggtcaggctggtcacaaattcctgaccttgtgatccccccaccttggcctcccaaagtgctgagattacaggcgtgaaccaccgcgcccaccctgtttttttgttttgttttttttttaaagaccgtttcctagtcacccaggctggagtgcagtggcaccatcacagctaactgcagtctcaacctcatagactcagggaatcctcccccctcagcctcccaactagctgggactacaggcgccaccactaatatctatttattggtctcgctatgttgcccaggctggcctcaaactcctggcctcaagccatctgctctcctaaagtgctgggattacaggcgtgaggcaccgcgcccggctggacagtggttttgatttccgtttccctcatgactaatgaggccgaccatcttctcacacgctgttggccatctgtgcatcttctttggagaaatctctgttcagatcctgtgatttttttttttttttttttttttttttttttgagacagggtcttgctctgtgacccagcctggagtgcagtggtgtgatcacagctcactgcagccttgacctcctcggctcaagtgatgtcccacctcagtctcttgaatagctgggaccacagatgcacaccaccacgcccggccaatgttcttttattttttagagaccggggtctcaccctgttgcccaggctggtgtcaaactcctgggctcaagcgatccacccaccctggcctcccaaactgctgggattccaggcgtgagtgaccccttgtccatgtttaaacggggtccctgtctgttgttgaatcatagtgttccctgtatgatctggatgcaagccgatactgcatggatgacctgcaggtgctctctgtctccacagtcgcctctgcagtgggcgctcgggtgccccacattcccaactgctacagacacaaccaaagcctccccatcccttcccccacccctgccggcaatcgcgtacaggagtgagcgtgtgacttcttgtccacatttttgtccacaagtttggcgagtttgcatccgtgtctaataaagaaactaccgtttctcacgcaggcacgttctgaacgcccgagtgcgggagccacgtaagacccggctcagggaccccgggtgaggccagctgcacatgcaggatgcaggtcctcaccactgcctccgctcggctgccagggctcttcctagaagacacgggcctctcctaggctctcctgactgaggccctacccctgcccccgagtcaccttgccccttggggactctctctgggcagctccctgtgggagctttgaaacctggcttcaatgtcacctgcactgggggtccttccaggccagccccctccccatcatccatctctgtccttggagaatcatctgcgtgtttgttgaacgcgggctccagtgataacggagccctcgagggtggccctccttctgctgagggctcatggaggccttggtgacaatccctagtccttgctctcaggatccagggaccagaaatgggagccaggggcccctccgtggcctggccagccccccaaggaagctgtgtctgtggcagttgcgctctaaggcatcaggcctaggggtcgctccagaatgactgtcttccccgacgccaatcccaggcaggggccccggggtctgcgcctgctgtccctacactctcccacactctcctgtcattcagggatgcaggtgggaaagggcaaggccctgggtgctcctatattttacatcagtgaaccaagcacctaccaagtccctcgatgtgcccagtcctggaccccagcatttgcgagacagcagcagacccaggtgacccccagccagggtgagtggcaaccagcaccagaagtggcctttagagcagggggccctgagctgatgacatctacacctaggtcactgccagccaggacaacctctgggacaatgggatgtcggctccaacgaccaatttacaagaaacacaaaggacacactcacagcaccacggaggagacaccatggaggtggcacccccaagacacagcgagaaatccaggctgcaggagccagtttcttcaacaaattgcacaaggaaaaagagaggaagggaagctcctagacatcatcggacatttaaaagacaggcggtggctcaagcctgtaatcccagcactttgggaggctgaggcgggtggatcacgaggtcaggagatccagaccatcctggctaacacggtgaaaccccgtctctactaaaaatacaaaaaattagctgggcatggtggcgggcaccagtccaggctactcaggaggctgaggcaggagaatggcgtgaacccaggcggcggagcttgcagtgagccgagatggcactgctgcactccagcctgggcaacagagtgagactccatctcaaataacaataaataaataaataaataaataaataaataaataaataaaagacatcactcacacctgtaatcccagcacttcgggaggccgaggcaagcagatcacctaaggccaagagttcaagaccagcctgaccaacatggtgaaaccccatctctactaaaaatatttttaaaaattagccgggcgtggtggcgcgcgcctgtaatcccagctactcaggaggctgaggcaggagaatcgcttgaacccgggaggtggaggctgcagtgagccgagatcacaccattgtcctccagcctgggtgacagagccagactccgtctcaaacaaaacaaaacaaaagacatcagctagctggtccaagcacagtggtgttcacaacgaattgatcacagccaggtagaattcttcattctttctccagttccactgctttgcttgaccagccttaaagacacacatatacatttttgtctgggcgcgctggctcacacctgtaatcccaacactttgggaggccaaggcaggcggatcacttgaggtcaggagtttgagaccagcctgaccaacgtggagaaaccccgtctctcctaaaaatacaaaattagccaggcatggtggcacacgcctgtaatcccagctactggagaggctgaggcaggagaatcgcttgaacccgggaggcggaggttgccgtgagctgagatcgcgccactgcactccagcctgggcaacaagagcgaaactctgtctcaaaaaaaaaaaaaaaaagtatatatttttaaaagacattggccgggtgcggtggctcacgcctgtaatcccagcactttgggaggccgaggtgggcagatcacgaggtcaggagatcgagaccatcctggccaacacggtaaaaccccgtctctactaaaaatacaaaaattagctgggcacggtggtgcatgcctgtaaacccagctaccaggtactcgggaggctgaggcaggagaatcgcttgcaccagggagtcggaggttgcggcgagctgagatcatgccactgcactgcggcctggagacaagagcaagactccgtctcaaaaaaaaaaaaaaaaaaaaaaaaaaaaagacatcaactaattgcagtgtgtggaccttatttggctcttaattcaaactattaaaccaaaaatgtgaacacaccaggccttcggtggcatgaaggaattgtctgttgtgttaggtgggtctgcagtattgcgatgccctccaaaatgcttgcagataaaagggtggctggaatttggttcaaaacatgggtcagggctgggcgtggtggctcatgcctgtaatcccagcactttgggaggccgaggcgggcggatcatctgaggtcaggagttcaagaccagcctgaccaatatggagaaaccctgtctctactaaaaatagaaaattagccaggaatggtggtgcacgcctgtaatcccagctactcgggaggctgaggcaggaaaagcgcttgaacccaggaggcggaggttgccatgagccgagatcgtgccgttgcactccagccttggcaacaagagtgaactctgtctcaaaaaaaaaaaaaaaaaaaaaaacacatgggtcaggaggggaagggtcggggcagggagggcagggcaggctctggggtggggggtctgtgagtcagccacagctctgcccacgtctccccacggagcttcgagccacgcagagcagcacgttttgcagtacgccatcttttccaaaagccaccacctctcggcagcatcattaacccaaggcaggctgtggcctcagaagccccggctgtcctccacctggaactggacacagctgtccctgctgagcttcagcagccagggagccacaagtggagaggcacctgcgtgagctccccaggaaggctactggtgacacccagacagcaacgctcctggacccttaaacacctgccagcagctgtgatctgtgtccttcacctctcccagcttgacccctcttccctggggaaaacccagccgtctccccgaggaggagtttgcagggtagacagcaaaatggctgggctgccccacagcacagagggtggcctggggggccagccagggccttcacatccttcctagggccctagtttcccatgggtcccctcaccccaccttccagaactctcccagcggcggccccaggtgtgtacagaacagcacccacctgcccacgaggtcaccctgtgccctgttgcacacttgaggggcctggcattcggaatcttgccagctcaggctgggacaggccaccaacccccagggtccccctcctccaaaccccaggaccagagcctaagaggacaacacaaggcaggggcgggggctccgctgctgtgccaagggcctggagaacacgggccttgctctccgctcagcagccaccagcgcccttctctcccggacagctcccgaggggctgctctcatggacaccatcaggtgctgggaagcaggaaccaccaggacctggacagagtccccagtgaccggcctggcagacagaggagccctcagctacagcatcacaaacaacgggtggggtaggtctgatgcaattctgtgggtgctgttgccaggcaggaggaggccatctccacagagacagccgcgagacacacgcgtccgcagtcagggagcgcaggagcaatgtggccccgaggggcacgggctccattggtccaggagaacccattcttctcccaccctcgagaccacccagcaaagccccaaggacacacggctcccctaaggaagggtggccacaggcgggagtgacccagaaacgttacaaaaccaaatgccagaacccacccaatgtttagcaagcctggggatgtgccacgtcccccagggatccagcacgcacccaaggagacactgtcccggcgaggagcctggagcctgggaaatacaaggcatcagactggtcccaagactctccccagcgctggggacaactgtctgcttatcttagtcccctgcgcccttttcaatccaaccctgggtcctgggcacctcatagttccaaatccctgctatgcacatcccggctgtgatgcctgggacaggtcctgtcctggctgtgatgcctgggacaggtcgtgtcacctctccaaacctgtttcctcatctgtgaaatgcaaatctccacggtccctatgcctcggatggtcagagtcaggattccgcatgacgacccccaacaggagcctggcacagacctggctctgggcagcgtctccataaaggccacctgttgtttttatctcccgaaagcgaacatgacaaggctttaaccccccacggcaatccgccctcacccctgttctcaggatagccttggaacccaatagcagagcgcctgaggcccttcatgaccccagcccacccgcgagcccacctcccaccctgcccctacccctcacacctcccgtggccagcctccagcctcatggtctttgctcacaccgttcaccccccttcttctggacccacctcatcgccccttcctaagcatcagcccaattcttgcacatccatcaaatccttgtccagacacctcctggaactcttccctgcagccccctacaaccatccccacctctccgggtaccccgcagccccaggccgcatcccaattcctctccaattagcgactgtttgtcctcccagctgagcgggcctccgggccccgcccccgctggcgtctgcacagcccccgggtgggacgtctgtctccagacccggggtttttcggctcccccgggccgtgccaaccgcggctccaggcgttccttatttagcagggccgctgtgcccgcgccggagcctcgccctgggagcgtcctggcccgcgtcctgcttcccgtcccgggccagggaacgcgcccacacccgcccgtcccgcggcctctcccgggtgccgctgggcccgctactcacagcgctgtggcgtccgcggggatgcgcagcgcgggaccgagcgtccgcagcccgcggcccgagcagttgacgcggcaggcggcgccgggcgctaggccgcagaggcaggggggctcgcaaggcccgcagccgcgcccggggccccccgccagcgccccgagccacaggcccaggcccagggccagcgccaggcgggcgggcgcggcgggcggcatcgttagggcagcgcgcgcatggccccgccgtccccaggcccgcccgcgcgcggaggccgcggctcaggcggggccggcagacggcatggcgggcgcggggctggatggggctgcggccgcgacctgctgctgagcgacgcccgctcgaggctcggggccaggccgctccgggagcttggccgcccgctcggacgctggcgctgcagtgcgagccccgccgcggctcctcctcctccccgcgccgcgcggggcggacggggcgcggtgggggcggggcgggtgcaggctccgcccccttcgccacagcgcgaccaggccagcgatgagggactggcatccggaggcttcaccctccgctccacagggtcggcagcagagcggggcctccggaagctccgccccacgcgttcccggggcgcatgcgacgtggggcggagcgtctggaagctccgcccgtcgcactggagagtcggccgaggcgcacgaggtatttttcacgctccgccccactgcaggctaaagtgcgtgggcgggaagcggtgggcagggtgccatctggctccgcccttctcctgtggtgtgggccaggcggcgggttcctcctcctgcagcagccacaggctccaccctgatccttctcccgcggcatggatccttctcccgcggcgtggatccttctcccgcaatctccgtgcgcgtccccagtcagtacccgcagcctcccgacgcacccgctggctccaagcctccctaccccaggtttcctggctaagagagagacagaaggagagagggggaagagagagaacaggcaatgggaggttgatggtgagagcttattgaaagacaagagggaggaaacccacatcctccattccccatccattcatttattgccttatttattccattgaatcttcacagctctagaaaaagtgtgctacaattattccctttattaaatgaggtcactgaggcacagtttaagaaatttgccagcagggcacagtgggtcactccggtaatcccagaactttgagagggggaggaaggtggatcccttgagcccaggagttggagaccagcctggccaacatggcgagaccccgtttctacaaaaattagccaaaattagccaaactggctcacacttgtagtcccaggtactcgagaggctgaggccggaggagcgtgtgagcccaggaggcagtggctgcgctgagccgtgattgtgccactgcactccagcctgggcaacagagtaagaccctgtctcgaaaaaaaaaaaatggaaaaaagaaaaaaagaactggctgggagtggtggctcatgcctgtaatcccagcactttgggaggccgaggtgggtggatcacctgaggtcaggagtttgagaccaacctgaccaacaaggtgaaatcccatttctactaaaaatacaaaaattagccaggcgtggtggcaggtgcctgtagtcccagctactagggaggctgagacaggagaatagcttgaacctgggaggcagaggttgcagtgagccgagattgcaccactgcactccagactgggcaatacagtgagactccgtctcaaaaacaaaaaaaatcctaccacatgtgctccaccaagctctgtctccaaggtggccttggaagccacatggggaaggtggcagagactctaggagcctgagcagagacccagatgattatgaaaaatgcagacctacccatccttattcacctgggaccaccgtgaactatatcataagaaataaacccctattgtacatacatgcaccattccagttgggtctatttgttacagcagtttagccaaccctaatccacatatacagtgtcaacagtggctgagatgacatgttgcacagacatgagagtcagaaagacctgagttcaagtcccagtgatgacatttactatctgtgtgaccttgaaaagctgcctaactactctcagaccgtttcctcatcagtttgttttgagaatcaaatgagaaaattactaaaaagcccttagcactgcatctaagatggggaagagacagtcaatgaattcaagtttcctgaagcccagttgcatccctgccctgtcctgggctctgagagacagttgccgaagctagtgttaaagtgaactaaatatggcctgagtgggacttcgtacttctatagttgagtccttgtggacaaattgcaacctagcttaataggtagacaagattgaaaacctaacttaggagtatgcgtctgtaacaatagctgagtcttggccaatcccagaggccgtagttcaaccgctcatacgctgctgagtgttcaaactgtactcaaataaggcaaacgccaacttgtaacaatccagccattctgtacttcacttctgatttctgtacatcatttcccttcttttgtccataaatcttcttccaccacgtggctgcgctggagtctctatgaatctgctgtgattctggggtctgcccaattcgcaaatcattcattgctcaattaaactactttaaatttaattcagctgagattttcttttatcactaatttgagctggttttctaatgtttgcaaatgggagggctgactaatataacactgctccaaatattaacgtctttctcccaacccatcacccaggcagaagtggtccagcctggggaaccctaggaggaggctagctctcctctaggaaggcttaggatgcagccagtgggcagtaactggctcactgtcccctgcaactgaaatcagaactggttccagaaaccaagttgacccccaaccagtctttcccaaaatatggctctatgcccatctctggtcaggctgggctgttttcctggacagagaagtctcagacaagcaggcagtggttagtgggctgtgcccaggctgagaacatttcccagagcagatggcatctctggcagtcccttaaagccagcagaggccaagtcatgtccaagaggccaaaagacccaatatggtggagacagtctacagtccccatgaataagggatgccgatgccttccctatgtaccaggtagtcactgcctgaggggcccagagcagcaggagggcagagccagcctgggcaggggcactgggccggaagtggggctcacatcctcagcgcgcacacacactctcacacacacacacacacacacacacacgaatgcacgcatgcacacacaaatgcacgcacgcacaggtgcattcaaacatcacatacacgtgtacattccttgcaaagtcaacttctgctgatagcacaacaaacaatggggccacagtgtggcatggaggaaaccctggagtctgatctcatttttttttttttttgcatctgtcaggagataaagatatttgataaaaatccttgagtcacatccccaccaggtccctgcctacctgtagaccccatcaagccagctccatggcccctcagataccgcctcactgggtccccagggattgacctcagtcctggaaatgcagaaatatctgtatctgtcacagctgagactggcggccttccgccggctttcctggaggcagaggtggagacagggacttgggtggatgtggtttttgtttttgttttgaaaggggctttcaggagaagggaggtgaggactacaggatgcagaaggggacagagcagagtgagaatgtggtcccttaaagtcccgccttgacctatcccacgagcagcagagagcacgccacaggatcgtccccaccgtggggcagggaccagccattcacgttgctgtatcagttagtcactgggccattactgggcatggcatcccatcccaggcaacgtggctcccatctgagggtgattctctagagaaggacagctgtgagctctcagcaggtgaggctccaaaagcagctatgccagtctagacctcaggggaagggggaattcatctctaggcagggatgattttcataacattgaactcttgacatgcaggagcaccgaccaatcagaacagacacggtgaccaaacaggcacagccacaccagtggataccagcggaatgtccacgctgcctctgcgaagggacagtcccatgagccaagccctagaccagctgttctgggagcactgcatcattgcactgaattctcacaaccgccccataatgctgggaccatccccattttcctgcccaacagcctccgtctcatagacactaggcggctctcccagggtcacacggtccagtcaataacgggcagaactcgcactccgatctgtctggctccaaagctgctaaaaattttctacttggcctcactggcttgacaaagattaaaaaagaaggcaagtccttctttccaagagatgctgaggtccctcggcgacgctaggtcatgattttatcatgttcagagggcaatgaaagggacagaaaacaagcgatgtgtgatctcctgtcatgtcaagagacgctgatttcaaagaaacgtacgtttcgcagaatcaatacgctgtggggcctcagaaagctgaggcagacacacggccccgacccgtgcacgtgggagccctgttacaagagacggcagaaattaaactgaatcacctggagcaagtacattgtaaatgttcaatattaatgacccacctcggccccaaagaagagagcgttgggctttgtccagctgtgtgctctgttgttaaaagaccaccttgtggccaggcacggtggctcgcacctgtaatcccagcgctttgggaggccaaagcaggtggatcacctgcggtcaggagttcgagaccagcctggccaacatagtgaaaccccgttgctactaaaaatacaaaaatttgctggatgtggtggctggcgcctgtaatcctagctactcgggaggttgaggcaggagaatcgcttgaacctgggaggcggaggttgcagtgagccaagatcacgccattgcactccagcctgggcgacaagagtgaaactccgtctcaaaaacaaacaaacaaacaaacaacaacagaaaacaatttgtgccttaatgggcattcctttcccttcttgctaagggatgagatgatggcagaacttgtggccactgtcctggaggttgacaagctttttctgtaaagtgctagataataaatattttgtgggccacacgatctctggtgcaactacacaacgctgccattgtcatgcaaatgtagccatagatgatgataaatgaatgggtgtgactgtgttccaataaaactttatttataaaacagacagcaggccagagttgggcaatgggcagtagtttgccccacactccccgcccatccgtcctattccttggcttttttgggtacatcaaggagtgcaatctggatgctgggctattttatggccactgggcataaccttaacctgggccttttgtctgttaacctgggtcagtggctacggtgaaggtcgggcaaccaaggtttagatggctcagtacacattcacgcccacaaaccaaaccaggaaaaagatgtgctaagttgagcatatgacactgttggtactcaaatggtttgtttttttttttaaataaatgtttaagtaaattttttattttagaacagttttagaaaaatggtgaaagcagtacagagagtttccatgtaccccatagcttgatgcattatgaactaaagtccatactttttttgggggggtggggacagggtcttgctcgtcacctaggctggagtgtggtggtgtgatcatagttcatggcagcctcaaccctcgacctcccctggctcaagtgatcctccatctcagcctcccaagtagctggaaatacaggtgcctgccaccatccccagagaatttgtttttgtttgtttgtttgtttgttgtttgtttgttgagacagggtctcactctcattgcccatgctggtatacagtggcacaatcacgggtcacttgcagccttgacttcccggactcaagtgatcctcccatctcagcctcccgagtagctaggactacaggtgcacaccacaagcctggctaattttttgtattttttgtagagatggggtttcgccatgtcgcccaggctggtcttgaactcctgggctcaacccatccgccggcctcggccccacaaagtgctagggttacaggcgcgagccaccgtgcctggccacctgaagtccatagttgattctgattgccttagtttttgcttaatgtcctttttctgttccaggataccacatggagcattttgaggagtgctggtcaggtattttgtagaatgttcctcaactgggatttggcagatgcttttctcatccttagtcttggcttgtgtgtgttttgaggagaaggaccacagagcttaagaatcattctcagcactctgtatcaggcacgcattctctcaagatgacttgccgctattgatgttgactttgatcacctggctgaggtagtgtctgtccgtgttctccactgtaaagttactctctcctctcttttcacactgtactctttggaagagagtcactatgcacagcccacacttaggatgtgggaagtccgctccacctccttgacgatggaatagctatataaattacctggggccgggcacggcggctcacacctgtcatcccagcacttgaatgggaggccgaggagggtgatcgcttgaggtcaggagtttgagaccaacctggtcaacatggtgaaaccccgcctctactaaaaatacaaaaaattagccgagtgtggcagcgcatgcctgtgatcccagctactcgggaggctgaggcacaagaatcgcttgaacctgggaggtggaggttgcagtaagccaagattacatcactgcactccaacctgggcaacagagcaagaccctgtgtaaaaaaaaaaattaaataaaaataaataaataaataatctggaattcttctgcctgggagatttgtctcttctctcttatctgatcatttatagcagtatggaatcatggtatttattctttgaattctaatctgttacgtatttatgacagtatcagtaaaagcctcccttgaaatttaccaatggcatgaacatttcagatgagtctgccatctttggtgctcctgggacacgagagagacctgtcttgcttgctgatcacaaaggtggctttttctgtggccaaagctaaggctgtagggtctggtaagaagaaaagatggtcatgttcctcgtcaagtttccagttggctactggagagatcagtcaaagagtacaacaatcaatcattcgttcattcaaaacttaagtgcctcctatatgccaggtcctgtgctatggaagcaggattttgattagaccttttaaaatgggaagcaacaagaaaagggagaaagtcttatctttgatttcagcctaaccaagggaggcatcactgtttccttcttcttttttctttttcagaacgacgtcctatattactccctgacaggggtgaggagtgtttcctacagttcacaggaaagattatgcatccatgattccagtccctaggcttggaagagaggtctgcataattgagatacagcttggtatgttctccagtgatactgagaaaagagtgaggagagtcaaaaggaaaaaataataatagcagcagttgtaaaacctaacacattaaacacttactatgtgccgagcactgatctcagtgctgaataagaataaacaaacaaacaagtaactgagttctcttactagaaaataattgtaaagtaacgtacaagtttgatattttctacacatggagttttaaatatgaagcagatatgaaggtatagtaaatagatcaaattatttaaagcaacatgtttaaactttcaaataaaacttaaacagaatcagtagtgttcaatcagttctaagttattaatactaagttactcagtcactccattaagattcaacaaaatggttttgttaatcagtggtaccaaaaattaaattttggttttaaccttagtccttgttgttagctctcctggaatttttctgaaatttcatgaaaagaataaaagaatgatttcagaaaaaataaaaaataaaaataaacaaacagagccctttcattttctcctggaggaagtagcaaaaacagcagccctatggagagagaatttcagaacggtatcaatggcctccaaaatatccctgccatttgactatattctttgttttcagagaatcctttggaactagcaccaaagcttcatgcaaaaagctgtgcagcactggttacaatgacctaaaacctggaagcaaactgtgttccaatagtaggggctggcttaaataatctctcgtacatacatataaaagaagaatgaggacactctctactgacatagaaccatttccaagattaaccgttaagtgaataatgcaaggtacagttttgaaatacacattaactatagtcaccatagtgtgcaatagatcactaaaacttattccttctgtaccctttggccaacatctttctttccccatctaccacatcctcaccctctgatcaccaccactgctaaaagtagattttaaatgttctcaccacaaagaaatgttaagtatgtgaggggatgagtatgttaattgacctgatttaattattccacaatgtatgcacatatcataacatcccattgtaccccataaatatatgtacttatttgccgattgaaaatgtttttaaatataagatgcagaagaatgtgtgctatcttttaaattttatggcatatggatgtattaactttttaaaaatttaaaagcaatatgtcaaactatttatagagtagaatccaatgatctatgtgggaataagaaagtgtgggaaagaatttttgggaaatgttcactagttttgtttgggtagaagatcactgggtaattctttcctcccatttttctctatttctaaatttagatgtgtggtacaatgaaatacttttatcatgaaaaaaagacattttaaaatgaaagaaatcctggatccaggctaggggtttgcttagatatttaaaatcctagaacgcatataaaaagggactcgtgatcacaaaaggacatcagagaatgacaaaaatgtcaaagatatggtcaggaaggcataaaccctacactaatttgccaaaacccaaaaagccaatgggctctcaaaatcaagccttaaagcaactttcagaggtttgctgttttaagtgtttggttaggactttgctgcaattaacaagaacctcaaatcaaactgggttaagcaaaagaaggaatttattggcttaaataatcaaaaagttcaggggaaagaaaagactgtctttagaatagcttggtcctgttcactcatattttttcttttctttttttttttcttagagatggggtcttactctgtcacccagactggggtccagaggcatgatcatagctcactgcagccttgaaccctgggctgcagcaatctttttaccccagccttccaagtagctgggactacagacatgtgctaccatgcccagctaattttttttttttttttttttttggtctacagacagggtctcaccatatcgcccaggctggtcttgaactcctagcctcaagcaatactcccatgtcagcctcccaaagtgttgtgataagaggcatgagccaatgggcctagactcacttacatcttgacttttttcctcttgactcagctctctacctggggcaccatattggggcattctaaatatcaggccctaggtagtggctcctagaaggccatgttcactgtagctttttttttttaagcagttctagaagaaaagagccaaaggtgcctcttccccagcagaggcaacagtatgcattgcataccaactgagtcacctgctcatttctgaaacaatccctagagacctgagaatgcaatgccctgagtggcggggtggaaccaacaccatcagaagcgcactattctagaggaaaagcaggtaccaggaaaacagactgagcattcagcagcaaaacagcaggcagcagagaaaattgcaaattcatgtgtgcccatctcttcaagtaaaatgaataaataagcaaaatgaaaaaatatatatgtatatcattaagaagaacatgaaatctgaaatagatggacagcaagtaagagaacattgctttaaatgaattcaaatttctaggccacatgcacaagtctcagaacccatgttcatatccatggagctacctccaaagacctgaactgtgatccctttcagagaaaccaaaccggagagaggccgctggggtctctcttttcacaaaggggatgggttggaagttgacatccgagaaccagatacaggcattgacttctgaggaaacttttttattaatcagttttataattgacaaataaaaattgtgtatattgtatttattgtgtgcaacatattttgaaatatatatacattttaaaatgccaaatcaagctaattaacatgcatgacctcacacattactctcttagcaaatttcaagaatacattgttgttaactatagtcaccatgttgaaccacagatctcttgaactgattatctgaggaaattactgaacaaattctaaaatagcagatttatgaaggcttagagaagattgatcaataaaacctactgtaaacttaccaagatcgtgtggtaccaaaacacactccacaggattacgagattgggagctctagggaagcccgataaaatccaattttaaaatagcacaaaaattaactaactattgggtactaagcttagtatctggatgatgggatcagcagagccccaaacctcaacatcagagaatacacctaggtaacaaatctgcacatataccccccgaatctaaaaatatttttaaggaaaaaaatatttaaacaatctgttggccaggtgagatggctcatgcctataatctcagcacttcagaaggctgaggtgggaagatcgctggagaccaggaattcaataccagcctgggcaacatagtgagactttgtctctatgaaaaatacaaaaattagccagatacagtggtgtacacctgtagtcccagctactcaggaggctgaagcaggaggatcgtttcagcccaggaggtcacggctacagtgagccatgatcccaccactgcactccagcctgagtgagaccttgtcacttaaagaagaagaaaaaaaagcatatgctattttcagaaacgcatttgaaaatttgaaaacatccatgtttgtgttctgaggataaagacaggtagaagaaacatgggtgtgaattagtagctgattgtctatccataccaactaaatgccatcatcatcatcatcaccataggtatttgaaggtttttactaccttacttagtcctctaaggctgaagtgctagcaggtagatatttattagtccccttttagagattaaagcactgatctcaagaggtgaaataacttgtccagctagcaaataatggagctggcatcctgacccagatctgtccagctgcaaaaatctttcctctcatgagttgttagcattattccaaacaaaacactgccctaaaagtgtgaaaatgtcctcagttcaccccttctctgcagtgggaccctgacatttaaaggcacaccaagaggagacagtgctccctgcagggctggagggtaatatctgaggtctgggagggacaaaattcacaaccaagggttactccctcccacctgtgcctgacatttttctttctaaaaaatctgctcatttctgttcttctttcctcttcatcttccccctctcccttttcaatattttatttctttatcttatttggtgttttcattgccaaagtaattcatgcttactataaaagcatcaagcaatagacaagtgtataataaaaagcaagaggtccaacccccaggaaactgctggggacagtttggtacctatccttccacagtgtttactgtgcgcacatcagtaaatcagacttaatacaatgttacaagttatatagaagtgctgaaatatacacctaagaagccagcagccttggctatagtctctggtgcatgcatgtggcatgattgtgcatggttctcagaaaccttgttgctgctcctatcattccttcctctaccagtccacaaatgtctaactgcccaccatgtgcgaggtgccatgctccgtgctcagaacacagctgtgaaccaggtggacatggtgcccttcctagaaacaaaatctaggctgcaagaatggtggctttaactcacttcaagaaatgcattcaccaagcaccttctctgtgccagcttttgcaggggatgaggcgatgtcacagatatatcagacacagcactgctctgaaatgctcatggaataatagaggagacaggctagaaaatgaggtccattatttgtgttttaaaattaggccaggcacactgttcacaatagcaaagacttggaaccaacccaatacccatcaatgacagactggataaagaaaatgtggcacatatacaccacagaatactatgtagccataaaaaaggattagttcatgtcctttgcagggacatggatgaagctggaaaccatcattctcagcaaactatcacaaggacagaaaactagacattgcatgttttcactcataagtgggaattgaacaataagaacacatggacacagggaggggaacatcacatactggggcctgtcagggcgtggggggctaggggagggatagcattatgagaaatatctaatgtagatgatgggttgatgggtgcagcaaaccaccatggcacgtgtacacctatgttacaaacctgcacattctgcacatgtacaccagaacttaaagtataattttaaaaataaataaataaggccgggcgtggtggctcaagcctttaatcccagcactttgggaggctgaggtgggcggatcaagaccagcctgaccaacatggagaaatcccatctctactaaaaatacaaaaaattagccggatgtggtggcacatgcctgtaatcccagctactcgggaggctgaggcaggagaatttcttgaactcaggaggcggaggttgtgatgagttgagatgacaccattgcactccagcctgggcaacaaaagcaaaactctgcctcaaaaaaaaaaaattaaattaaaaaaactaataaaataaaataaataaataaataataaaataaaatcaggccagctgcagtggaacactcacgtctttaatccctttgcactgtaacccctaagtactttggtaagccaaggcaggaggaccacatgaggtcagaagttcaagaccagcctcggcaacatagaagtttaatttaaaaaaaaaattaaatttaaaaatagccaggtacagtggtgcacacctgtagccccagctactcagggctgaggcaggaggatcacttgagcccaggagtttgaggctgcagtgacctatgattggaacccgggagtttgaggctgcagtgactgattatcatgccactgcactccaacctgggtgacacagcgagatcctgtctctaagtaataatgatgatgataaattaaaaaataataatttttattatgttgttgttactaacaaaatttattgagcccttcctagatgtcatacactatactaagtactttacaagcattaagtaatttcatccttttaaggaccgtttgaggtaactgtgatgattattcccacctcatagatgcagacactaaagctcaaagaagatgagtgccttgcctgaggtctcacggctggtgaatgaccgggctgtgactcaagccaagagctgtttgtctccaagactcttaaagactcttttttaaaaccagcatgctattccatttcatggtattctctttttctccctcattagcagattcctacagaacccacatgactctactgttcctgccccaatttatttttgcctgagtctccccactttgggcaaaagcctcgcttgaactatatcgatagctacaatgactgaaaattgtgtcacgtatcacatagaatctctgttcccaaggtacccagagagactgaaataggtccgttaacagtcgtgtgttttacattccacttggagggttaacattcagggtcacccttcttctgagccttaaaaaccaggggtatcaaagtaatgagggagtgcgagcattccatggagtttggattaatgatctgtgagcctctgttcagccctgaatgcgtgtcatttttagagttcagcctggcaagaaaacttaacaagaatcctggtcaaaagaagtctcggtcatttaatgacaaagggtaactggacaacctaccaccagcaatttatttttagaccaagttaagtcatacttctatgcatgacctcattcccatgactctcctgccctgcccccagttactgtcctcagctctatgatgcaaatattctgcagacgtgtctctgccctgcaagattccctagacagctttaccttgactacagatatgtcaatgtccgccaccatagaaaggtctttctgcagaccgaactgaactgatgctagcttgttccatcaggaccccttctttcactgtgcaaactgtcccccaagctcctgtgctccaatcagacaatcagaactttccattcatttcagcaaagttctattgagcttccactctgggttgggtagtagtctaggctggggacagaaagatgaatgagacccatgccttatgagacacatgatactcacagtgaggaggagagagcagatgacttacactgaaacaaaaacaataatgtttcacatccaataatataataataaacaagacacagaggaaggggttatttcttctcttctgagagaataggaaacaacaaagatacatttctacagagaagggctttaaaggatgaataggagttttccagggagaaaaggagaaaaggccatttctggcagagccaaccaaagcagaaaattctgaaagtgaatgtttgacaggagctgcggagagggaagaagagggtgacacataattcagtaaagtgattgtgttgaacatggaacagcagaggggtgggagatgagcataagaagttgtgatggttccttgacaccttgcttatttttgtaattttttttttttagattttgaaataatttgatcctaacaggaaagttgtaagcttggtataaagagcgctcatatacaggctgggtgtggtggctcacgcctgtagtgccagcattttgggaggctgagctgagagcattgcttgaggccaggaggtcgagaccagcctgggcaacatatcaagaccccatctctacaaaaataataataataatgaaagaattagccaagcatggtggtgctcacctgcagtcccagtaacttgggaggctgaagtgggaggatggcttgagtccaggaggtcgaggctgcagtgagctgtgactgtgccactgcactccagcctgggcaatagagtgagacactgtcttaaaaaaattctcataaacccgttttacctagtcttcctaaaatcgtcaatattttaccacacttgctttatcatcttttcttgatacatacatattgcatttgtatttttttatgaattgtttaagaatgagttggggtcatgatattcctttacccctaatcacttcagtgtgtatttcctaagaccatggtcattttcttaggtaactaccatataaagtcaggaaattgacattgacttaataccattatctaatccacaaaccttattaatatgtcaccaattttcccaataatttctttcatagtaacaaaaagaaaatgttgaccacctgtattagtccattttcacactgctataaagagctgcctgagactgggtgatttattaaaaaaaagagatttaattggcccacagttctgcatggctggggagttctcagggaatttacaatcatggccgaaggggaaacaggcatgtcttacatggcagcaggcaagagaggagagcaggggaaacagccacttataaaaccatcggctttcttgaaaactcactcactatcacaagaacagcatggaggaaagagcccccatgatccagtcacctcccaccaggtccttcccttgacatgcggagattacagttagagatgagatttgggtggggacacagagtcaaaccttatcaccaccctatttacaattgggactccaaccctctcaacatgccctgggccctggctctgctttttctttgtagcattttctgacctctaacatgtagcattattcctatttctaaaatgtctctcccttcccaccatcccactagaatgtagatctatgaggtcaagaacttttgtccattttgctcactgtcatatcaacacccaggagagtgactgccacatgaaagttattaaataaatagtctgaatgactgaatggccaaacctggaggtatctcttcccaacccctcttcctcttatttttttaagcaaaaaacaataggctattttttcatgccaagaaaactgagcctccatgttagtgtttttctccctttaagttcttgcttggggttttcttattttgcctcctgataggtacgtagggtatattgcaaaggagaaggttatccccagaacagctagggcttcttctaagaatagcccaagtcaactgaatctcccctgggtctcctatacagatgtgaaagtccttgacatgcaatggtatctatccctctgcaaacagagtgagcatctttagatctaattgaaagattaaaaagaagatccccagctggaaggtcaatttatagattccacagttaaatcaagccacattcttaagcacatgggacacaaaccttgcattaaatcaaagacttaatccaagttaagccaccctggatgaggagctagagctggagacatgtaattaacaccagccagtcagcaccaactgcttcagctgacaggtccacagcctggaaaaccttgttacaatttccaggagggctttggggatgcttgttctcaagttccagagacggtgggctttgcttctttccatctgatctcaactactgaccaccaggctccctgcactccagccccaccaacctccttgccacttctcaaacatgtcaaggacgcttccatttcaaggtcatttgcacctgctctctccctgagctccctctggactttgctcaaatgtcacctctctctcactctatttatttctgtaagcctctctcctccttgtcacctgctattccctcctgctgtatcccttcccgccactcttatcccacctgacacactgcacattgtacttatccatttactctttcttcccctgagaaaccccatgaaggcaggacctgtgctttttcattcaatgttccctcaccaatcatctagaacagtatgtagcatatatcaggcactcagtacctaactgctgagttaatttgttggctagttatctgattgattgactgattgattgggtggttaattaaatggttaattaatttacctcctgaggctgggcccccatatggccacctagctaagaaacaccatcaaaccgggggtgggtattttggttacgaaggcaaataagagctacctagaaatgccctgacgccagatgtcttcaatattctgagacctgagtctctgttataggttggtgtccttgggataaagttcaagttctctgtccctttggttcttaccttgaggaactccatcttccacccctgaactgctcatctaccctccagtgaactagaacttttgtcagctcctcaaagtcaccaggttcttgccacatatgacgtctcttcctagaacagtcctctccatcatgccatagtcttcaactctggccagcgcctgctccccaggtgtcccctgtctgcactcaccacactcttcttgcagtgaatcaccagactgtgggttccacgaagcgagagcccttgccttcttcttccccatggtatcccagtgtctagggcattgccagactcatgcttgaatatttgctaatttggataggagttatcatcttatttcacagatggaagttatgaactttttacacacctaatgtacgggaattttcacactaaacaatcctccaattctctgtggataccaattgggtattctataattaaattaaactttggcactgcctacctggtgttaccgtcagaccctatgagtgaagggttccaacccacaagaaggcccccaacctctgaggccagttgcaaatcccaggttgctacctgtactcctaagcaaccagctataaatcgggggttcctgcaacccactctcaggtttgataatttgttaaaatgactcccagaaatcagaaaagtgttttaattactactactggtttattataaaggatgaaagtcaataacagcccaatggaagggaagcataggggaaggatgggagaagggccccatgcacaccagcctcccagctccatgcactcaccaactcagaagctctctgaaccccatcctttagtattatggaggttccactacataggtgtgattaaaccattggctatttggtgattaggtcaatggttgttgacttcagcctctctcctctccttgaggtgggaagtaagatttggggtgggcaatgagcctaatagctcctccaaccttttaatcatgaggttggtttctctatagccagccccatcctgaatctatctagagctcaccaagagtcccctcatttgcgaaaactcaggaatcgttgaaagggacttgttatgaacaacaaaagatgctcccctaaacccatcattcaggaaattccaagggttttagaagttctgtgtcaggaaccaggacaaagactaaatatatacttcttccttcatcgcagaggttaaatatagtatagtggtaagaccacagctttgaagaccatgagttcaaatcccaactcttccacgtaatggctatgtgaccttaaacaagttatctcagctctctaaatctttttctcatttataaaatgacaatcatggtaaatttataattcattcaacaccgttctcaaggctaggaatatggcagtaaacaacagattggcccaaagtgatattcgagccaaaacccaaatggtgagaagaatttcgccaccttgagcctaaaaggaagaaccttcaaggcagagggaatatcatgcctgaaggtgttgaggcaggaacaacctcatagtgttcaggaaagataaaagaaggccaggccgccaggcacggtggctcacacctttaatcccagcactttgggaggccgaggcaggtggatcacctgaggtcaggagttcgagaccagcctgaccaatataaagaaaccctgtctctatttaaaaaaatacaaaatcagccaggcatggtggcacaggcctgtaatcccagctactcaggaggctaaggcaggagaatcgcttgaacccgggaggcagaggttgcagtgagctgagatcgcgccattgcacttcagcctgggcaacaagagcaaaactctgtctcaaaaaaaaaagaagaagaaggccagtggtgcctctggcatccccaaaagcaagcctccaataccacaaaggtacacagggccactttccctgcacctctcggctcctgatctacccaactccagaccccaaggttcacctctagctctgaaaaggagcacagcttctccagccacatctgcctcattttgcctcaactgcaattggaatcgttctctgattggctcccctgggtacgtcccctagcctgaccttctcaatcccccacttctgtgccctaccatccccttaagtgacactgtcagccaggtttgcctggctctcaagctgcaaatctctaagacagaagtcaatgggtaatgagaataagaaaatgtgaaggactagaactccagatcttgatgctactggtattagttaggtcagagaagataataatttgacatcctaggaacccaaatttccatccccgtctaactccactatccaatgctaaattcaatggcttataccaatgctatttgattcttaatcagtgtctgctccatctggtccctttacagtactgattctcaaccggggcaattttgctccctaagggacatttcgcaatatcgggagacacttttggttgtcacaactggggtggacggtgctactggtatttggtgggtagaggccagggatgctgcaaaacatacagcagtgcacaggacagcctgcccctgtccccaacaacaaattttcctgcccaaaatgccaacagtgccaaggttgaaaaatgctgcttttaagtaacacagctcaccctgcataaacattaaacatatatataaagagatgttaaaatgtatttgtatgcagataaatgcaaattaaaacattaatgagatatttcacacctcgcaagcagacaaatttcaaaaaggacaaatattggcagaaaagtggggacataggaaccctcaggcacagctgatggagggtatgctggtgtgacctgttactatttagtcaaaggaagattcacagacccaaggaccagcagttctataagaaagtcttacaaagctccttaggaagacacatacagaaataatcattgcaaggttatttgtggaaggtggaggtaacgaggttgtctatcattggggaactaggcagataaaagtggatgagcaaataccgtggggtattagaagtgaccttttttttttaatttttctttttcttcttttttttttttttgagacggcgtttcactccagcccaggctggagtgcagtggcatgatttcagctcactgcaacctccatctcctgggttcaagtgattctcctgcttcagcctgctgaatagctggaattacaggtgcctgccaccacgcccagctaattttttgtattttagtagaggggggtttcaccatgttggccaggctggtcttgaactcctgacctcaggtgacccacctgcctcggcctcccaaagtgctgggattataggcttgagccaccgtgcctggccagaagtaacattttagatgtacaaatagcaatagagatggaccttacagctttaatgagagtgaggagggggagttaaaaaaaaaaaaacaaaaacagcatgagacgattaatacaattccacatgcatcaatctttttcaaagtgtacacattgggagagtaaattggcacatgtactttggaaatttatttgatagtatttactaaagctcaatataaatactttgaaccagcaaattccactcctggaattatactcaagagatatgagtgtttgtgtccaccaaaagacatgtacacatttaatccataatagccccaaaccagaaacagccagttgttaataaagaaattgaggtatatgcatacaatagaatacaatacaacaatgaaaatacggatgcatctcatagacatcccattaagcaaaataagccaggcacaaagaatagacacagaatgcctcctttcatgaagttcaaaaccaggcaaaactaatcaacagtgttagaggtcattacactaatgtcctttggaaaggatagactttttttttttttttttttttttgagacggagtctcgctctgtcgcccaggctggagtgcaatggcgtgatctcggctcactgcaagctccgcctcccaggttcacaccattctcctgcctcagcctcccgagtagctgggactacaggtgcccgccaccacgcccggctggaaaggatagactttaaggattgacagggagactcctgcagggtcagaaatattctatatgttcatctaggtggtgattacacaagatctatacgtatgtaagaaaatatcatgcagtccacataaggtctgtgctctttatgttaattataccttaactacaaataaaacttaggatggaggactttcaaaagatatggattcaattgacaataccaagcactggcaagcatgcagagtaattaggaattttcatatactgccagtaggaaagcaaaatgacatagcccttctggaaaacagtttggccgttttttataaagttaaatatacacttataatgtgaccctgtaatctcacccccaggtgccctaaagaaataaaaacacgtttgtacaaaaacccatccacagggctgggtacgggtggctcaaacctgtagtcctagaactttgggaggctaaggcaggcagatcacctgaggtcaggagctcgagaccagtctagccaatatggtgaaaccccatctgtactaaaattacaaaaattagccgagcgtggtggcaggtgtctgtaatcccatctactcgggaagctgaggcaggagaattgcttgaacttcggaggtggaggttgcagtgagccaagatggtgccactgagccgaatccatcaaaagaaaagaaaaggagaaacaaaagaaaagaaaaggaaagagaaaaaagaaaaagaaaagaaaaggaagggaagggaagggaaagaaaaggaaaaggaaaaggaaagagagggagggaggaaggaaggaaggaaggaaggaaggaaaacctatacacagatacacaaatttatagacactctattcatagttagcaaaacctggagaaaatctaaatagcctccaaagaggaagtggataaacaaacatccacaccatggaatactatttggcaattaaacaacaaacaaactcctgatacataataaccagaatgaatctcacaggcattatcctgagtgaaataagtcagcctcaaaaggttattatcttagtccattcaggttgctatataccaaaataccataaacttggtggcttataagcaaacgaaatttatttcacacagttgcggaggctaaaagttcaagatcagggggccagcatggtgagggccttcctctagattgagggccctcctccaggttgcaaatggccaacttcccattatatcttcaagtggtagaaagagcatgagagacttctctggggtcccttttataagggcactaatcccattcatgagggctccaccctcatgatctaattatcttccaaaagcctcacttctaaatagcatcatattggggattatatttcagcatgggaatttgcaggaggacacaaacattcagcccacaacatgactttcttgaaaagacaaaagcataatgatggaaacagatcagtggttgccagggactatgggtgggggaagcatgcaactataaggaataacatgaaggacttctttggaatgatgaaagtgttcggtatcttaattgtgctcaaagtggttacattaatctatatatgtgttaaaattcatagaaccatgcatcaaaaaaagagtcaactttactatatgtacttaaagtataaaataaatgagatattgattcagagtcatattccacaattaataactatattaggaataaacaaatacgcgcacacaatattcttcaagaatatacacaaacaaaagatatacattaagcacacacgatggcctattaagggtaggaaatgtaagtaactagagtgaggtggtggggatgaaaggaaatgaacccagagacaaatcagtgagagacacatttgataatgcaactaggaagacttacaggagtgagaagcgattgtactcacagctatggtttattacaggatcggcaaggggcaagggacacacagcaggtagaatctggaagaatccatgcacagactcccagtgttctccccacctctctctagccctagggatcacggtgaatatgttctttcggcaacacctcttcagtgtttctgcctagagaagcccacgtttaggctcaaagtttgggtgttttattgagagctggtcacataagcacaaaaactagaaacaactattgaaattccaggctcctggaaaggaagcaggtattctgggcgcgaagcaggtattctgggagctaagcgggcaaaacagtgttttacatagttagataacaatgcaaaagccaagttcccagatgccagtgaagagccaagcctgaaagcaagcctttctaaagatggcaacctcatgctgactatgttaattctcccttgccctgggtccttgcagagacccatgtggatgtgccacgagcctgtgatccaaaaaaataaaataaaataatttttttaaaactaggatctgcttctggttttcaattcttctattatttaagtcatgcaacagtgttaaccaggcaggctcactagcatgatggatggataaataagtgggtgggtaggccgacggatgaatggatggatagacgaatggacggatggatgaatggacacatggatggatagaagcaaaataaaatcaatactgtatgagccaaacaaaacaatggcttgagcattctgtttctaatgatgctctcaggaatgcagccacaaggaaactctgccctcacctccaccccatgaggcagaaactggccaccagtgacagggaaacaaagtggattcctcgaatgtcattgttattaaaacaaaactagtcccagaaaactgacctgaatgtattttttctctcacttttggcctgactgtctaataaccaaaagtcaccagaaaaaaaaaattttttctcagcaaatgcttaaaaacagagaagacccccaaagtacacaggggcagagaacaactcacaaatctcaagaataaaataaagacggaagattctcaccctactgcaatgactctcccagcccactgccaccaaagtttctgagattaaaaagagaaattatttaatatatgcagtttcaatttttaaagtttcaggcatgaaagagcttttgctccctaatgatgtccctcagatgtagcaagacctggtctctctttcactgaagaattgccttcattttcaccacagacttcccttgcctcaaagacagatgctcagtcagagaaaggagcctgaggatccatagaaactctctgatattaattgatctgctcctagttttcagttattctattttttaaaacatgcgacagtgttaactaggcaggctcactagcatgatggatggatgagtgagtgggtgggtaggttgatggatgaatggatggacagatgaacaaatggacagatggatggatggatggatggatggatggatggatggatggatggatggatggatggacagatggacggacagatgaatggatggatggatgggtgggtggatggatggatggatggaaaaatggatggatgtatagatggagatagatatagacagaactagatacagacaaatagagacatcgttaaagagagagaggtaattatttatttttgcaacaagtatttattatctactttaggtcaggcactgctccagcttataactgtttgttataacagtaaccaaaacaaacaaacatccactaccttcccggagcttagagagagactataaaaattaaaaataatatatagaattatagatggtgttaagtgctatggggagagaaacatcaagtaaaggggcttgggaccggctggaaagagttccagttcttaaagaatagggtcaggaaaggactcaccagaaaagtgacttttgaatggagacctaaaacagatgagagtgttcaggttcaatattactttttaaatagacagacttaactacctgagaaaaaaacaggcatatcccaaaaatactaggacaagggaaaattataaaagttgatttaacaccaacaggtatgtaaaggagatgatgacataatgcttagttcctggcaagatttagattggagaaaaatagcatgacatgggcacacttggaagaaaccaatgggctatcaccaagaaggacctgctcgagctcaagataaccaggaaacataaccaccccttatgttataataatgtggtaacacaaaaaggtgggatggcatgtcacatattgactcggaagtaggcaaaaacgtgagaccaacttgggcttagatacacatacctaggaatatactaggtgaagtcaaagacagcaggagattgatattctacataaatatggaaatgcactttatgagttcttgagaatctctggggatttttcataggtctcacccatcactggtcatgtaaatatgtcatttttagcaaaatcacattctcttcacttctatctgttctgtattgctgcaaggactgctttttgaactagggtatgacaatgatccgtcttgatagtgtttgtgagtcaattcagaattacagtgattactaaagttggtcacatattccccccatctctatatgcattcctctttgtgatgtcactttgctgtcctttccactaaatagtagaacctatttctctaccctcttgagtccttgtcatgtgatttgccttgaccaagaaaatctcaaagaagtgatgttatggtaattcacagcctacaccacaacaggccagaaacgtctaccttatccctcttgaaatgctaccctgagactgacatatggggagtctgggctagactccttgagggtgagaaactatgtgaagcaaggtctggccaatagacagccccaaatgccagaattgggagtgaagtcatcatagacaatctgtctctaatggagtccccagatgtgtgcagaataggaatagccccaggaaagaccaacagaagaaccactcacctgagctcagcccaaattgttgactcacagaattgtaagtaaaccaacaaggtggttgtgttaagccattaagttttggataatttgttatgcgggaataaataactaatacagatggtagctacaagtctcttcctatgcctatggttgtcaagtagacaggtgaagcaattagtagtggaaactatccattcattaaacaagtacttatggagctcctactctatgcacacacagcctagtggctcacaataagcaacctttacagccactgcttgatgaaatatctccagacaaaagtattcctccaccatagcataaggtgatggtctgcccttgtgtatccatccttgtttaagaaacaaactaatgtcccttaactaaagattctccttccagtgaggacaaatgcaactcctcgtgaccactgtttctcctctggtgcccttccaataactcagaaaatctagattattggttgtttatgacttcactggatagcacctctattgtcatcaggccttcaggaggttgggtcttctgagaaatgcctgcccctcacccagccctagcaggccaatccattcctctttgtgtggtggagtcacgccagtgaagtggatgaggagtaggatgggagtcagaaaacttaggtttcatttgtgcattctcagacttgtgggaagatacttcaccagccccagccttagaaatgagagtaacagagctgtacaatctctgaggtgttatgtattcttaaggatacacttactggcagggaggaaatgctctaagccatttacatacattaccgacatcttctcttttaaccctccagggatcaggcatctccacggggtaggcactcccaccttcctgattttacaaatgggagtctgaggctcagaggaattgggtgacttactcaatgtcacacagctagttgcaggagtcagtcttttaactcaggcccatccagtcttaaaaacatggactgaaccagtgtacatccaactgacagatgagtttagaagctatctagtccagacaagcttgaactcagctagtccagcctttcatgcacctcacctatttagtgacagggaagtcattacttctccaagcaacttacattacgttaggctgaaaattgcctgcctgaaattcctgctcactaatccctcttggccctctgttaacatcaataattccaccgataattacaaagcacctactaggcaccagacattatcctaagtgcttgggatacacgtatgaaattgctcattccaacttggtttggcccagttttcaagggtttcctgctcaaactcacacctcagcctgaattcccactcctgaagatttcttacctctctgtagtgagctctgttgatggcctctctccatcctgctgtaactcacaatggaacctgtctcttccttcatttctcccaatgatctctaagacagagctgtctcatgccgctgactttactgaagctctcaggatatggagggggattacagcatgcaataagccatgacttccacaaagttacttatctctgtcttgaagttcttcactcacccctgccgtaggaaatttcacttccctagcctttcctcagagcccagctgctgtcatttttggggggtcctctaccaagtctcttgaattccacattccctagcctttcctcagagtccaactgctgtcattttggggggatcctctactaagtctcttgaatcctacattccccaacctttccttaaagcccaactgctgtcattttggtggggggtgggggggtcctccaccaagtctcttctctatttccttctaatttttcgcaatggtcagtacacccaagaccctctttccctgagctgggaaaagacctcaaattactatttttttgtcatgcataccaatgcaactcttcttaatctaagcttttctcatctctaccgtactccagaggaaacctccctgcaaataagaaaaccacaccaattaaagtattttttctgggaaaagaaaatatgcagttgtctcagaaggattcctcatgatactcctaggtcaactaattcaaacagcagccaacttttgaaatagaagttttctattaaataatagtaatgtcaactattaaacctgcaccttggcatatgatatgctacattcatttcttcatcttccaaatgaagaaactgaggctcagagagaaacattatcactagctttaaatcactgagctagaaagtggaaaagtgaagattcaaacagtccccaaaccaacacgcctttccagtgcttgaactatgatcaggcaagaaagtgcaacacttaaggtggcactcactctcaggggctgactgcacaagcatgaccctaagaatgggtacttccttaagagcagggtacctagaatccaagttcaggcaagtgcagggtgaatgcagctttaatttgcatcctaagcaccccgcttgcctcaccacagctggggccctgtaccttctcttccacaaccctgaaatgcatgctggacagtgaccatcctgactgggacactagcctggccctctgggcttgcatagcaattgatgcctggctttccctgtgcaggtggtgctgattaatggtgctgttaagaagagatccagctgctgctttcagtttcctcttcctgcagagatccttaattactgggcttcacctgttgagtttccttaaatgacatgagtgtgtatttttaagtgggaaaacaattcattaggaagtgccaacatctcagaggaggtaaatcctccagttaatttcagaaccacactgcttcagccacataagagagcggtccaagggggtactgcttttttctgaacgtcaccaagccaaacaaccaaccttcagcagatggcagggagcggccttgagaaaccacagggaggggtcatgagatcaaaccacccttagccatcaacctttagcatcctccctggttgcccctttagctcagcaccctgggaatgatgggtccacacagccatttaggtactgcttccacacggctgaaattgcatttgcattttattaaataaaagcaatctgtgcaaaagcctagcctaaagttactaacagatatttgagtctaagataatacatcttacagtattagaattcaggttctaagacaatcaccctcaaccattgtcaatctttacattagggtagatttttgaaacttcaggtccctacaatctagattctgatttaattagtctagggtgggaccctggcctttagtatttttttaaagctgcagccctcagtggtgactccaacgtgtagccagaattggaaaccactctaatttgtattttattttttttatttttatttttggaaacagggtctcactctgtcacccagggtagaatgcagtggcacgatctcagctcattgcagcctctgcctcccagattcaagtgatgctcttgcctcagcctccccagtagctaggattataggcatgtgccaccatacctggctaatttttttgcatttttagtagagacggggtttagccatgttggccaggctggtctcgaactcctggcctcaagggatccacctgcctcggcctcccaaagtgctgggattacaggcatgagccactgcaccctgctagttgttttatacatagagagagagattacaaaatactttctaaaggatagatcctgggtcttatcactgtattgctcataccaagcaaaatgcctggcacagagtgtgccaccgatacatgttttgtgcataaaaataaataatgtcacttgatgcttactagaggcaggagaagggacatagaaggagcaatggggataggtcggccaaggggtacaaagttaatcaggaagaataagttcctgtgttctattacacagtagggcgactggagctaatgaccatacattgcatatttcaagatagtcagagaagaggagcttgaaaatgatcaccacaaagaaacggtaaaggtttgaagtgatggacacacactggctaccctgtttgatcattatacaatgtatatatgtatcaaaatattacactatacttataaacatgtataattatatgtgtcaattataaatgaaatgttaatatgtcccttgattcttgtttgtacctttttccaattatttagccttacatatatatccatgtatatataaattttacataaatgcataaaaagtgagcattcctttgtgtgtgtgtgtgtgtgtgtgtgtgtgtgtgtgtgtatgagaaaaagagacagagacaagcagagagagagagagagaggcagaaacagagagagaggaggagacagggagagagagacggcaaactttttttgctaccaattttggctcatttgccctgcccctctattctcacccccattgccatctccccacctgctccaacacctgccccaccagaaaacctgtactgacagtccagtcagtggtcttctatatagtgtccatcctcatttaattctagacagccatacagacacacgagtgtgggcaatcattgttttatagaaatgggatcatattctaccaaccgttcccatgtattcaacaattccttgttgtaagccctccaagttgatttctcaaagaactaaaaatggaactttcactggacccagcaatcccatcgttgatatgtacccaaaggaaataagtcattctaccgaaaagacacttgtgctcatatctttatagcagtgctagtcacaatagccaagacatggaatcaacccagctgtccatcagtggtggactggataaagaaaatatggtacatatataccacagaatactagacagccacaaaaaaagaataaaatgatgttctctatagcaccatggatgcagctggaggctgttatcctaagcaaattaacgcagaaacagaaaaccaaatactgcacattctcacttacatgcgggaactaaacactgggtacacaaagacagaaagacgggaacaagagacactgaggattccaaaagggggaagtgaaggagggggcaagggctgaaatattacctattgagtaccaagtttgctacttgggcaacgagatcatcagaagcccaaacctcggcatcatgcaagatacccatgtaaaaaacctgcaggtgtaccccattaaactaaaaaaaaagaagaagaaaagaaagcccccaatacccctgatatcactcaccttcactgtccttattgggcacgtaccagtccataggtggaagccccattgcttagtcagccactcccccatggatgagcactcactttgcttcccatttctgcccgtcagaaataactcagccacaaacaggaggtcatctgatgcctgcaaccaccctatacagcacaaatatccatgtgaatctttcttcccatccgcagacacatagccaaatgcctagcaggccttacctgaccccactaaaacagtctttctggccagggaaaattataaagaattatatgagatcacacatacaaaaaaaaaaaaaccttcacagtgtgcagaaggctttgtgtcaaagtcgagctcgcacgtggccgtggccgggttctctgtggccagccccattcacaacacagctctggcagagcactcttcaatagcatcattaatagcccattgatccaattacatttctttctgttccacttcagaattacaatctcctgttccccctgaaagagcccagatagattcccagatgagtatcggaagaggtagctgccatcaggacttgcttgatggacccaagcactcatctaatagtggcactggaagaattaatctggctgatatatcagacctctctcctccgtgggaacttgccattttctccagcctctgagtttttctagtgagattcagagatacagccaaatgtgagttaacccagggacatcctaacactgccctcattgtgtgttcccagcatggggtaggcactccataaataatcgttgaattgaaaaatgcctaaggaggggtatattggggctcaaagcagaccaggtcggctgaagaaatgggctttatccagattgtgactttgcaggttggaccagaatgagagtttgaatctgattccataggtaatgcataaaatgaaaatatatactataaaaaggcaaagtcaagaccttgaatgatagctgagaaaaaagtagagagagctaaatacatattccaagtctaatgggcaggataatgagggacagaggtaggcagcaataggaccaaaatagcattcattcacttagtaactgtataatgaagacctaccttacgccgggcaccgtgctaagcactggggaggcggtggtgtagaagtcattatcccagccctcaattgctcatggtcttagggaggaggccaagacacaatcacattagagccatgaccaggacaggacagagctaaagcctatgacaaacataagcccagggaaattaaggagtatacagggaggcgcctaagccaacctggggaagtatcaaaggcttcctggaggaggaggatgaggaagaattagtaatgttgaatactggcaggtgaacaattcatactgtgagaggctgtggccccagtacccttgcatctgctctagactttgacttctacagtgagactcctggccaatgaggatctatgtccacagtccctgggggtcatcagccctgcactctcccacctccacatctttgtccatgttttttcctctgtatggatagcactctctggttccctctccccagtctgtaaaaccatcaccttcacctcccatcaaggcacagccccagtgctacttcttgcatgcagcttttccaacttcctctacctggaattaatctctgtctctttctctctctctctgaatttcaataacactttgcttgtttctctcttatagtacacagcactcttgacattgtattataattatttgtgtatttgtcttatctcctctgctaaactatgaactccacaggggcagaaaaaaaccttgtcttaaccacctttgtattccctgcagcgccttatacaaggcaggtgcttgatacaggttgaatgaagattatgtttaccaggttccaggtaagtggaaggaaattaaaagacagcccagctggaaacagtgggcaggcattacaggcaggcccagctttctaacagctatcataaaactggctgctcgctggagctgtgaatttcccatcgctggttagagaaattctttaaaagggagattcttttaaaaatggctgtcctagatgatgtctaagctcatctaattttcactaggttactacaatggagaatggttgatgagtaagcaaagacagcagaaacccactacacagtgaaataggaatagatgtgtgttattgtcaatgtgattgctcttggttgaatgatgagatcaggggtatttattagattattaaatttttaatcaattaaactaaaagatccattctcagagaaataatgacagtatgtcatgagcaaggattataactaacctaattctaaacatccgaggattttttttgttttttttagagataggggtctcatcatgttgcccacactggcctcaaactcctgggctcaggccattctcctgccccagattcccgaagtgctgggattacaggtgtgagccactgtgtctggctgagaatcatttttaaagtttgatttaaacaatcgcccatccccagatctgatttggggcatcaatggggccaaatgacatgggtttcctagagagcaaatctccggatgtcatacagatacttaaaaccttcaatggctccccatttccctacaacacattcctagtcctcagcttgatgtttgaggcttttaataatatagctcttgccagctgtaccttacacaacgccagacacactcagaccagaggtttcaatctcaagggcatatagggactcagtggagtgtgctgggccaggacaaaaccacaagggcatgccccaactcaacaactgagcaacttcacaggtccagcccctttgcccagcagaaatgcagactcagcattgcaagctcttctgagttttcaaaagaatcaggaaattaagatttttttttgtagaacctgccatttttcaatgttaccttaaaaatgcttaaacactttgtgaaaaatgcccatctgtggctcagatctctatgatttacttagactctattttttaattacttagatttactaaaaggtgctatgctcgcaccccttcaaatatccctccccgatgtttcctctctctaggttactcctctctgtctcctttcctggatttattccagcccaacctttaagactagcttctagttgcagtcattcctgcagaattaccaatttctttttactcttccatattgtcacaatgttttacaatgaacctgagcagcagatgctgtcagtgccctcccacatcccctcagctcccttgatgattttgtgcacaccagtttcccatgtgctttcactcccaacagcctcagaatattggaatccactttctctgaatgcacggagagctagaagcacctgggaatttatgttgcccaagagcagcccttagccaatgattgacaggtggaggagtttaaatacttcacctcccttgcttcttaacgggaattacttcaaaatatgctgcctccagatctcccctgcagattgagccacagttatcttctgctagactttgtttgctatcacacacctgcttgggtttttcctggaaacacttcctattaaactggttttaaatgagccctcatttcaggatctgcttctaggacctttgatagacagcttttgacatgttctccaatgatctccagcatcttctctgttaatgcccttatacaatcccctcaccatgagtgtgccatgtttctaaatccaaaagtgatgagtgtcacttccatgattgggatagaagagattgacttccatcttgccaccagactctctagattgtcttctctccttgtgtgctttgataatgcaagctgccacattgaagagacccacatggcaaagaaatgaaggtcatctctagtcaacagccaacaaagagctcaatgctgccaataactactgagtgagcttggaaatggatacttccccagtcagaccttcacgtgagaccacaaccttgcaccaacatttgattatagccttgtgcaaaaccatgaagcagaggacctagctaactcacatccatattcctggcccacaactataagataataaatgtgggtcagtcaagctgcttaagtcatggggtcacctggtatgtagcaacagatcccaacataagacaatgtgtaatatttctataattagaaaatattccatcctagatatctcctcctgaaagccattcctgagctcccagaccagggtgtttttgtcacctctgtcatggtcttcatcatcctgaatttaataattaatatgccctgcctccccatctttttctcccctactgatcaccttgaaggcagagctttcagagagaaaaggtctgatatatttctttattcatcatctaagcatagtatcatataggagatgcttaacaaatgtatattaaagtaattgatttgttaattgttttccatatgagattttggccaagtgcctccctatataccattattctgcagatgccaaatcaagggtaagggaggccttcaatattcagcaaaatctctactccatgcatcccccacatcattttctaagcagtttcttcctttccatcaccagggtgcttatcaattgtacattgacaattcctcccatctgttcaattcatctgttggatggtcactctctgccacttcagagcaatggggagttcactctgcctttcatacccctctgggaagcccaggaaaattatctctgattaatgtcatttcttcttttgggtctaatgacaaaattacagcaaaatccagccctactttgcaccacacttggaaaaaaatctgctcagcttttgtctgccaaccacagcaaaaacttgattaaccaggactcagtgcacatgggcagagggctttttccccccagttagcagagggatgaaactgaaaatcccatttatttcctcccttattaacagaaaaaaagaatcaatagcttagcccacattgctacccactgtcaataaattcccccaaagaaattgagtctctcttggaaagatgagcattcttgcaggcctaagaattgtgtattctgggactaaagatagtgttagaaattagactgaatcagcagagatctttggcatgtggaatttttatttaaaacactatttgctatcacttatattcccgtctttgcccttctcccagaagcaaagtataaaaaatgtgtgttctcatttttcaagtgttccagattcctaaagtccagttcatataaattgcagcatattcttatttatatgacagagactgtcacaggcatctaagctcaagcttattaaactgaagtttcctattctatctactcaatgggttctcatagtctcctaagcatctcatcatcttcctcctccctctgagacatgaaactcctacttggaaccttttcaaggtctacggcattgtgcaaaaagaaaaacctttcttgttatgcaactaacagatcctttcagttccaggggaggaaggagccaccagaatggtcactcaataacttagccaagtttcaactctgttttaagggaaaggaattgcaaagaaaggaaacattcgattattgagcactgactatgccaggcactgaattgagaatgcattttttactcctaatcatagcctgaggccctgcacgatctggtccctgcctgcctttttgactacacctctgaccatgcccccacatcacttaatatgctatacccacactggccctttttattttctagagcatgccaagctcttcctaccccagggcctttgcacttgctggtctctctgctgagaatgcttttgcccagatatgtgcgtggctcactccttgtcattcctcatttcttaattcaaggccacctccaaaaggtaatcccgaactaagctgtccacctcccatgctaagtcattctttatcttgttcctttattgtattttttccataacacatcaccattttaaattaacttagttattgcctgcctccccatgaatatataagcttcatgaaagcaaagtgtgttcctgacttactcactattgtgaaaccaacatgctagcacatgcctgccatataatagaatctaaaaacatttctggagtggatgaataaataagtttctctctgaatcctgccaagataaatattgttattatccccgttagcagataaggaagttgaggttccaagcagattaggaaatctcacaagtttgcacagctagaaggtgctagagcaaatcttacaaccacggaactgtctaactccagtgcatgcattctccatcattcctagacactgtgtgggaagacaggagattatagcttaatcaattgttttctaacttctgttcatgaaaaatgtctgggcagctgtgacaaggaaaaaagtcttttatcagctcacagttgtgagtgtgacagagcagggatatatcttctgcatcaaacattgccagtttgtcaaatatcagaatagaattgaattttaggaagccactatttctgatgcagctgtttcttttggatcctctcaatgggcagagaagatcccagcaatagaatgggtgaggcacgcatctgtctattaggatggttggaatgcatgaatttgataagccctatatttggtgagggatgtctgtcctcaccccaaaccttctcaccaacgtgacctcccgccagcatggaagccagtgttacaacattgtgagaactgggccctgcaactgtgctggtggccatttttctgggaccctcttcttttactgatacctttgggagtactcccatattcatttccgttgggcatctcattcgttgctgtaattcttgtcttcagttcaaagctcaaaagcctcaccataaagaactgggttttactttttggatcttgatccttggggaaaccccctaaaaaagtctatatctactatatccactccccatcttccagtcatctctgagcatggctgatgtagggaattgctcaacacagtttcaaagccccaaacaacaagctagctctggacatgcctacctgctatggtttgagttcagtttgtgtccctccccaaaattcatctgttaaaatcctaatccccaaggtgatggtattaggaggtgaggcctttaggagatgactgggtcataagacaggagccctcatgaatcggattagtgactttataagagatcccagagagatctttgtccctcctatcaggtcagattatagtgaaaagtcatccatgtaagaaccaggaagcaggtcctcagcagacactgaatctgtagataccttcatcttgaacttcccagacctcaaaacagtgagaaataaattcctgttgtttataagctaccaagtttatggtattttgttacagcagtccaaatggactaagacactacccccattctatttaaaagaaaataatctattagctcaccacatttactgtgctgaaaatttccaaccagaagaaaaagctttatggaggtgacccaacgatatggaggtgcttacaaccccatgggtggctacaagaatcaaagagagaaattatagttcaaaggcaaaacgtatactatctcctcatccctattttttcttggtttaagtcatttttattaagagagtcataatgttctttatctacatgacactttccatctttaaacattaactaattaattgactgaaatggtatctcgggagcatttatcatctatcacattagccagagagccagggaactgtctataaaagctgttgaacactcagtggaggcttcatctttccgcttcctttcccagaaatgtttttttgtgtgtctgcatatgaatgtgcaatggggaaaaaaataaaaagagaggatttgacttccaccaactgctataaaaatttacctctgggagacatggaatttcaattgtgaaataatcagtcttggaaattgtcctgtcctccaggaaaagaaaaaatatgtagtttaacagcaattgcccttcaaaacaattactaattataacatctataaagaaaaataccctcgataccattactcctaataaagccaggcgaatctatagaaaggaattagctggcatgtctaaaatctgacaggagagctgttggggatgggtcagaagaggagtgagctccaaccagcttaaaaacctggatccaaagctttaggaggcttaccacctggagcaagcctctcttagcaaattggcaagattagcacaagaaatcaggccaggacaattacaaattgagaacccaagtcatttttcctgactttccttccactctatcccatcccagctttctccatgaacctcttaacctcctcttcaagcagatgtcacggtacctggaactcatgccttacagctcaccatcttcccttcaccacagtcctcttaaagacatatgcccaggtagggttacaccaagcccctgagcccttggattgaatttgactgtcagatcctaactgtttgaaacaacatatgtcatggaggaaggatcttggaggaaagaaagagagaaaggggccacagaaaagagaagttggtggcagtgctgaagatagacaaatggaaaaagtccattctgatttcaaattctccatcacttccctgctgtgaaggctgtgtcaagttgatttgaactctctgatcctctcacctcagtttctcaaagtgaggggaaaatatacctgaaagcctactttttaaatgagtgttcagttgcagacaatggaaaccactccagctaccttacgcagaagggaagtgattaccagatgtaagctgacttaggaaaccattggaaggacccaaagagttggagcttccaagaacaattccctggtcccccaaatcactctgcctctgctatgatggtgaaaactgctacctgcactacgagaagtcaccacatcaggaagctaatggctgcagaactacccagactctgcagagatccacaggagcaaagtgaatggcattatgccattttcccctcttaactcagttataaattcaagacgcaaagagtatctgatttgcagaacctgagtcatagtcagaatcctagctgcaagggagtccagtatattgaccttttagcaacccagcctctgcagtatagaatgacacagttgacagaggctggaatggaaactgaaggagcccatgcacaaagggcaccacccacatgattcagggctgtcaagagaatcaaatgagatggtgtttacaaagcacctaatatgctgcctgatcattagtagcttctcaataagcactagttttccttcactttcccaaaattttgctgcagcttggccctctgaatcatcctaaaagaacagaagaaaaaacctggaagcagccaaatgaccttcctaacttaaatgtgagggttttttgggcatctttcatttagcaaccttaccaaacatcagttatctctatttaaggcattcccctacctccacagaaagaatgaatcattttaagcagtagtttaagcttttactctatccaaacaaaattggcgaaagatcctctccctggataattacattaacattatttatctaaccactatttttctttttctgagatggggtctcgttctgttgcccggaactggagtgcagtagtgtgatatcagctcactgcagcctccacctccctggctccaataatcctcctgcctcagcctcctgagtagctggggccacaggcatgcaacaccacatttggttaactttttgtatttttggtagagacagggtttgtccatttgcccaggctggtctcgaactcctgacctcaaacaatccatgcacctcggcctcctgaaattacaggtgtgagccactgcacctggccaatctaatcattatttactggtcacctactagttgcctggcagatgtgattcctctccttcaaggagttaacagtctaggcagggtaattgtgcaaaacttgtaagattaaaattctgataaaacattaagagaagagatcagagtgccataagccagaataaagagggtgaaactgattctactcagggagtcaggaaaaatctccctgaggaagtaatgtctacactaaaacctgaaggataaggaaaagttaacctagtaaagagtgggagggaagagaatttctggcagagaaaacagcacatgcaaaggctgagtatttaggaaaccagaagaatacctgtgtggctggagtatgttaagtgagaaggagagagaaacgataattactttggctatggaactccaggctattatctggggtgacattttccctcaggttggaatccagatatgtgagacaattaacatttcataaaaataacttttgaagcaatgtttgtccacctttctgtatctcagttgtctcctctgtagaatagtgttaacccttcactggatgatcatgagtgttaaataggataacaagtatacgattatgacaagaaggctgggcccttttgagcacagcagcgacatcctcatcatcttcttcagtgtttagccataccactccagagagctccaccaagaaccagagaggtgcttccctacctgcatgacttctctgagatgctctctagcccacacacagcagaggcacccacctgacaccttcacctggccacatctgattggaccagagtgtacacctcctactacccggacctatcatattcctacacctgggaaactcttacattcagatagaggcgcaattgatcagagtgcattagaagctggagctgtaaggtcatgaagaagaagtcccagggccctgggcaagtagaaactgggaaacagcaaaccctgagattccaacggcaggcgccagtctgcagagaagagaatggagcagatgtgcagaggtaagctccagagagtgaaatggagaaagcggctgattaacaacattccaagtcccatgaggtccagctgcatacgtcggatttccagagagccttgtgtgtccagacagtaaaatttcatatccactttaatctctttgaatgggtttctattccttgcaattgaattatcactgtctcagaggcccatcaaagtggagagctgaggccacccttccttaaatcagacctaaaatgtaaccctatcttgctaacaggacataataccggaactgaggaccccaccaccatctcaaggccttcacacaggctattccctttgcatagaaagctcttccacccgctccttttgcaaaactaaatctcacttatcttccaggctgccccctttgagcatcgcttgtaaagactcccactccaaagtggacccttgctgtggtttccatagctctcaggacttccctttgcattgtgtaactcactttggatcactcgtaagatggctgccaccctaccatatgtgacattccacacttgcatcctgtttcttgcttattccccagggtttgagtgggggacacatagtagctgcacaataaacatctgattaatgcatgatggatagtctaaaaggatcaaattgacattctactgaaaaagaagagtttcactttagcctactaggtgctctactctatgcaaggtgttggaaacacaaagatgaattagacatcatccctgtgtttaggtcttgaaaagcctaagggaacaggtggataggtagataaatacgtttatgacaatgtaacaacgtgagtgttaggagagagagagactacaataggtgtatttctgaaggttttttggatgacaggggaagagagagagatgttgtagagggtcctagtggcccccacaccatcactcctcagaatttttgcagaaaacaaatgtagtgagcatctgattgttggctgctcagcatctactctctaattctgaatatagcacttcatttttccttttggtaaagcaccttcctgccctctcagcccaccagcacactggtgtaactggtatcaattcaacacctctgtccccagagtcaaggatggatgtgtgtcccaagcctagtcaatcagaatactccatcctcacaaggagtggttcagggatgatcatgtgacagtttagttaaatgagagtcaatctgggagtgtaaattagttcaactattgtggaagacagtgtagtgattcctctaagacctagaggcagaaatgccattagacccagcaatcccattactgggtatatatcccaaaggaatataaatcattctattataaagatacaggcacttgtatgttcactgcagcactattcacaatagcaaagacacggaatccatctaaatgcccatcaatgatagactggataaagaaaatgtggtacatatacaccatggaatactatgcagccataaaaatggatgagatcatgttctttgcagggacatgaatggagttgaaagtcactatcctcagcaaactaatgtaagaacagaatatcaaacactgcattttctcacttataagcaagagctgaaaaatgagaacacaaggatacctggggggaaaaatgcacactggggcctgtcagtcagagtggtgggggacagagagcatcaagaagaatagctaagggatgttgggcttaatacttaggtgatgggataacctgtgcagcaaaccaccatggcacatgtttacctatgtaacaaacctacacaacctgcacgtgtacccctgaacttaaaaggtgaaaaaaaaaaagataagagtatatctcagaattcctagggagaagcaaggagaaagataagctcttctgtcactagaacccctaacctggcagcagccttcagctgagctgctgaagcctgtcttgggactacaaggggaaaaaaactccccaaaaataaatcttacaaggaaagtagcaggcctgagagaaaaagccacttctgatgtcagtttgaacatctggatccaaatagattcatcctggatttttcagttgtgaatcaacaaattctactttttctgtttaagcttgagttcctgaacctcaacactattgatagtgtttggctggatgggggctggcttgtacattgcaggatgtttagcaatgttcctggcttctagagccattctcacccacgagtcatggccaccaaaaacagctgcaatcattgccaactgtcccaaggggcaaaatcacctcctattgagaaccactggtttaaaccagttttcaggttcctattgcttgcaaccaaaagtcacgagcatacagtaacctatcaaataattccctacccaatttccaggaataattctcactcctacatgcttttactttccgtggtacctggaacatctttctatgggctttgctttccaaagccagtctgttgattttacattttttaaatattggtgtcaatgaaagtaagtcaatcagatcaagaacagcttagctctcagtcccagcagtacttgtacaagtgacatatttggggacattgattatactttttcttcctcttaaaaatttaaacatcttccctcatttactttctttattttagaattctcagcagtcaattttcttttatctacaggccttcccttcgatgggaaactaatcaataagaaattagatttttgccaaggtattttaaagtaatgtaaccagcatatttttctctcattcatgactttattattgtgaaatgaaaacagaaataccacatccttgaaaccctcattttattaagctccatcacagctaccttcattcatcggagccatctcttccaacgtcattgttttgggtgaagcttgtgtttgatcaccaacctcatattttaaattgaaactcagctggagtagagttcttccctctgaatgagggatagcagtctggtaattagcagcaaagctcaagcagacaggctgcatccacttattctatctgaaattcttttccttttctttttttttttggccagtaattactcttatcttggtgaagctgacccacctcttggcccctcaattggagtctccctttcaagaaaatatcacattgtgttgaataagaaaatcaaaatggaaatgaagcttcaagaggagtctagctaccatcttttcaattgccttttgaaacatcagctgggtggactttcaagacgcaggcacagttagatatgtggatctgtttcttagattgcacttgtgtatctgaagacatccattatgcctaagagggaaggaaatgagcaaggacttcccaatgcatacaggtgcttcgtaacacctggtgatcttgttactgaaacaccagaggttcagtctaggttctaatgcttgctgcacagaaagccaatcactgagacaatgagtattgccagggaagaaggcttcaattggatcctgcagccaagaagatgggagatcagcatcaaatccattcccctagctgactaaaattaggtatttttatagcagggaagaaatgtaaccatttgtgagaaaacaggaattagggagaggaaaggaagaggagtttgtcaacaagaagcaagtggttgcttaggcagtcatgatggatgaagggtcgggtgctttcactgtccagattcagagatctggtgagtttcagctccttgattctatctgggaagcctgatggttggaggcctgagaaaggaactcagataagacaaatgtaacttttgcaagtttcaagactgggatggccaatttctatgtgtatttaaaagaaaccataaacatcagttctatgggacaattgggccagtttcagttcggctcagttttttggcatggaaaggaggaagagactatcaataatattaacagtatagctatattgatcctttattagagggggagaaatctatttatttgggagagtagcttcaaagtgtgccaagtcagggaatcaaaggcacattgggaacaagctgaccaaacatcaaccagcatgaacggtcttgagccctcaagaccaagatgagccaagaacccacttcaagtttgaccaaagcagacagtaaataagacctccctgtaggaactccgctcttgttgcctaagctacattccaccttccacactgataattttatcacaaaaacaagcaaatgcaaaggaagaaagtagtgatatgataggatgacacatgatctagccaattccatctagaaggcaaataaaggacggaggcttggtgagattaatgcatttattctttccagaaattatagagcccttactctttgtctggtactgttctaggcttggaatacaagcaaagatccctgcagttgtggggtataccctgtaacaggtgaagagtgacatatcagaggaaggtcagtgactacagatgaaagggattgcattgtaggacatttcccatgtcctacaagcctcctcctgcctttggtagaggtgagtgtaaataaacaaaatgtttcctgcactcaaatgccctcctctattttatttgttatgggagcaaacttccatctccaggacagcagagtgtagagcatcttctggtgtggtagctgtggtgagttagcttgagctgaagccaatgtgggcaactgtctacttaaataactcacctattcacctattcctggctgccatcaacaaagttggagcctccaagaagcagttaggattaacatattaacacagaagatggtcttttttttgtttttttttttttttgagacggagtctcgctctgtccctcaggctggagtgcagtggcgcaaactcggctcactgcaagctccgcctcctgggttcacgccattctcctgcctcagcctcccgagtagctgggactacaggcgcacaccaccacgcccggctaatttttgttgtattttttagtagagacagggtttcaccatgttagccaggatggtctcaatctcctgacctcatgatcagagggcggtgtcttagtccatcttgcgttgctataaacaaatacctgaggttgggtaatttataaacaaacaaaggtttatttagctactggttctgcaggctgtccatgaagcacggtgccagtatctgcatctggtgagggcctcaggctgcttccactcatggtggaaggtgaagaggagctcgcatatgcagagatcacatggcgagaggggaagcaagagaaagagggggaggtatcaagcctttttaacaatcagctctcacaggaactaatacagcagtaactcacttataaacatgaggagggcaccaagccattcatgagggatctgcctccatgaccccaacccctcccatgagtctgccacctccaacattgggatcaaacttcaacatgagctttagggggacaaatactgagacgatagcaggcagtcagcaaaaacaagaactagcatgtgttgagtctgcttgattcatcctttcacatatatcatgtctcatttcacttccacaacaattctatgaggtatgtatgtattagccccatctcacagatgaagaaactgaggctgagagagactaaatggcttgcacaagatctgtctgactccaagttctacaggctttctgcattgttgtgctgcctatttcacccaataaagtccaacccatccgcatgagagtgttaataaatcaataacctgagtacttcctggggctggctctgtgtctatccctagattgggcactgtgaggggtatgaaattaaggtacagtctttgttctcctgagactaagttagctaaggaaacaaagggaaaagcattcattcaatatttaacgaaccataccaacactccacccacattcaccctatcttacgcaaatacttgtggatcccaaaacgtgccatgcctttgcacaagtctgcaatgccctttcctctctcctctctgcttcaacctacatcatcttcatctcgcaagagttagatcatccagaaagcccctctaaacccacaggctagttggtggactttcttctatgaattccatggaccctggtgctcctctccgccataaaactctctggaaaaaaaatcagtgagagcttcagaagttagggaaccctgtaagtgagatgactggggagaaaacaaaagcctgagatggggaaatggctaaagacaaaagaggaaggaatatgtatgtggcccaaggtggtatcatctacaacagaaaactgacagccaggtaagggactgtatagagctagggatgttgtcacagtaagaaatagaagatatcattactcaaagccaagttaattacgatgttctgctttcacttattttttctaagtgcttccacctctggaagcatttctgatcagcacaactgtgaggttggtagtaggtattatcattcccatttagtggaaggagaaactgagatgctcagagaggttaggtgagctgcccaaggacacacagcatgaagacactaaggcagcagaatggttgagatcagactttctggtgtcaggcctacagctctcaaccacctggccatgtgaccttggacaagagacttaacttctccaagactcagtttccacacctaataaaaggggactaaagaatctctacttcgtagagatgttgtatggtgacataatcatacgagacctttgtcagtccttgacatatctgtaacaataaatctttgttccactcatcaccactgcttttgtttcgctgggatcatctgcaaaaccgcttgtgtgaaactctggtcccagctgctctccagggacaccagggcttccttgcaaaatatagcagccaagatggctttgggcccccaagtttctgagctcttgtttgactgcacatccccttccttagaaagccagcatcttcacgtttcctttctaagctgccaggaataaatgccaggttctggctttatggaacagtttgggaaataattagtttgccttccacagaggccagagttcacttctaagatatttaaaactctactgatggcttaaaataaatatcacaatggagatgtcaaaatatctatgtgttcttacacatgacattggaggggaggggagactaaaaaaatgtaaatggatttaccaaaataatctcgaggtaagacctttgaggcttgataccacagaagtgccatattgtttttaagtttctttttttttcttttgtaagtttatttttctcctcggagggcactgaaagttttgttgtgagaagcaataaagttctgttttccaaaagaaaataaaagcatgattgtatttttaaaaatcaatcttaataatttccagccattactttatgagcttaatgcaactcccaaacactgataactgatttctccaactggaagatgcgaagcgcacccaacggatgccaagttccgggctgagtactttaaatatttattgaattattaatcctcataagtgctcagtgaggcaggaatgatattcctcattctgtaggggaggtaatggagaccctcaggtacttgcctaaaaacatggggataataaagcagaaagtcaggattgaagcctaagtgtccttatcctgactccatgctctttccagtgagttcttcgccccatccagatctaggagtgctgaacactcaacaacattatcaggcaagacaacaaacacacccgtgtcaactggagtttgtggctagtataaagcaatatagagtaaatctcaaagagaagtaggtcaaagaaatacctacaacctcaagaatgtgtccttttctggctgggagcagtgcctcatgcccgtaatcctagcactttgggaggctaaggcaggaggatcacttgagcccaggagttcgagactggcctgggcagcacagcgaggtctcgactctattattttttaaaaaatagaatatgtcctttcccccttgcctgcctggataaaaccttcttttttatctcttgctgcttcccacttcgcattttctgctctgttaaacatcaaaccgcttctgttgcccagaactatgtctcaggttccacgcaactgtgcctctgcaatgctgtgcctttttcccaaatgctgttcctctacaatccacttagcaaactcctgttcatccatcaaaaccctgataaaacataaccttttaaaagaagtcatcttcatccctctcccacttctagacccaatggaattcacacgttcctcttagtcttctctccatagcatgtacatgcttacatttttataattattgcaacgtctgggatttgggtctctgggttagttgattggtttggctgatatatcagtctccctcacccgactggctttcctataggcaggggctatgcctgaatccacctttgtatcctctatgcccagccctgtgcccaagtcaaaacaagcatcgaattgaattgaatcaaaattgaaaatgaaaacaaatatcttggagaactagaatatagggaaacaagtgttaatgttgtaagagtctattgcagagcaatcaaccagaccatgtttccctaataccgattacaaagctggcacagaggcaagacggagcagcagtggggatttatgctctctggacatctgttgggcgtctcttctgataaatcctcgccttgccctgctgatgatctcatctttcagaagacagaggaagcgacagaggaaacggttacttgccactaaatcctggcaacgaggaaacactggttaatgagaaaagtggaatcgttaggagaaaaaaaaatgggcacataatcctagagttaatgatggtgcaagaaaggaagaaagaaaataagcacccattaaaaacctacagtgtgccgcctactttacgtgtgttactacatttaattctcacaacaaccctgggaggtgggtttcagtcacttccattcacagaaaagaaagccagaaaatggagaaagtaacttgcccaagctcataaaaggcaagtctatctgcctgcaaacccccagttctaacctcacaccaggctgctgagcaaaaaaagcaaggcattgcctgacttcaaacctagagttgatgaataaggcagcgtcaatctgtataggctaggtaatgatacagtaacaaaacacacacacacacacacacacacatatacatacacacacactgaaatccaaatcacggtcatgtgacacgatcaagctatttcttccagccttggcagctttctaggacaggcagccaccctcctttgtgtgctggctcagttctccactttgcttccacctcatgaggctccatctcaacagatgcttcagagcttgcctcattcagggggaaaaaaaaagccccggaggatctcaccccagtaattaaatgctgccacccagaagtcacatatgccacttccactcgtgtggcacaactcaaggccaaggggcagagaagtgcaattctccacccagaaggaaaacaagccagaaatggttgtgcaacgaaaattccaaccacagtagctttttgaaagatgagaaagcaagcttccatatgcagcaatgaacactggccaagcccggcctctgtgtactaccaggggagagaggagaaacatgaaaacaaaaattaatatgtagaaggcaatgatcaaaaagagagagacaaagggagtgatgttgatgggagaactgggttatggaaaaggatttcacaagaatcaccaagcacatgtggaaggtcagtgccatgaacaaggtccccggacacaacccaagaaggaaatattgtgcaaaatagattggagtgccttcgtcagttcaggctcctataacaaaataccacagcctggggcttaaacaacagaagtttctttctcggagctttggaagctggaagtccaagatcagggtgccagcatggttggttccagtgagggttcattttacggtgtgtagacagcaactttcttgctgtgtcctcacttggcagagagggagagagcaccagcctctttctcttcttatagggacactaatcccattgataagggctccacccttgtgatttaattacctcccaaaggccctacctaatatcatcccagtgagatatcatcccgttggaggttagggtttcaacacatgaatttgtgtgggggacacaaacatagctccatagaaaagagtctcagaaattgtgtctacccattcaatttttaccattcaattccattcccgggaattaggaagaagcaattaataggactaataagagctgtctggaggctcttattgacaaggctgtgagcaaaggatacaaggtgggacacaaaactgctttgaaaatggaagcaagatagcctgatagaaaaggcactgggcctttgccactgtcctctgtggctttataaagttacttaacctctctgagccttggtttgcttctatgtgcaacgggaataatatactatctgcctcaaaaggtagttgtgaggattgagaagatcctgcaggtaatatacacatcaaagtgcccagcaagatgttagaacaaggaaaacaatcataagaaggatgagcatgacaataaactctccaattggataaattcaagttggttgtctcaggaaccatctgtcttgtaactctctgacttcatttcccaccaccctattattgcctgaatttgctgcattgatcttttttgttcttttttttttttctttgagacggagtcactctgttacccaggctggagtgcagtggcacaatctcggctcactgcaagttccgcctcccgggttcacgccattctcctgcctcagcctcccgagtagctgggactacaggtgtccgccaccacgcccggctaattttttgtatttttttagtagagacagggtttcaccgtgttagccaggatggtcgtgatctcctgacctcgtgatccgcccgccttggcctcccaaagtgctggaattacaggcgtgagccaccacgcccggccgaccctttttgttcttatttgatcattccaggaatgctcataccttagtgcctaggtactgtggggttctctcttcctagaacacttctcagaaaatgagagaatgtcttgttcaagtgctattatatttactcattgaaaccttccataattacctacttgaaattatagcatccactccactcctcacactctctatcctctttccttcctgtattttcacattggtaattatcatttcctaatatacaaaatcatatacacttttttattgtctatccccccttcattagaatatattctgaaacttagatgaattctccagccaagaaaaacatctgacacatagtacgcatttatcactacgcatcgtttttgttgttgttgttagagcaaccctgcatttctctactctgatccattacattttaattttatattttagcaacagggaatgccttatttctttgtggaggtttttttattttgttgtttgttcttctgttgtttgtttttttgtttgtttgtttttgagacggactcttcctctgtcgcccaggctggagtgcagtggtacaatctcggctcattgcaagctccgcctcccaggttcagccattctcctgcctcagcctcctgagtagctgggattacaggtgcccaccaccactcctggctaattttttgtatttttagtagagatggggtttcactgtgttagccaggatggtctcgatctcctgacatcatgatctgcctgcctcggtctctcaaagtgctgggattacaggtttgagccaccgtgcccggcctagggcatgtcttatttctatatactccttctacaccttttactctggcattgcaaattcctagcaaaacatcctgaagggttcatgctgaaagggcaacctactcttcccatactatcttactgaaacttgttcttacttcagtcttggagctgcccattacatgagccttgcagtggcttggacatcaacctgtgagaagtcgccagcatccaaaatatctgagactcacagaagactcagcataagctcctgtaacgactgtatttcctcaactgcaggatcaaggtgtggctgtgaatgtcactctcatcagtactcattttgtactgcttatggtttgtttgtttgtttgtttgtttgttttcagggaaatgaggttgagatcaaaaccaggacccagctcatgtgattctgtatcataaagaatatggaagtacatgtatggagctctagtgaaatttgcttggactcagttaagatgcaatggtttgcaagtagttataacacctcaattcctgggacaacttccgattacttttagaacacagagacacaatatgggcatcatttcaatatcagatcttatttgtctgaaaataccagatcactagggcaatgaaataaacaaccagctacaaaccagctacaaattatctagagggtacagcctccattctctacaggaaaagagattcacattcttagtaccaggcccagcaataaacaccttaaatattaatgttattccatttcatatccacaataagcactacggcaaggtaaattctatcggctccattttatttttaattgcccaggctggaatgtagtagtgcaatcacaactcactgcagcctcaacctcccaggctcaagccgtcctcccacctctcagcctcccgagtagctgggatgacaggtccatgccaccacacccggctaatctttgtattttttgtagggacagggtttcaccatgttgcccagtctgctctcgaactcctgggctcaagcggtcctcccgcctcggcctcccaaagtgctaagattacaggcgtgagtcactgtgcccggaggccccatttttcaggcaaggaaattaaggctcagaaacactaatatcattgcccaacttcatgcatatagcaaaagacagggttagaagtcatagctatgtcttcctgactctagactgtgctttttccactacaagggatgaaattggggaaaataaactgctcaaatgaataaaatgctcaaataaaaaaatacaaataaataaataattttatattttagcaacagggaatgccttctttgtgggtttttttttattttgttgttgttttttttttttgagacggagtctttctccatctcaaaaataaataaataaataaataaaaataaaatgctcaaataaataaaaacaaaccaatgaacaggagtgctggtagacctgcttctttgcgactgcttaatggcttaaagggccattcatttggttttgaagccaccaaagccagggcaaggtgaaacgtttagtccaaatgggtccctcaccccatttgggaaccaatcactgtcccctatagacctagttcattgaaggcatttaactgaatccaatcatccacattactaattgacctccacaagccaacaaaagaaaagatcggttcatccaattaaccttgggactagctcacccttgatctcaatgctcatccagatggagagaagtcctctgggccaagattgggaaactgagcccccctttctcaaagctggcagctttttaaaggccaccaactccatttcacaagagatgaggagagacagatggtgaatagagtacctgcaaaaactcaaagatacacaggaccagtgtagcaacttgcacacttgcaacttgtatttccccctttttcctcccaagtagtctcagtctcccaacctgattgtcttataagccaaaacagcttttgcgcagcttgatagcctcagccttgatttttaaatgactagaaattcaggaggcaaaagagcgatagtcttagctcaaaagtcaaccggacctgggtttgaatcccagatccacagcacaacagctgcaaaaccttgagcaattagtgatatctctaagcctcggtttcttcatctctagaagggaaatacaaacatagtgtcttcctttcattaggttgtggctgtgaagtgaagaaattacaggtaaagccttcgacatggggctcagcacacagcaagtactcaataaatgttggttatttattctaaaaaggaaaaaagttagctagtctataaattttataggtcaacatcagtactgaaaatgactattcaccatactctgaatcttctcttgatccgtgcgcttgtaatttctgaattttaagcttctcttaagtccttattggggagtcccttgggatagttaatgttctcccaagactatctgcattgcaccccgcttatgttccttctagaaatataatcaggatgagcctggaaaatctcatccacatcatggttttagccatcgaatcattccctcaataaatacgtattaatcatctattgatcaccaattactgtgctctgtacacagagctgggcactgcatatccagctcatctccactttggtggccaagatactggaaactcaaactgtccaaagcttgatgccatgggctaaactgtatctctaaaaattcatatgttgaagcactaacacattggagaatgtgatggtatttggagacggggcttttgggaggtacacaggtttaagattaggccatcaggatgatccttatgacgggattagtacccttgtaagaaggcactagacagcttgctcactctctcttgaccaagtgaggacagaggagaaaactatcatctgcaatccaggaagagcccctccccaagaaccgaatcagcaggcaccatgatctcagacttcccagtctctagatctgtgagaaataaatgcttgctgtttaagccatttgatccatggtattttgttaaagcagccagaactaaaacacttggtttccaacttcatcttaaaacatgcttctcccctgtctcctttcttggttacaggctccactgaccaacccaaactgaaatcatttgagactttccctccctcactctcatatccagtcagtccccaactcttatttgtgggttctagatttgaaaaaaaaataaaaataagaagctcttccatctttataaacagagctttttctccattcatgactgatttctactcatcctcagggctcatggtgtctcctctaaatcctccagcagtcttcaaggcggtcttattactttcactcttccctagtagagtccctgccgaaaagccattttctgaaacacaatcctgaatctgccccttttctgcttaaaaaccttcaagaattcacaaaacctccaggatatagtctctgctcctcagctgggaaatcctaccataactgagccctggcccccgcccagccatttctcaacaagcccccttcactttagattcctcagcctaattgcaacatccccaaatggtccaggtgctttcaaacctccacgcctttgcaggtgctgttccttctgctccaaccccctctccattccttgactgctgatcctatactttatcctcatctttcataggttcaaatccccccatgggccattactgagcccccttcccaggctgtataaggctactactttcctctctgttccaatatattcccactataataaatatgacacagtctattgtaacttgttctttccctctttctctgtccctcctccgcataaccagatggtcactcctttgagaatagagagatcctgtcttatttattttcaatgccatgcaggttttaaggataaaaatcaagaaaaaataaagttttggcaactgtgctaaagccagagatttctgaaaatgactgtttaatgcataccatggggataattataacgataataacaatatcaactattttaagtgctaaatatgactaaacattttataggcatagctcatttaatccttttaaccaccccaggaagaagtattatttttgctctcttgttttttggatggggtaaatgaagcacagatctctctttctctctctctctctctctctctcacaaacaaacacacacacacacacacacacacacacacaatgggtttgggattcagaaaggcacagttcctaaactggctctgtcatttatcatctatgtgacctgaaggcaattcacttaatctccatttgtttcctcatctctggaataagaaaagacttgttgtggtaatttaaaaagactatttacaaaagtattgaaccaggagcagtggcatgcacttgtagtcccagctactctggaggctaaggcaggaggattgcctgagcccaggagtttgaatcctgcctgagcaacatcatgaaactgtctcataaaaaaaataaagtttaaaaaaacaaaattaaattgacacatagtaggtactcagtgatattgtctctttctccaaacacttacccagacctgtatgcttcaggaatagtattaatgtcttaaaccgggtaactagtctgctgactggctgagattcaggcatgtcagtatcgcttggctccagcttacctaatagactagctctgagtctgtctccatccatgtctcccacccacacaactctagcctcatggataaggtgaggctcagggagtgtgacctgggacgaggttagaatgagcatgactgccatgcagtttgcttgataacttcgaaaaagctgaaagcttagcagtttggttttgaggttgtgatgcaaacgtgtaagtgttcgatgtgtatttctgtcaaccacacctgaaaggccgtgtgcaacaccacgtgcccaggtgcggaagctcagagacttgacgtaggcgggaatttgccgtgatagcatttaagcagccatctgttttccaggagattctggagccaccttccccatcaagcccccctttcccgtcctcacgcacccccagctcctcactcaggaatacattgacatttccagatgtattgattacaggggcagactagcttttggcgggagaagggagagaaatggattgactttattatttgtgggtggaaaaaaagaataaacaagggtgcttttgtttgaaggacaaaaccaaaattatcggttgaatggggctgaattaagcacttaaagttcaatccttccagagtgctgacagtgcacaggcggagatcaatacagaaactatttgggccgtggggaacctgggccctgcttattaaccgctaattataccaagttttctgccgaaatgggttagttcccttgaagattacgatacaacagaactggttggcactgtcggacccgggtctgggatccaacccctggagcaggaagtccaaggttcaggataaactcccaaaggccttctatttatggagcccacttcccaatttgccacttgcaaatcagggtgtagacagcccaccactttcttattagaattttaaaataagactgccaacggcaagacggatatttcactagggctttcagtacggccacaccagttgttcaaaacagggacactctcccacgccagtcgctcagcaacctcccctgctacctcacatgcccctcactctcattatccaggcttaacacctggccgagcaagggcctgcggggcccgctccagcatccactctggtgaatctgtgctcatgccctcccggtgctcaaacattttgagcacgaccctgaccacaggcaacaactttccataatccgttagtcaccagccagtctacaaacccagatgccttcccgtggggagggggatattgattgtacatacacaatgtcacacacacacacacacacacacacacacacacacacactatataaatacacaactgcatgtatatgtatgtagttatgtatatatacagttatatataaccatataaaatatggaaaatttatatttcatattatattccattaactatatattaaatatgtatatatactatatatagttttatacacttaatatttaacgtactaaacatttaggactaaaactaaatatgtactatatgtatgtaactatagttacatatagtacatatttagtactaaatatactatatatactaagtatttacatatctagtatacataaatactatatataccatatatatttatatataataatatataaatattgatataattacatataatatatatttggcactaaatatactatatatgtatagatagtatgtgtatatataatatatactatatatgtgtgtatatacgatatactatatataatactatatatactatagatactgtatttagtatatactaaatttactaaatatatattcagtatatactaaatttactaaatacatatttagtatatttagtatacataaatatttatagttacatatagtacatatttagtactaaatatatactatatttatatatttagtaaatatataaatgaacatgtactatatgtaaacacatgtaaatatataaatgtatatattaaatatataaatatatagttacatatagtacatagtatatatgtagttatatagagtatatatagactataaactataactatatatatatatatgaactatacacagccatccctcggtatacacaggggactggttccaggacccccaggtgtaccaaaatctgtgcctacccgagacctgcagtcaaccttgcagaactcaaggacaggaaaagtaacccttcatctacacaggggttttgaagcagttcacatctgtattgttcaagagtcaaatatagatagatagataggtagatagacagacagatagatagatagatacacacacgtatatagatgcacacacatagtttatgtaaagttggtgtgcttgggagatatttccatgttgccacttatcaatttatcttatctttttaacagctacatggcgcccagtagtacggatataccataatttagccactccctagttgatgaatatttaggttatcccacattttctctatcacaaaacatactgcaatgaacaccttgaacatatattattctgcacatatatgaatatttccataggatggattccaagaagtggaattgttgcgtgtttttaattttggcagatcttgacaaaccattcctactttctctcatacaaaaatgatggtgacatgtgcccccatttatctggatggtttgcaggaatgagccccctcaaagtggtctctggtcaacacaatgggtctctgtgatgtacccacctgcatttagcaatcagagttcacagagcactttccagtctgcttggcacacattcgttcacaaagaagctgagggaagcttcattgctgcttctaaaaagcagattattccagatccccgcaaagcttccagtctgttgagctacctgaaaatgacaagcagcaacttccctgcagagacctggagtcagagtttggccatcaattgccacccagaccttgaagccactctgcttgtctctagggcaatgtgaactcctggccatcatgccttgcttaggatgtcaccaagtgtcccctgaaaaacagctgtcagtctgtccctctaatcataggacctcaaacccagcacagagagccaaatagaaagcagatcctattccattccctttatctccctgtttccattaaaaataaaagcctcggagcatgcaagcaggcagaggagagggaagtattgtccacagtcaaagcatctcgacctccagatcagtcagccagaatgtcctgctacacaagcatttttattcgttccaggatgttcttgaggcagcttccaaaaatgcacataacataacaaaattggaaagtgcaattaacagacaaagtgagaaaaatgaaaaatatatatgagacaagatataaagacccaacctaaatgcctaccaatgatagactggattaaaaaaaaaaagtgttatatatacaccatggaatactgtgcagccattaagaaagaacgagctcacatcctttgtggggacatagatggagctggagaccactgtccttagcaaactaacacaggaacagaaaaccaaatactgcatgttctcacttagaagcgggagctaaacgatgagaatacatagaggggaacaacacacactggggcctatcaaagggtggagggtgggaggaggaagactcaggaaaaataactaatgggtactaggtttaacacctggatgatgaaataatctgaacaacaaacccccatgacacaagtttacctatggaacaaaccttcacatgtactcctgaactaaaaataaaagttaaaaacaaaaaaagaagaagaagaaagaaagaaagaccgaggagaaagaaacctatatgaggcattaagctctgcacaatttttaggcatttggactccaacaacagcaacaaaaaaaggcggatagagggttcgggagatggaattacatttagtgtctatatctacaatgtgcatgaaaataattcccacattttgactttaatcacagaggctgggcatggtggcttacgcctgtaatcccaacactttgggaggctgaggcgggtgaatcacctgaggtcaggagtttgagaccagcctgaccaacatgatgaaaccctgtctctactaaattaaaaaaaattagccaggcatggtggtgcatgcctgtaatcccagctacttgggagactgtggcaggagaatcgcttgaacctgggaagcagaggttgcagtgagctgagatcgcaccactgcactccagcctgggcaacaagagtgagactctgtcttaaaaaaaaaaaaaaaaaaaaatcacagagtggaaaataggaaataaagatggcacaactttcaatttctcagaatgggtctgtttctcatttgaacagcataaaatccagccaggcctcctctccaaccagcaggccaagactcttccaaactgacctgacaccccgccatacccaatcttggcaccccacccacttccccctcctcagggtgctgcccaaaccagacaaaaagcaggcgccaagatgctcccacaggactaaggctcatagtgaccttcttaaaaaaaacaaaaaaaaaacttagttggcaactgttaaacattgggaaattgtacataaaaaatcctgatctctcactttttaaaaaaacaagtggaaaagaaaaataggcaacataacatctccccatagctggagctggggccgccttggaggagaaaaggtacctcccattttgtgcacgcagcccactttcctgactcatgcccatgcaaaccccagctaggcaacaaatacttaaattttttgtttttattattatttttttttagtagaaacggggtttcgccatattagccaggctgatctcgaactcctcgcctcaaaccatcctcccacgtaggcttccaaaagtgctgggatgacaggcgtgagccaccacccctggcctaacttttcaatttttttaacagagagaaaacttaacggggtgagtaaaatggcaccaaaagacctgaacttggacccatgacttggccgtccattttctgaatccaccaaatgaggggtccgacactgaatgacgattctttgcacctctgacaatgttctttcttttgactgacggaggtcccactttccagggtaggggattttgctggtatctacgaaccatgccaacttggcttaaacggtcaagaaagaggggggtctccataatggggccatttcactctaatttcttcttgaaatgcttacccgactggtcccctccctcgccccttacctatccctttcctctctagggttttgctaggatgttagccggatgtaaggtacacggacgaactgcaagcttagaggtagtgattggctttgcaagcagaaacaaaaacaaaacaatgaccaaaaaaaacccctcaaaaccaacaaaataaaacaaagcacctcttcctttccttaaaatacattttgcgttaaaccagtagcctaccaaaggcagcctggagccttaagtgtgttctggaagctgagccttgagcgccatctgggagcagagggcggcactgcagcctcccgccctggagcttcgcctccaggtccttgcagactttccccttcatgatccatctcttctcccgttgccccaaggtctcagaagaggggatgtgctacaatggggagttatgggttttgcaatcagaccctgacacttcactagctgtggggtcttgggcaattcattgcctttctgcaacatgaggacaatcacacccaccttactgggagactggaagattaaaaaagaaaaatgacataaacgggcttatagcatgcagtcagcaaacttatccccttccgtcacagtgccataactcagtctacagacgagtaactcggggagggggtttgtttggctcatctgtaaaacagggctgctggaagccgacattgcataacccatatgtacaacaactggcacacagtgagtgctcagctgttaataaagggaaggaaaagaaactgtaaatctggctctgttataggtcctgaggttaagcaaatagagagacagttataaagataagtaagacaagagagccaaatgtaaataataatatcaggtaattaattagatgtatgaacaaagttcaaatcagtgtagcttccaggctatatcaattacctcgcttaagccctctacgccctttacaacacaggactgtcacccctgcccagtttacgggccagccaaggcgggttcagaaacagcagagaatgtcctttgggcttacgctgtttgtgaccctgcttcttctcggatcctagtccatcttcatcttttttttcccaaaatggttttctcatttctgccactgaagttgaacaaattcaacatctgatttttcctttccctgtctcccctctgcccacaccctcccccagtacttcatcttcctgaggtcggctcgatcccaacttcatgtctgtcccatccgccctcttcaattccactctcctctctccagttatgacccctggatgcctgaagaagccttctaactgtgctctccactgttcagctctgctccctccaatctgccctgcatgagcccctgagggatctcaccctttcagcaggtccacctacaagtataacccctctaggtgacataccttccttcgggaagcttctcccagcaaccactgacccacaagaatctctgctttcctcaaacacaagtagacttcgcaactctgcctacctgttagaataacctgaagaagcttcataccacactgttcaccaacaagcacacaaaaagatgctcgatgtcattagccatcagggaaatgcaaattcaatcaacaatgagagaccactccacacccacaaggatagctataattaaaaagacgaacaacgacaagtattgacgaaaatatggagaaattggaaccttataataccgctggtagaaatgtaaaatggtacagtcacttgggaaacaaggctggcagttagttcctcaaagggttaaacagagttatcatatgacccagcaactccactcctaggtatatatatgtaagagaattgatagtttctgtatccacacaaaaaacttatatacaaatgttcataatagcagtattcatggatatccaaaaagtggaaaccaccgaagtgtccatcaactgatgaatggatgaacaaaatgtggtctaggaatgatgtgctgatccacactgcaacacagatgggtctttaaaagctatgtaagtgaaagaagccagtcacaaagaaacatatgttatttcattccatttatatgaaatgtccagactaggcaaatccatagacacgtaaagtagattaatggttgccaggggttgggggaggggaaatgggaggaaatggggagtttctggtagtgactacagggtttcttttcgaggaaatgaaaatgttcggactgtaggctgagtgtggtggctcatgcctgtaatctcagcactttgggaggcttaggtgggagggtcacttgagctcaggagttcaagaccagcctgggcaatgtagctagatcccatttctacaaacaaaattttttttaattagctgggtgtgatggtgcatgcctgtggtcccaactactcaggaggctgaggcaggaggatcctttgagcctaggaatttgaagcggcagtgagccatgatctcatcactgcactccagcctgggtgacaatgtgagaccctgtctctaaaaaataaaaaaagtcgattgtggtgatggttgcacaattctgtgaatatacgacaaactattaaattgtgtactttaaatgggtgaattgtatggaatgtgaattatgtatctgaataaaacttatatttttaaaaaaataaacctcccattcctatcacttcctcattgttcaatatggcttcatatatttcttcataaataaatatactgatttaatacgtgtttattcgcttattgtctaccacaacagtaaaggtaatttcaatgagagcagagcctgtggcgcgttcacttctatattcccagtgctttgagcatggcacaaaaggctactgaataagtaagtgccagtgtgtgaatatatgagtacctgtaagaatcagcaaaaataaaatactgtttccagggccccacccccagagattcagacgcaattgatctgagggagagcctgacaaaggtctggctcaagactcctcgagtgataccattgtacaaaccaagacgaagagccctgatccacagcagctgtcatctataaccctaaccctgtgtcacccctgcagatgaggcttcagtagctcaccattacctctacagacattctaaattcaagttaaataacgcagatgaaggactcaggtgagtctgggactttctgtatcagaatcgtcacagatgcctcaaaaaatcagattcccagaccccgttggagacattcagatccttgcagacccctgccagggaattaatgagttcaggttcattccacatgcagattctcgggactccctccaggaaattaaattgagattcccggatttaaccccctggaaggggtcccaagaattcacgtgttgaacaagtgtcttttctcagacacgctgaaggtagggatctacagagtcacattcatgcaaggtctgtggcacaaggcctggctctgcctgcatctctggcttcatctctcaacattcatgcccccaccctgtgcaggtccaccaaccccggctactccacgtaacagaaatggcctttccctactccttctcttggcttctgcaaccagcctcccaaccttcactcaggtatcaaagtggcaagcttttctgggttccgtgtctattctgagctcccaagcctcctacagttgcacttaaccagggatgattgtgcttttcaagggacatgtggcaattctggggattttaattgtcatattgggggggtcactactgccacctactgggtagaggctaggaatgcttaaacatcctacaatgcgcaagacagcccccaccgcccccaacaagaactatctggcccaaaatatcagtgtaactgaacttgaaaaactctgctatagtctattgtcatgtgagttcctcgaaggcagggaatgtgtaacactcacctgcataacctcagataccacatacagagcctgacacaccgtatttggtaaatactagtggaatgaattatccgtaccttacatctggcattcaggtgtgttcatttctgccctattttattccagaaaagacgtgtagatacttaaaaaaacttactcaatgcaacaggataaaatcagtgaaggtatcgtagaagcagcagctatgatgaagctataggtgggttgagagcagttattaggattatttttatagccacaaggtagagataagctgaaatttgactctgggcttctggttggcatccatgcaataaaaatgtcccagttgctcaagggaagcacagctctctctaaagttgagaggtgtggggcactgggccatagtgagagtgaagtggacaaccctttctttctttgttttttttttctttttgagatggagtctcactctcttgcccaggctggagtgcagtggcgcaatctcggctcactgcaacctccacctccctggttcaagtgattctcctgcctcagcctcccaagtagctgggaccacaggcgtgtgccaccacgcccggctaatttttatatttttagtagagaaggggtttcaccatgttggtcaggctagtcttgaactcctgagctcaaatgatccacccgcctcagcttcccaaagtgctgggattacaggcatgaaccaccacacccatctggacaaccctttcaacagcaccaatacaccaggagtctttcacaactagttgttataacttcctctgagttcttttcctcttccagaactcattctctttctctttcccatgtaatttgatagtttctttctatctcttaagtttgagcttggccacatgacttgttttggtgaatgaaatgatgatagacatgatacaagtaggagctttagatgtgtttgtgcagctggatgtgaattcctgaatctctcccatcaccatgagaagagcatgccctggctagccctctggttcaaagaaggtaaaaaaatacctggagtcaagctcattcaacttaacccacagacctgtagcctacagcagaaccacacagctgagcccagcctagctcagcacaccccctgctgacctgcagttgcataagcaagcccagctgggttcagccaccccccagtcgcagatgcatgagctaaatatatgttcactgttgcatgccacagagtttggggaagattcactatgccccattattgacaatgggtaaccaaaatatctcccaatagcaagttaaagaattacgccaaagcgtggctaaataaataaatgaaagcaatcttttggggggctaagatagaccaaattattccatgttacttaagattcctcccaaactaagtagtaactccttggtgatagatcatattcttccaccaagtgaccaccactgagctgggcacataagaatgcttgatgccaatgtgtcaatcagtatttgattgggaatatagccaacccatttcaagagaaatgctgtgaactaaagtcaaaatgttggcaacactgaacaatcaatcgactgaattggacagtcaatagattcagatgctctaaatgccttccattatatccgatctgccaaaggtccaaaaaccaatgatgcagtggcaaatttcctggtctcatctcccacgcagcatccactctcccccagatggttgagttctttctggtcatcttagatccctccagaatggattttttttacctctcatgcttgcgcaaggctcaacttcaattcgaagaaagccttcccatacttccttttatgaaattacaagcctgggatccctaccttgtctgctcagaaataaaacagactcagccccatctacacttgagttagagttgagagttgcatactctcaactcctcatgtggctgagttgctaaaggtgttgtattagttcttgcactgctatgaagaaatatctgaagctgggaaatttacaaagaaaagaggtttaataggctcatgattccgcaggctgtacaggaagcatggctggggaggtctcaggaaacttacaatcatggcagaaggcagaggagaagcaggcatgtcttacatcaccagagcagaaggaagagagagaagaggaaggtgctacacacttttaaacaaccagatctcatgagaactcactcactatcacaagaacagcaagggagaaatctgcccccatgatccaatcacctcccacctggcccctttttcaacactgggaattacaattcgacatgagatttaggcagggacacaaatccaaaccatgtcaggagtgaaccatggagtcaagcagtcctggtttctatcacagctctgccacttatatgctgtgtgaccttgggaaagcacttagcctctctgagcctcggttgttctaactatacaatggacataatatttacctactttaagactgttcttaggactgagaaaggtaaggtctataaagtacttagcacagcccctgacacgtagttggtgcttaattaatgctcttatcacttgattttgaattcagagagtagacccatcacagcagagctacagtggggtggaaaggggaggtaacggaggtaacaggacccactatgagcacctactgtgtgctagcagctgtgctaagcactttaaatacactctctcatttaatcctcaccaccacctactttgtcaccattgcttctataacaggacatcaagtaggaattctccagttgttctggatcaatgactacagcagacagttggtacctagctcagggtgagagatccccaagagaaattgctccaaaagagggtgatcacacatccccagtttgccctgcatgatcccaatttatacctgttgtcttaacatatctattaataacttctcattccctttcatactcagaacagtccaaatctgagcaacaaattatatggtcacctgtcatggtcaccagccaattatatggtcacctgccatggagccatgggggctgattgcaagaaggaggggctagcatctctatccctgagctgcagagccatgagcccctctagtgcgatcatctgagtaagatggagtgaggacactcttggaaaagctgactctaagcaaagcttaatgtaggaaaaggacaggggcaggcatctccctctcattccctgtgccctaagagtgcgtcacagatgcctgtgatttcatggtagaagaggaagccagagatacagatgagaggctatccaaggagccactaaatgaggggcttggggccacagatgattgaaaggggccaaagggaggcaaggctggccttcccctaagggtctcagtgacagatggggcacatatgacattgaaaccaagcacacgatctacaccagaaccatctcatttgcaaaggttttgagcagcaaaaccagtgttacacagaacaagatcagaaatgccacccataactacgaccttgccaagttaagtagaaataagcctaaactccccgacccactttcctccccatctccacacacaaagagaggaatgggagatgcataaagagctaaacatgcccttcgcacgcacctcttcaggtccctgccatggggaagagagataacgtttgtttgtttgtttgtttgtttgttttttagatgcagtttcgttctttttgcccaggctggagtgcaatggcccgatctgggctcactgcaacctctgcctcctaggttcaagtgattctcctgcctcagcctcccaagtagctgggattacaggtgcccgccaccacgcccagctgattttgtatttttagtagagacggggtttcactatgttggccaggctggtcttgaactcctgacctcagatgatccgcctgcctcagcctcccaaaatgctggaattacaagcatgagccaccgcatctggccagaagtgaacttttcattggatctgaaattggagatttaagtcagactgaactaagttttttaatagctgaaagtggccagaaagttaagggacctagcacccactggggtagaaagactgaacatacaactgataataatatttaagaaaaaaaacaaaactagttcatgcttgtaccccatggagttgaaacttctccccaaactaattactgtcgtttaatagacacttggtgctgagtgctttacatattttccttttagggaaaactctgagacacatgggctcaggggaaatatttgttgacttggatggaaaaggcccatcctcagcttttgttttgccctgtcctgctgtctgtctgtgttaagttcaatgcctgaggctttgccaacttatattccctgtaagggcagaaattcagctcatgtaaacctcacagcaatccttatgcccatctaacagagatggaaatggagactcaaagaggtaaagaaactcacccaaagaaccccagctaaaacatttagcagagtagggatttgaacccaggcctgtccacctgcacatcccttgcttgtttgccttattgagctgtctcctcaatttcatcttcaccagccccaattctcagatgtcccctgggcctcctcaataccatgttgcaggccatagccccaggctgctaaatggcacgcagcctctgtgggagaagactctaattgtgcctgaccacaaggtctgcagggagttaataaattattccaagagaatatttgcactgaaggccttattgactggagtccatttcctgagttggcataattttttttctccagcaattgttataaagcaagtgcaagtcttgaagcctcaactgtagaatctcttgattatcaccaagtatatgggcttccaagcctacctaccttcaaagtcaaggtcatcacaaagggataatccctcaggcaaaaagaaagatgagttttaggggtcccctggtttccatagaaaaggcactccaggccaggtgccatgactcacgcctatagtcgcagcactttgggaggctgagtcaggaggatggtttgaacctgggagttcgagaccagtgtgggcaatatggtgagatcccatctctgcaaataatacaaaacaaaactcgtaagcatagtggcacacacctgtaatctcagctattcaggagactgaggtgggaggataacttgagccaggaaagttgaggctgcagtgaactgagatcacgccatggcactccagcctgggcagagtgagaccctatctcaaaagaaaaagaaaaaagaaagaaagaaaaagaaaaggcactccagttccattctattctttatggaactattcataatttacagattaatgtcacttttctccctcccaccctcatctttctccctaagaaaaccacgactgatttgttgcagtattataacacccaatgagtagaaacaacccaaatgtccatcaataggggaatggttgaataaagcatgatatagccacccagcagagtactatgaaacatactaaaagaatgagaaggacctctatatccccagtatggaggagtttccagttcattcaaatgaaattagcaaggtttcagaaaagagtatgttgttttgtataaggaagtgaaagggattagaatatatatttgcttatattagcgaaataaaataataaaaggctaaaaccacaaaaaaaaaagtttcctttggtggagagagaagaagaagggtaataggaatgaaaatgggacctctctaaggctgagaagaggggagaaccaagaaagaggagtgtgggagtgctttgttctgccaggtgcagtcaataggtgccttgtctgtagagaatttaaaaaacagtaatacaatcaactattaaatgcaattggtatctaaatcaaattttggatccaggaaaaaaggacattggtggaaaaactgatgaaatttgagtaaagtctatagttaatagcattatattaatattaatttcttttgacaaatgtaccatggtgatgtaagatgctaacattagggggaactggatgaagggtaactacaagaattatctgtgctatttttgcaacttctgcaaatctaaaattattccaaaacaacgtggtgatttctaaaaatatatgaatttcatacacgagtattatgacatgaacaaaaagcaattaaaggtcatccatttttattattactggcaattctaaacaatattggtgatagaactctcccactcctccaaccagggcaactaaccactctgtacctactctgaggatggcttttttatttagttattagtttgggacattgttaatgttctgtaaagacaaatataaaacaaaatttgaaaacaaaaacagaaagagccacaatattgggcatgaataatccaaatctgagcactgtcaccacgtgctcctctcaaattcagggttttaattttttattctttattacagacaggatctccctatgttgcccagcctagccttgaactcctgagttcaaatgatcctcctgtctcggcctcccaaagtgctgagattacaggcatgaaccaccaggcctggcctcaagttcaggtttgagcagctctcaccaaaatcccactgcagtaaaattcgcagtgggcttcaaattcaggtccatctgagtccagatcccaaaagctttctgacagatcttcttgagggtgacaaaacagaaataaaagatcagaatgggaacttgcagttcctcttctgtcctttatagaagtgtcaacggggatgcaaagatttcattatcaacgggactggcactgtgcccttctatcaggcgtctgctctcacagggaaatcaacttggcacagcctcaagcattgaacctaacactgagaggcagccgggcagagcagaaagaaagctgaagacaggccctttccatccaagtcaacaaatatttcctttgagtacgtgtacctcagggtttttcccaaaaagaaaaatccctccccatataaaccccctagaaagaagtcattgctgcctcaaatgcatgtattcagctgcaaggcttctattgctacatgctttctgattatagccaccatttctaagccctgcaggtgtttgcccatcttggatcctttgaaacagctccttcccctgccccatttgcttccagatatctgcacggctcagcccctccatttatttgggcgtttgctcaaagccaccttttcagagaggccttcactcaccaccctattgaaacggggtcacacctcccatctctctccattctctatacctactttatctccttaatgctcactacctcttaacatttattcatgtgttgacttgtcttccctctctgaaagctccataaaagcagggtctgttgcatctccagagcctactattttttttcggtgtaaacagtaggtggctcacgcctgtaatcccagcactttgggaggccgaggtgggcagatcacgaggtcaggagattgagacgatcttggctaacacggtgaaaccccatctctactaaaaaaatacaaaaaaattagccgggcacgggggcgggcgcctgtagtcccagctactcgggaggctgaggcaggagcatggtgtgaactctggaggcggagcatgcagtgagccgagatggcgccactgcacaccaggctgggtgacagagcgagacttcgtttcaaaaaataataataataataaagaattccaaaatcaagtacaaaatcaaaaggcagattttcaaacaaaatctttgaaaagtggttctggccgggcacagtggctcacgactataatcccagcactttcggaggccaaagcgggcggatcacgaggtcaggagatggagaccaccctggctaacacggtgaaaccccgtctctagtaaaaatacaaaaaaaaaaaaaaaaaaaaaaaatcagcggggcgtggtggcgggcgcctgtagtcccaggtactcgggaggctgaggcaggagaatggcgtgaccccgggaggcggagcttgcagtgagccgagatggtgccactgcactccagcctgggcgacagagcgagactccatctcaaaaaaatatataaataaaaataaaagtggttctgtcctgcttacaccctcttctcacgcttttcaggcacaaagaagggccaagagcaagagaggatttctttggagagagtctgttgaagacacgccttcatgttacaagatcttgaaactcatgggcaccatggtctgggatctgaatcctgcagcaaagctcttccaggcttcttgctatgctgcctggggtaactgcacaaggccccataattagacgaccccactgtgatgctggcattttgaaattcctataatttttttttttttttttttttttgagacaaggtctttctctgtcacccaggctacaatgcagtggcatgaggctcactgcagcctcaacctcctaggctcaagcggtcctcctgccttagcctcccgagtaactaggaccacagatgtataccaccattcccggctgatttatttatttattttttttaattaattaatttatttttttttgtagagatgcagttttgccatgttgcccaggctggtctcaaactcctggactcaaagcaactccccagcctcagcctccgaaagtattgggattacaggtgtgagcccctgcacccagccagaattcctataattttcataacaagaatcaccacattttcgttttgtgctgggccctgaaaactatgcagccagttctgcccaagatgcttattttatttcattttcccagctttacaggggtaaaattgacaaataaaaatggaatacatttacagtgtacaatgtgatctttggagatatatgtatacacaaattgtgaaatgatcaccatgaaccagctaattaccctattcattacctcccatagttgtctttggatgtttatgtgatgagaacacctaagatctggtctcttagtgaaaggatggtgattaccagaggctgggaagggtagtgggctggggaatgtagggatggttaatgggtacaagaaaaatagttacaaagaatgagtaacacttactacttggtcaggtgtggtggctcacacctgtaagcccagctctttaggaggccaaggcggacagatcacttaaggccaggatttcaagactagccgggcaacatggcaataccccatctctactaaaaatacaaaaaatagccaggcattgtggggcacacctgtagtcccagctactcaggaggctgaagtgggaggatcacttgagcccaggaagtcgaggctgcagtgagctgtcatcatgccactgcactctagcctgggtaacagaaatgagatcttcactccaaaaaaaaaaaaaaaaagacctactacttgatagcacaacagagtgactatagtcaataatttaattgcacttttttttttttttttgagacagagccttgctctgtcaccaggctggagtacagtggcgcgatctgggctcactgcaacctctgcctcctgggttcaagcaattctcctgcctcagcctcccgagtagctgggactacaggcatatgccaccatgcctggctcattttttgtatttttagtagagacggggtttcatcatgttggccaggatggtctcaaactctagacctcgtgatccacctgcttcggcctcccaaagtgtggggattacaggcgtgagccaccacgcctggcctaattgtacattttaaaataactgaaagagtgtatttggattgcttgtaacacaaaggataaatatttgagggtatagataccccattcttcatgatgtgattattacacaccacatacctgtatcagaacatctcatgtacccataaatatatacatttattatatacccacaaaaagtaaaaaaaaaaatttaagagctgctctcttaacaaatttcaagtaagcaatatggtattgttaaccatagttaccgtgccaaatatgagatgcccagaacttattcatcttatcaccgaaagtctgtaccctttgagcaacatttcctcctagcccctggcaaccattctaattcgactctcttttcctctgagttcaacattttcagattccacagataagtgagatcacacagcatttgtctttctctgtctgaattagttcacttagctaattctactctttttgtatgagttcaacgtttttaaattccacaaataagtgagatcacacagcatttgtctttctctaagtccacttagacaatcagaggtgcttgttttaaactcaggttcctggaccccactgtttttaacagttcagcttgatatccaagcctgtaagagacactttgattctctggattaaaatgagagacagtgagaggagaggaagaagaatagaggaggagagatttctctctaaaaatgtaagggattccaattaaaaatcacctctcattgtacatgcagaaaatgtacagtgagacacaaagttgggttggaagacaaaactctgaaactagtctgggagggttaagtgacttcatggaaataaatactaaaatatcaaaatgctctaaactttccatttttacttctaaatgtgctgagaaaaaaatctgattatttgacaggaattttaaaaagaacaatttttataaaactaaaatcacattcctgaacactcaaatgcttagcataggggatgaaattgacctggaattttctttgtgagaggaaggaccaagttcccaatgtggatacattaccagttagattttccaagcacagttcatactgcagaattcacctaacttgatttaggtttctcctttataatcagtttccacttgaacttcaactaccacgaaaaagtaagtaagtaaagcaaagacgtaaattcttgggaactttgttatgagaggaactttctagactgcacttagttgtcttatttaattagctaccagggaaacaaaacatatagtatgtccaaggagttgactcaatggaatgctgtcatgctaaacagatctaacgtcatgctgggtgagacacacagtctattttagaaagccaaacagggccggatgcgatagctcatgcctgtaatccccagcactttgggaggcctaggcgagtagattacctgaagtcaggagtttgagaccagcctgaccaacatggagaaaccccatctctactaaaaatacagaattagatgggcgtggcgacgcatgcctgtaatcccagcttcccagctactctggaggctgaagcaggagaatcacttgaacctgggagatggaggttgtggtgagccgagatcacgccattgcactccagcctgggcaacaagaacaaaactccatctcagaaaaaaagaaagaaagaaagcaaaacagaagcaaagcatgccagaagtttattccaagcctctgacagtaggagtcctgaaatccacctggtggatgaaggaggaaacaaaatttagaggacttggcagaatcacagaatgtggggagatgtttccaaaggggacctcatctcatgctgcaaacgttttgtctggagaataccaaaaaaaaaaaaaaaaaaaaaagttttgtctgtgtcttgtgtcttgggttgttttgttgttgttgttttttaacgtcatcaatgaggcgttccttgttctgctgaggccctagaagcattcaggaaaggaaatgcagaggtgggaactggagagaaataatgtgctcaataaaaggagtaaggttttggagccagacaagaaaaaaaatgagaagcagagctggggaaagaatagagggttctagaagcctgaatgtgccagaaaatcatcccctccagaatcccccagtcttcagtgaagccctatgaactcactagctgagtaggtttcctgcaggcaatgggagacgcaaagttctgcacttaagctcctgtaggggaaaaagcagagccagcgtgggttggggccaccagggccagaggcagatacgaccttgagaaggtcgccctccccagattagcaggaagtagcctgcatagaagatcttacctagatctttgaggattcaggggaccccagctgacatgtcggttattctacttaattataaaatgtttgagcagggcacagtgactcacacctgtaatcccaagcactttgagaggcggggataggaggaatgcttcagcccaagagtttgagaccagcctgggcaacacagtgagactctgtctctacacactttatttttttttgttttttttttttgtttgttttttaaattagccaggtaggatgctacaggcctgtggttccagctacatgggaggctgaagtgggaggatcacttgagcacaggattttgaggctgcagtgagctatgactgtgccactgtactccagcctgggcaacagagtgagaccctgtctcacaaaataaaaataaaggccaggtgcgattgctcacacctgtaatcccagcactttgggaggctgaagtgggtggatcacttgagatcaggagttcaaaaccagcctggccaacatggtgaaaccccatctctataaaaatgcaaaaaattagccggcatgatggcaggtccctgtaatcccagctacttgggaggctgaggagggaaaatcacttgaacctgggaggcggaggttgcagggagccgagatcattccattgcactccagcctgggtgacagagtgagattccatctcaaaaaaaataaaaataaaaatgtttggccatttccaaccttgccttcagactatgggttcctggaggacaggtgcacttctcagccatctctggatgcactgatgtggccatctctgttagtgtactggtatggaccagtagggtccatacttgcacaaatcccaacaatcggtatttacatctctttgcttggccagggcccacaatgcctgtgcacaggacaggtcggaagtcctggagaattaacatacctcctgcattaggtcttcaccagtgactaacaggagggacgtataaatatcccagctccttcactcctccagggggtgattctgagctacatgctcaacactagggttggcaaacttcttgaaaaagggtcatatagtaaatattttatgttttgcaggtcatattgtctctcacagatgctcaactctgctgctgttgtataaaagctgccatgggctatacataaatgaaagggtgtgactgtattccaggaacattttattgaaataacaggtggcagaacaggtttgccatgggccaatagtttgcaaatccctgctctgtgtcattttccagagttccccagagagattaaactgtgattccccacactggtaactgacatgataatgcatctttcttgccacttccctcccttgcctgtcccctttcccccacctcctcaagcttaataaactattggcactcaaatccttgcctcagagtctacttcagtgagcatccaaactaaaacagttgattaggactttttttgtttttttgcaagagatggagtctcgccctgtcacccaggctagagtgcagtggcgggatcttagttcactgcaacctccgcttcccaggttcaagcgattctcctgcctcagcctcctgagtagctgggattacaggtacgtgtcaccacgcctagctaattttttatttttagtagagacagggtttcactatatgttggccaagctagtctcaaactcctgacctcaggtgatccgcctgtatcagcctcccaaaatgctgggattacaggcgtgagccactgtgcccagcctgataaggatacttttgactgcaagcaacacagagttgaactacaggtgatttaaatattaattttgcaccaacctataatccagatttattgtatctcccacacaaaatccaggcgtaggtggtccagacaggttaattcaataatgtcatggctttgcggtttttctgatccttactagctcactactgagaaccaggtcatgtgcccaaggctaaaccagtcagcagtgagagaaacaagatgagcatgcctggcttgggccaactgagttccatgcctaagagcatgaggaaggaaggggctccatttctctgggcatattgccaactgatgcatgaatgaaaatgggatggtctcagcaaagaagaagagaaaagggttgctgggcaggtaaccaatacatacccagcagctggtgcttagaaaatgctgctgcagtctatgaatgcatgagccactggatgtaaacaatggatagcaactttctagaagaaagataaagttgaaggagtcatcctggacacacaagagtggtgcaaaataagcactgagtggccaggatgctcaggggaaatctcagaggctttagggagcatggttacctaactcagaaccatcagtgccaactaaggaagacacaaggtacattggttaaagtcaaggacaatcatgttcttcccctagttaataacagacacggcattttacagttcataaagctcttgtccattcattagtctcaccattcagtcaatgaaataaacccaggtaataatcaggtcaggtattattcttttaaaataattttatccccatttactgtgaaaaaaacttcttgagacagcttgcaataaaaggtacacccaaagggaaaccaaaagaaaaattatttatttatcaaatacataagaaaactcatttaatatggttattttgattgcatgtgctcttgggttttagctccctaatagccagagcaaaagaaaaagaaaacataaaggacacatgaatatcatcatttaacaaagggaagtatagctgttcacaggaaaggaaatgatttttcttagaatagaattcaaaaaaaattccacttggatccttacataaggcaaatgtaactaaatgatggataatgtctcccatgatggttttgcagaagatatgagaatgtcctcattcatcatgacatttgaagtagtccattctcacactgctaataaagacatacctgaaactgggtaatttataaagaaaaagaggtggactcacaaatggactcacaattccacatgtctagggaggcctcacaatcacggcagaaggcaaaggagtagcaaagtcacatcttacatggcagcaggcaagagagggcttattatttttagtagagacacggtttcacaatatgttgggcaggctgacaactggccaagaatagcatggaaaagaccccccatcttgattcaattacctcccactgggtccctcccatgacacatgggaattatgggagctacaattcaagttgagatttgggtggggacacagacaaaccatatcaatatccctacccatcagcttttcatacaaagccaaaggtttctccctgtggatggtatcatagcactgatacccataagcctcacttccattccacattgtcctggatatcctagctagtgcagttagacaggggggaaatgtccagaaaggaagaaatgaaacagtcatcattcctaggtgacttgatcgtatacataaaaatccaaggaaaattgttatggactgaatgtctttgtctttctccaccaaatccacacgttgaagccctagcccccagtgcaatggcatttggaggaggtaatttgggttagacgaggtcatgagggtattacccccatgatgggcctagtgtctttccccagaaaaacaatatcctttaccatatcccgaaaattataacaataccagttttaagtacttactatgcatgcaccaagtgtttacaggttttgatttactcattgaaacctcacagcagcctataaacccagctagtatgtggcagagttgagacgcaaacagaaaagcagtactccagatccccttggatccttacataagggaaatgtaaccaaatgatggataatgtcttccatgatggttttgtggaagatatgagaatgtcctcattcatcataatatttgtattagtccattctcacactgctaataaagacatgcctgagactgggtaatttgtaaagaaaaagaagtttaatggattcaagttccacatgttgtcatatgccacacttcttagggatgaatgaacatcaccatgatgccacacttcctagggatgaatcaacgtcagaattttttttttttttaagttctgggatacaagtgcagaatgtgtaggtttcttacgtaggtatacatgtgtcatggtggtttgctgcacctatcaacccatcatctgggttttaagcaccacaagcattagctatttgtcctaatgctctcccacccctcaccccccactctccaactgtccccagtgtgtgtcgtttccctccgtgtgtccatgtgttctcatttgaacatcagagcttaaagaagcattcctgctttcttctctcccagctgggctgggcttcaggtgcctcctatatgcttcctccatatcacctccacccttgcttgtcattgtctgggtttgtattcatttcctgagacttttgtaacaatgatctcaaactaaatggcttcaaacaacaggaatttcttctctcccaggtctggaggtcagaagactgaaatcggttgcaataaactgaaatcaaggtgtcagtagggctcgttccctatagaagtgctaggggacagtctgttccttgcctcttccagcttctggtggctgccagcattaccttgcttggagtggcatcaccccaatctctgcctccatctggatatatcaccttcttgtcttctgggtgtaatatctctccacctttctcttataagacacttgcaatcaaatttagggcccacctagataatccagaataatctccccatgtcaacatccttaatttaatcatacctgcaaagactccttttccttataatttaacatatacaggttccgcggactagaacctgctatctttgagtggccatgattcagcctactataggtttcatcactatctctttatcaactctgaagtccttgacagcagagaccacctgtggccattttcaaatggctgtacatttttacatcaaagcaatcccttagggccaggcacggtggctcacatcagtaatctcagcaatttgggaggccaaggcaggcagatcacctgaggtcaggagttccagacccacctggccaacacagtgaaaccccgtctccactaaaaatacaaaaattagctgatgtggtggtgggcgcctgtagtcccagctgctcgggaggctgaggcacgagaatcacttgaatccaggaggcggaggttgcagtcagccgaggtcacaccactgcactccagcctgggtgacagaggcagactccgtctcaaaaaaaatacaaaaaacaaacaaacaaaaacacacaacaatctcttgggatctacaccctctcccttgactttaatgacctccatgattgctttgacgtattgaatatggtggaaatcatactgtgcccttttccagtccatgttttaaaagactatcaagcgctacttcctatatcttggaatactcacttttggaactcagacaccactatgctacgagaagcccaaaccacatagaaaggccacatgaaagtgctccaggcgacagcaccaactgagctcctaaccagtagccaatatcatgccagccatgtgtctcagccatcttggatggccagcctagtcaagccttcagatgactccagccccagtcattatctgactacaactgcataggacttgaaatgagaaccacgtaggtgagcccaatcaacacagagtcatgagcaataataccaaatatttgtttccagccactgtgggatcaggctcttttttatgcagcaagagattatctgaacatcatatttgttgctgcataccaggtgcctggaactatgcctggaggtcttgatattcaatgaaagtggaataaatcaaataaataaaaatggaataaataaacaaaactctagaagctatggattctagggagttgagctggagatcaggaggaatggatattaggtctcaaagaaatgacaaggtaataaggtagaagaagaaggctgtggataaacaaattttctggagccttaatggtggtgagaagtgggcaagttcaatgttgagcaggaccaaattcaacagaccctcagcaaatgtttgctgacttagcagtacacagattctgcacacatcttccttccttttaaccattcctttaattgtataagcaatatattgagtatctactgagagccaggctttgagttgggtgaagactattcagcagttaagtccctttaacgcttatacactgttgatgggaatgtatattagtccagtcactggaaagcagtttggagatttctcaagtaacttaaaatagaactaaggttgaatccagcaatcccattcatgggtataaatcccaaaagaataatcattctaccttaaagatgcatgcacacatatgttcattgcagcactatttacaatagcaaagacacgaatcaacctagatgcccatcaattgcagactagataaagaaagtatggtacatatacaccatggaatatactatgcagccataaaaaagaatgaaatcatgacctttgcagcaacatggatggagctggatgccattatcttaagcaaattaacacaggaaaagaaaaccaaatattgcacattctcacttaggaggtaaacactgacttcacatgaacacaaagaagggaacaatagacactgggtcctacttgaaggtagaggatgggaggagggtgaggattgaaaaactacttaccaggtactacattcattacctgggtgatgaaataatctggacaccaagccccataacatgcaatttatccatgaaacaaatctgcgcacgtaccccccaaacctaaaataaaagttggaaagaaaataaaaatgaaaaacaagtccctttcttatggaacttaacaaccatagagtatttggggaaacctcaaaaccacaggcaggtggttcaagcccccatctctgaccttcattaccctgctgtatagccatgattacaaaaaaaaaaaaaaaagccagaccattcaatgctattgcttctctcttccaaatgggatgaagtgcaggcagtaaacaaaggaagatgaacttggccaagtccttctattcattttgtggcagtgatgacaatttcccattgtggggagctggaggggcagtctccttctgttcaaatgactcagtacacttttgagggggcataagaaccagaaagtgcaggtgctagtaaagcaggcctgtatttacagggagaatcagtccacagacttcagcttctcaaaaccattgttaatgtgcttttacaaaatgcaaaatgctgctagacagttcactgggtggccttgggcctacccagttcttccctcttttcccaactcatggttcttaagaataactgaagaatgtgctagaaatgcaacatcttgagatagagagggactggccagaacgacccaacctctgtttcagtccacccctagaaacaaaatgtcttaaacactttagcccagcaaatcacacatcctggggtataaaacacagaaccagctgctttctggggtatctgagcttctgtgcaagtaaggcatgcacagatatgactctacttaccctcagcaggtttccggggacttggaggaatagctcacaatgaatcctaggcttctaccatctcttgctgcctatctgtaagtaataaacctacctcaggtaacttgttgtgtgggagtgttctgtctcactggacaagttggtagccagtgaacagtgaacctgcttcacaaattcctctgctgtaaagtgcaccagaagctctcagtcatggaagttctgtgctcaaatcttccttcaaggtgaactgctctggaagcagagctaactgacaacctctagctgctgtaccttttgacccaccgaggtgttcatgctaggctgcacttccctggggattttcccagccagtgactgggcacagtggaagtaacggaattaggtgattctaacccaactgggagttgtccaacagagagagttgccttaggaactattacactggctgatacattctcagagttgtgccgaagcctttctctttctaactatctctcttccttcccactctgctttcagaggtgtcagacctgcattacggtctgaaatctctccctgctccctccccatttcccttcacaggcattttcttcaatgaatttcctgcacaattaatacttggttttctttcatgttgtaaaccactgtaggatgactacagttaacaatatgtagttttggccaggcgcagtggctcgtgcctgtgatcccagcactttgggactctgaagtgagcagaccacttgaggtcaggagttcgaaaccagcctggcaaacatggtgaaaccccatctctactaaaaaaatattagtcgggcgtggtggagcatgcctgtaatcccagctactcggcaggctgaggcagaagaatcgcttgaacctgagaggcagaggttgcattgagcagagatcatgctactacaaatcagtctgggtgacagagcaagattctgtctaaataaaatataatgataatagtaataataatgcagtttcaaatagctagaaggaagatactgaatgttaccatcacaaagaaatgagaaacgtttgagatgatggatatgctaattaccctgatcaaatcactatacattatatatatcaaaacatcactacgtactccatcaataggtaccattatttttcaattaaaaaataatttttttaaaaaaaagaaatatagaatgttatacttgtaaaaagaagaaaatggaaactgaggaatcaaattatgtaagagtgatcttccttctcatcagctatcattttagaaatttgtaggaaaagaaaaggagataaaggaagacagcaagaggaagcaaataagcagagggaggaaaagagcagaaagtaaagaaagaattagaaagtaaggagacacaacagatcagatcagctaccataattcaaatgctcgccaaaatcacttcctatatttgcaatacagaagctgcaggagacatgttatttaaaattagtaagagggccgggcacagtggctcatgcctgtaatcccagcactttgggaggccgaggtgggtggatcacaagatcaagagatcgagaccatcctggctaacatggtgaaaccccgtctctactaaaaatacaaaaattagctggacatggtggcatgcgcctgtaatcccagctacctgggaggctgaggcaggaaatcacttgaacccgggaggcgcaggttacggtgagccgagatcgcgccactacactcaagcctggcaacagagtgagactccgcctcaaaaaaaaaaaaaaaaattagtaagagaatgagaacttcatacagaagttgaaaagtggatttgaaatcagtggagactgggaccttgtacaattaattctgttttgccttctgctactcagaggacctgaactgactcacctaccatctagagacagctactattttgtatttcttttttagtttcatgcatttaatttgcatgattatcattttgctttatttctccattttacattataatatgtgccacctcatgttactgtgcttcatgtctattatcgatgccccataacattctattgtatggaagtatcataaatatcaactatttccctttagttggacattcagggtctttccagatttttttcctaattaaatgatgctgcaataaatgccttgtttcgctccttcagaacaggtcattgcagtaagggcctctccattggagtggtggattttagtcgtctgggacttagggttttggttctgattctgctacatcctaacagcatgaccctgagcaagttacttggtttctcaggactcctgtttcctcacccatcaaatggaggtaacaccagacaaggatcctttgtgactatcagatttaatccatggcatcattttgaaaatattttcttttttctttcttttctgtttttttttttttttttttgacacagagtcttactccatcacccaggctggagtgcagtggcatgatctcagttcactgcaaccttcacttcatgggttcaagcaattctcatgcctcagcctcccaaaagatttccatggaaggtgcttgcaaagggaaaaataacttgtgtggtcaaaaagtttagaaacccctggtctaaacggcgctagcaggacttatcagagcctttattataacagcacacagtcccaaaggtagatccttatggtattatcttagtctattcagactgctataagagaatgccataggttgtgtggcttacaaacagcagacatttatttctcacggttctctccagaagatctgggaagtcccaggcagattcagtgtctggggaaggccttcttcctagttcatagacagccctcttttcactgtgtcttcccatcatggaagggcaaaggggctctctgggaccccttttaaaagggcattggccaggcgcagtggctcacgcctgtaaacctagcactttgggaggccaagatgggcagatcacttggatcaggagttcaagacagcctggccaacgtggtggaacctcatctctctaaaaatacaaaaaaaaaaaaaattatccaggtgtggtagataattatccagtagtctcagctactcagaggatgaggcaggagaatcacttaaacccagaggcagaggttgcagtgagcctagatggtactactgcactctagcctgggaacagggtgagactcttgtctcaaataaataaataaataggcatgaatcccacttgtggagtccccaccatcatgtcctaatcacctcccaaaggccccaccccctaataccatccatcacactggggattaggtttcaacacatggtgggaacacatttagtggatagcaagcatgaagcattaatcaagcttatttgcccatcatgcccatgaaattctgaagtctgacaagcagcctgtgagaagaaagacatacaacaaggaggtaggactatggtgctttggggtggaggccactgatgaaaaactcacccctcgaaagcatctcctactttgatacctacggatgcaacatccaggtagaaccagcctcgatgtcttctggagcccaggacctgatctccaagctggcccaagacaacgctcagagtgccactgttcaagctcctcttgctccataatcactttaaagaggctgcccccacccccggggctcagagggcttcctgtgtcctgacactatgatcgtgagcgagcgccgcgctctgttcccaactatgcttcctcatctgtcatccacggcttttcttttaaggagttatttacgaagaggtgaagcaatttgcttttaaaaatgaaaaacaacagaactagtattttttgtaagtcagcttgataggcagtaaacaatcctgccaaagcaaagcagaaaatgctgaaaaggttcatgtctcttcaacgactctgaccaagacttcagaggatgctccaaggggagaaacatgctcagggctacagaagcgagaatcatggataccctaagctggtctttcccaggagcaattttaccatgcaattttccctggatcctttctctatcgccccataacacctctcccatttggaaacaaaaatataatctttgaaagaaaaatagaaatcactgtctaaataaaaataatacattcctagcattcattcaccctcttcatcctcctccctgcccctgcgggggggaaaaatctcatgtatcatgttgaatttctcatctcttgtgaatgccatgcaattgggtaaataagttctgtgttcaatcttttgtttttttgtttgtttattgctttattcattcacaatggaaagaaagactaaacttcaggtagagataaaagaatataagatgtatttttaactgtccaagatcatgggatccccgaattctattcatgatagaatgtttgagcatctgtggaccccagtttgtgaactcttgccctgaaacaaagcctgccagttatctgtgttcagtcttttaacaggggttattcaatttactcaagccaacatgagaggtttccatgacaacctctcagcacattcagtcttcatataaatgagttattgcttttatgttctcatactctaagacaatggggaaattaacataatgtggtcatacaaaaaaaaaaaaaaatcaaaacaatcaaaatcctcatatcctccccagaaactcacagatagcattcggtgaaaaagaaccaaagagaaatgaagccttcacatctgacaacactgttaacattagagatttcatttcagatgcatttaaatgaagccagaccataatggggttcaaaaaaaagtgtatagacataattaaactgcagaggaaagagacttaaagtcagggacccaaattcactttcaggccatatatcctccaaagataaccaccattctctgcctctctttctgcaccccatccacactagcattcctgccccaggaccttcgcacatgctcttccctatgcttggaatgttcttcccctgctgttcttccactgctgctttgcttagctaactcctacccatcctcaggtctcagctcagcaaagtcacttcctcagggcagtcaagctttgccactcatcaagactaggtaaaattttcttgttaaatctatttatggattttcctggttctttgtatttttcatcatcttagataggttaggtttccccagaaacaaatcctaagagaaggtgagacggtttggctgcgtccctacccagatctcaccttgaattgtaacaatctccatgtgtcaagggcgggggcaggtggagataattgaatcataggggtggtttcccccatactgttctcctgatagtaagtctcatgagatctgatggttttataaatgggagttcccctgcacaagcctcttgcctgctgccgtgtaagatgtggctttgctccttcttgtcttccaccatgattgtgaggcctttccagccatgcagaactgtgagtccattaaacctctttcctttataaatgacccagtctcaggcatgtctttattagcagcatgagaacagactaatacagaaggacttgaagataagtgggttgatttggaaagtgagcccaggaaacactgggatgacaatagggaaatgagacagagaagggaaaggagctaatccaggtcatgtttataagcaggctgctactatgggcaactggggttcaatcccactggggacatctgggagacagcatagcgcctgcctcaccctaaggtatggaaggcagggcaactgccctcagcagctggctgggggagatgtgcctgtgttggtttctctgcacttccagcctgccccacaagagcctaggttatggcagtgagacaaagccccaggcagtattgcagatgcttgcagtaggaatggtgagttcctatgccagaggacataggcaaggcaacaactacatctgccaccttccccaatgcaaacagcataattattgctggagactggagatcagtggaatagaagacagaagatttaattcaaagccattagacaaaaaataatagtcccattgaagacaaaggcatgggaatacggggaaggtataaatccacatgaatagacaattttcaaaagaagataaacaaatggccaacaaacatgtgaaaaaatgctcaacatcactaatgatcagggaaacgcaaatcaaaaccacaatgcgataccgccttactcctgcaagaatgaccagaatcaaaaaatcaaaacataatagatgttggcatggaggtggtgaaaagggaacacttctacactgctggcgggaatgtaaactagtacaaccaccttggaagacagtgtggagattccttaaagaaaagtagcaccaccatttgatctggcaatcccactactgggtatctaccctgaggaaaagaaatcattatatgagaaagatacttgcacatgcatgtttatagcagcacaattcacaactgcaaaaatatgaaaccagctcaaatgcctatcaatcaacgagtggataaagaaactgtggtatatatatgccatataccagcagtatatttatactactcagccataataaggaatgaattaatggcattcacagcaacctggatggaactggagattattattctaggtgaagtaactcaggaatggaaaaccaaacgtcgtatgttctcactcacaagtgggagctaagctatgaggatgcaaaggcataagaatgatacaatggactctggggactcgggggaaagggtgggagggggtgagggataaaagactacaaattgggttcagtgtgtactgctcagataatggctgcaccaaaatctcacaaatcactattaaagaacttactcacataaccaaataccacctgttccccaaaaccctatggaaataaaaaattttaaaaataaaaaataaatttacatgatataaaagaccttgactctaggcctgggtgactgattatatactggggtacaggttttagtcaaagagctggagactatatggaagaggggtgtctaaggccctctctgacattctaacaacccccatcatctcttttgctggccaggggcccacctggtaggacagtccaatccagggtaattctggctcacaggtcacgcaataccaatctttggtcccaaggttaggagtggctgctctcacaatggactttataataacctctccaacctctgtttgttgagcttagattcttaagcctctaagcttctgatgactcttactagagaaagtaatataattacccatcaatagagaaatggctcattcagcaaggatatatctgttcaatcaaatatatttgttcaatcaaatcactaaaaacaatggccgtttaagagtacatatacaaaaggtacgtgtgcaacagtataataagagcaaacctaaattatgcttgttgttcactgattgtctccccacagtagcatggaagttcagcaagagcagggatctttgtttttgttcaatgctaggtcctcagcacctaggactgtgccaggcacaaaaacatccagcacccaccaaggtaaaatttacaatgtctgacatcccataaaagttactttaaaaatagaggctgggccaggtgccatggcccacgcctgtaatcccagcactttgggaggccaaggtgggtggatcatgaggtcaggagatcgagaccatcctgccaacatggtgaaacctgtctctactgaaaatacaaaaattagctgggcgtggcggtgcgtgcctgtaatcccagctactcgggaggctgaggctggagaatctcttgaacttgagaggttgcagtgagccgagatcgcgccactgaaccccagcctgggcaacaagagctagactccgtctcaaaaaataaaaaaatagaagccagtggccaggagctgtgaccgacacctgttatcctagcacttcgggaggccgaggcaggtggatacttgaggtcaggagttcaagaccaacctggccaacatggcgaaaccccatctctactaaaaacacaaaaattagccagtcatgatggcacacacctgtagtcccagctactcggaggctgaggcacaagaattgtttgaacccaggaggcagaggttgcagtgagccaagactgcaccgatgtactccagcctgggcaacagagtgagactctgtctcaaaataataataatagaggccaggcatagtggcttatgcctgtaatctcagcaatttgagaggctgaagcaggaggatctcttgaggtcaagagtttgagactagcctgggaaacaaagcaaaaccccatccctccaaaaaaactttttaaaaactagccatgcatggtggtgcatacctgtagtcccagctactcaggaggctgaggcaggaggatcacatgagcccagtagtttgaggttgcagtgagctatgactgtgccactgtactccagcctgggcaacagagcacgatcctgtctcaaaaaaaattaccttaaaataataagtaaataaatatcaattttacaataaaataaaagtgactcagcctaccctgggtggggttaagggctggcctctatcacacctatcagctcccagaggtcctggatcccccagaagctgctaggaggggctgagggccattactcagaagtgcagagtggagcaagctttgaccaataagagacaggaaacagcaggagctggcagatgactgactccagagttatcccatgcttgtgtttctgggaaactgcaactccactaggcaatatgcacttctttggttttgctcttcctctttctctctttcccttatccctgctttcttgagattgcgtgacccaatgaaacattcacatatttgtatcaggcactgttggtaggctaagataacctccatccccaaaacctatgacacatggggtatctcctgaaggatgccattcaagttaatccccaaacattatggcttaaagccacaactgtttttattatagatcatgattttgagggtcaggaattcaagcaggacccagctgggcagttcttctgctcacacagtatcatctgaggtcactcagtagtattcagagggcttcggggctgctctgaagggtctagtgcagttttagtgatgtgccaggcaccttggtgggtgtattagtccattttcatgctcttaataaagacatacctgagactgggtcatttttacaggaaagaggtttaatggactcagagttccacatggctggggagcctcgcaatcatggtggaaggcaaggaggagcaagtcacgtcttacatggatggcagcaggcaaaaagagagcttgtgcagggaaactccctgttataaaaccatcagatctcatgagacttactatcatgagaatagcatgagaaagacccacccccatgattcaattacctcccaccgggtccctctcacaacatgtgagaattcaagatgagatttggatggggacacagccaaatcatatcagtgggacaggatggaagctgggctcagagcaacttctctccctttccatgtcatctcagagtctctccaggtttccctccagcaaaagccctcagatttctcacacagtggctcaggggtttaaaaccaagagttccaagaggtgtaaggcagaaactgcatgatcccttaaatgccaggaccagaaccatcatggtgtcacttctatggcaatctattcgtcaaagcagtcacaggccagcccaggctcaggaaaagggaaatagaccccatttctgaatgcatggggtatcaaacagtttgcactcatctttgacctgccacagatacacaagaaactgggaggaggggtgggtggaagactgaagcattagagtaagaggggctccttcatcctccggtcatcatttgccatgtgcacgtctgacttttttcaaataaaaactggggaaggacaaaaagtggggaggaaccatgtcaataagctgaatcctcatcttctatggcacagagtcaatagaaaatgtcttaaattgataaatcaagaaacagccacataagcatcttatttggagttacagagataaataaccgaagacctaaaaatggaaacaacatttcaagcacttgcctccgggaaataagacttaaggaggggagagaggagagaaggggccaggaaccgctgctttcattagcagctcctctgtactttaactttgtacgatgtgctcatattactatgatttttttttttaaattcaaaagggaaaaaaataagaacaaaatgatgatggttatttttaaaactatgtaattaaacctggaaaaatctcattttgctaaacggaaaaaaagtagcaggatactaaactatattaatagtatggtcataagtatgtttaataaagaaagagaaaaacatatatgggaggagaaaaatctgaagaaatttactaccaaatgatagtgggtgggtttctctacttttctaggtttcccacattttcagcaacgtgattctcatactttcctaatgaaaagaaatacattcattacataaaataaattaactgggccaggcgtggtggctcatgcctgtaatcccagcacttcgagaggccaaggtgggcagatcacctgaggtcaggagttcaaaactagcctgggcaacatggtgaaaccccgtctctaccaaaaatacaaaaattagccaggtgtggtggtgtgtgggtgtgtgcctgtagttccagctatttgggaggctgaggcaggagaatcgtttgaaccggggaggtgggggctgcagtgagccgagattgcgccactgtactccagcctaggtgacagagtgacattccatctcaaaaaaaaaaaaataaaaatggctgggcgccgtggctcacgcctgtaattccagcactttgggaggtcgaggcaggcagatcacgaggtcaggagttcaagaccagcctggccaagatggtgaaaccccgtctctactaaaaatacaaaaattagctgggcatggtggcacttgcctataatcccagctactcgggaggctgaggcagagaattgcttgaacctgggaggcagaggttgcagtgagccgagattgcgccactgcactccagcctgagtgacagagcaagactccgtctcaaaaaaaaaataaaaaaattaaaaaataaaaataaaataataaaataaatgagccgagcatcaattaaataaaatgccagaagggtctctgaagaactttccacaatagaagtgtattttaagtccctgagccttcatctcatgcctatggacaggggactctttgcactggttctggaacgctccagtccaccatgcccacggatttagttaggaaaccttcccagaaagaacttagtccatgtcatttcaaaatgaattaattcaactcaacaggaacttttgtaagcctccaatgtatgcggttctgaacttttgtaagcctccaatgtttccagttctgaatctggaatgctcattcagccacaaaataaacatttattgagtacctactatgtgccagacaaatgctacttgcaggggtgacaatgatagagacaggcaaaatattcaattctttggagccatagactaatgggagaggcagacaagtgactaggcaagtgtaatacatcctaacagacactttggggaacagacaaggggctgtggaaggaggcaacctggagggcttcctggaaaaggccaaacatgggccaagcgccgtggctcatacctgtaatcccagcactttgggaggttgaggcaggcagatcacttgatcctgagagttcgaggccagcctgggtaatatgacgaaacctcatctctacaaaaagtacacaagttagctgggcatggtagcatgcaattgtagtcccagctactcgggaggctgaggtgggaggatcacttgagcctgggaggttgaggctgcagtgagtcacgattgcaccactgcactccagcctgggtgacagggtgagaccttgtctcaaaaaaaaaaaaaaaaaggccaaatatgagctcagagctcagtctcaagggatgaaccagggcagatcaggttaaagcggaaaagctgttgccagcacagagaatagaatatacaaagacccagaaacaacagagaagatggatacattcaaggaactgagagtgatctcaaaaaaaagatttgtcatgatcagaagagacagtcccaaaccagcactcacttgggggctctgggactggactccctaaattggaatctcagccccatcatgtgagctcaaagtgcttcacctcactgtgcctcagtttccatgtctgtaaaacagggtagaagtagaacttatctcagaagagttataagaattaaactagagaagaagtgagcattgtttatatgtgcttgttgctatggatccaaaactgccagtaataacaataataataataataataatagcttatgctttcgttgagcccttgctttgcacctggccagtgacaggcacattatcagtaacacaaatgcaagtatctcatctaacccttgcatcaacgctcagagatgggttttatcagcatccccattttacagatgaggaaaactgaggcagagcagttgcacaacgtcgcagctgttcctggtgcttcacccagatcctcattgccagtaaaccactcatcattcagcctttgctgatctgtgcctaatggcttataccaatactttctccggagaattccttagctagcaaaagccatttcacccagggagttatgctctcacatgctgaactggccaatgactaagcgatatgaggcgagaggagtcacacaaaagtccagtcctcctgcttcaaggcagaatacactccagagacccacgtgagatcaaggctagcctcagcctgagagcccattcttgcttggctctgtcccctcccccatcatcctccttccctcactttccttctcctgagaacccccaccttgaataaaccgcacctacccaaatctcattctcgggcttccaaggaacccaacccgtcacacaacttgcagggattcggaccaggttttctccttccaaagggccccacgtgaaaccaccaagctgcaccaggctcatctcaaaatcagagtcatgggatcaaagaacagttgctgatgccaacccctgccggcatgagcccaccgctggggaaacaaggcgaaccagacatctcagactagaggagtgaatccaaggagagaagatgacaggaggtttatttgttctcacgctgctaataaagacctacccgagactgagtaatttacaaaggaaagaggttgaatggactcacagttccacaaggctgaggaggtctcacaatcatggtggaaggccagagaacagcgaagtcacatgctacacagcggcaggcaagagagcttgcgcagcggaactcccatttataaaaccatcagatctcgtgagacttactcactaccatgagaaccgtatgcggaaactgcccccatgttttaattatctccacctggccccgcccttgacacgtggggattattacaattcaaggtgagtttggatggggatacagccagaccatatcaggagagggcacagcattaggacgcagccggtggtactgtaattcgggtcgggggaggttgctgaaatacactcataagggtagtttaaaaagagcatcatcggccgggcgcggtggctcacgcctgtaatcccagcactttgggaggccgaggcgggcggctcacgaggtcaggagttggagaccaacctggccagcatggtgaaacctcgtctatacaaaaaatataaaaaattagctgggcatggtggcacgtgcctgtaatcccaagctgctcgggaggctgaggcaggagaattgcttgaacctggcaggcggaggttgcagtgagccaagatcattgcactgttgcacaccagcctgggcaacatagcaagactccgtctcaaacaaacaaaaaaagggggaggggcggggctttagacagatccaagctcaaccctgcaagttgccgagactccgtttctttatctgtaacatggagatcacgatgttcacctcgcagagtagattaagcagctggcatgtgtgaagtgcccagcactgtgtctagcatatgctaggtacttggcatgtgtttctttctttccctcccttgttcaaggccacatagtccatgactggcagagctagaagccttctcatttatccaaaatcaaagaacttctacaaaatagaaacagccccctgccccctcctgcccccgcccgcctgctaccttaataggttgtttcccagttattcaatgcaagagacttagcccagctaaagttattcaaaatcgaccttgagatcaggaacaaattggctacagcagtcagcgattggcaaatgcaatctaaatgccccaggcggcattagagccttccacgttgacaggaagagtcaatgtgcatcttggaaaaatctgagaaaaaaaaattaaaggtcaccgcgtttgtaggcagaatgggttttcttgagaccattacaaacagactgcctaaattgcaaagattccaggcttgacagctcccggaggactccagatggaaagaacaccacccccatctcttatacatccaggctgctgtctgtggatgtccgaaggttttcccaccacccatgctattgttgaaattccacaatcaacctgcaatgccccagtgaaccattttgctgggatgggaggaccaacttagggccaaccctgtgttccaaggggctgaccaggcaggacagccaaggaggcacaagtctgtaagatgggtccaaacatttctgtaggaagggggtcttgagccaaagcaggaaaaatcaaaccccaacacaaagtgtagagagagtcggatcataaatcacacacagacagggtccgagaaacatgggctggggaccagcagacgacaggctaggataattgatcattagaacatctgtgctgtttttgttgtaagaatagtatcaatattaataacaacagcaaatatatattgagtggcttctggagccaggcactgtggtaaacttttgcacgtatcctctcacttaatcctcacagtgctctacaaagtgggtactggtttcatgcccatttcacagagaacatatctgaggctcagagaggcatctacaaggtcaaccaggtaatcaggaaagccagatttcaagggcttgtccacatcactctatgacatgtggggaactcaagtgtgtgttggcttaactcaaataaatagtacaagttaggctgggcacggtggctcatgcctgtaatcccagcactttgggaggccaaggcaggtggatcacctgaggccaggagtctgagaccagtctggccaaagtggcaaaaccctgtctctactaaaaatacaaaaaattagccaggtatggtggtgggcatctgtaatgccagctactcaggaggctgagacaggagaattgcttgaaccccgggagacagaaattgcagtaagccaagatcgtgccactgcactccagcctgggcaacaagagcgaaactccgtctcaaaaaaaaaaaacaaaaaccaaccaaccaacaaacaaaaaacaaataaatagtaaaagttacttctcaacacgagccagtcattttttaaagtatcttacatttttcttttcctttacttattactttttgaattgacaaacaaaaattgtctataattattgtgtacaacctgatgttttgaaatatgtatacattgcggactggtgaaatcaagctaattaacaagtggtggggatgcttcaaatttactctcttagcaatttgcaagaatacaaacacttttattaattatagtcactattttccaaacaaggaaacgaatgcccagtaaaagtacaaagtaacagaactcctcactgaagctggggtcatgggtgaaaaagataaatataggctgggcgccgaggcttatgcctgtaatcccagcactttgggaggcagaggcaggtggatcacctgaggtcaggagttcaagaccagcctggccaacatggtgaaacctcatctctagtaaaaaaaaaaatacaaaaaaaaaaaaaaaaaaaaaaaaaagctgggtatggtggcaggtgcctgtaatcccagctactcgggaggctgaggcaggagaattgcttgaacccaggaggtagaggttgcagtgagccgtgaacgtgccattgcactccagcctgggtgacaagtgcgaaactccatctcaaaaaaaaagataaaatacaaatacatccatatataattaaaatatgatagtggtatgttttcctgtttaacaaatatttacttccctctcattcccttcaccatgggaagaacagaatcctctgccctgttagtgatgggtttgttttggccaatggaacatgagcagagctgacggtgcaccagttcccagcttaggccttaaaaggcattgagtatttctgctcactcctctctggaagctgccaaccttcaccaggtaccactgcttctccaatctggacctcagaaataaatgtaagaatcagacttgaactcaacccacagcctaaagcagaatctctccagctaaaccacagacctatgagcaaaaaataagtgtttatttttataaccatgagggtggtgttacttgttacacagctacaggtaactgatacatttacacgtgaatatgtgcacatactatacatgtgcatattatataggatacatatgtgtggccgtgttacatggaaatagatacgtataaatccttaaaatgtatctccatatgtgggatatttatacatatctatttgggagatagtaaatggggtagaatttggagactgctaaatttgcattcttgcgttgacacaagctgtgcattttgggggaaattacttgacatctctgagcacattttctcctttgtaacatggagataaagatgaagcttatctcataggattactgtgagagttgagtaaaataatacacgtaatgggcttagcagggagcctaacacacactcgctcacacccattcattcaataaatgttattgagtaaccacatttgccaggccctcttattggtgtttagaacacagttactagctgtggagaaaaaagcaaaaataaaaaggataaggagagccagcagccccggaggaggagggagggaggcataggatgtgcctgtgcctggcacgtagtaagtgctcaattattggtagccatttttattctcaaagtgattaacgtgagaacaagggggtcaactggagatttaaaaaataataatcagtctctctgctccgcagcagacccctgagacccttggcaaaccccagcaatagatcaaggaccttcagtaggtgaatacagtcgcaggaactgctagagctgacacatagtccctgcaactccagccagacgccagcaccagctgccactgggagatgtgagcttggcttctccatgaaagagaaagattcctggggcctcagccgtgcctcaaacccactgataacatcaaacacacattgctggggggagccggccaggtgctcagaagctgcagggtgaccctgcgtgtaggtgtcgggaagtcagcagcgactcgggggtggagaaacacccacacctttgcaaacactcttaatgtaatgcactgcccttgaggccacctcccgtttttttggccctaattggcatgtttttctatctcctcagaaacagccacgggagacaacattccatagcagttaaaagtgtggtctctgggtttgcaaccagactattccccaccagctgcaaccttgggcgagacacttaaccccaggagcttcccctcccgtggttgtgatgattaaatgagataaccagataaccccttagatggcaaacactcagcacagtgcctgatgctcatcattgtggcttttattacggactcattttataaacgaggacatcaaggcccagacagcttaagccatttgctcaaggtcagaaggtcactctaaccttgccatcaaaccttgggattttctttttcctccatcacaccatccccaactgatctactcctcaagtgaatttcagaaatcctccaaagatgaattttgatctacctagagctgtgctgacttaactggagcatagcacatattttcaaaacaggaggaaacttgaccacagctttgagccatgtggatgataaagtcatcgtaggtgaacttgagactgggattcggcccttgtgtcgattgtgattagcacagagtgaagcagcgtcattctctcgggggtaatacccgagattcgttgcctcataccaaaaacattaaggacacagacacacacaaagagtgagtttaaaagcagaggtttaataggcaaaagaatgagaaaggagaacgctgtctctcttccgagaggggggcacccagtgggacttctggcccaagtcagagtgcaccagattttacacggttggggaggcggtgcctgatttactagggcccaaagattggttgcaccaggtgtgacatttacatagcgcatggggaagttggccgccccaccctagtgttattatgcaaatggggtctttgcctggctggctccttgttgcctgctccttactgtacacatggctggcaaagagaagggaagatggagctgccgtgttggacgtgcctagccccagctagccttttcttatgggcggagctgccggcattcacccgtgcaagcttccagcttgcttgcctatgtctgcagcttgattttacaggatgctctccgttagaaaagaaaaatgatttggggactgcttttcattaaaaggaaaaccttactgaggacttccttaccctcactatctgcctaaataatttcttcttaactcttacatcagtaatatgaactcaacagactgaaagtaacaatcagatcacaaacacagatgtctacagagtctggaggtttctagggtgactatccatcctggcttgagcactgcaagtcccacactctgggaatccgctcgggcctgggcaaaccaagacagctggtcaccctcgccgtaacataagtgagtgaaggtataaaaagctgtgcctgtctcagcgttttccacttctgagaagcaatcatgtatggtggttaaaagcaaggactctagagccagactcacttggtctataccccacctccgttgcctaccagctgcaggacctcacacaggattacccaacctcaccatgcttccgtttcctcacatataaaatagagatattagagccccctaccctaggtcagcctcaacaccactgacattttggacctgatcgtcctttactggggagtctggggacagccctgtgccttgtaggatgtttagcagcatccatggcctctacgtactggatgacagtagcacagtatgccctagttgtgacaatcaaaaatgtctccagacattgccaaatgtcccttatggggatagaagtgtccccagttgagaaccagtgttgtaggcagtgttgtgaggataagggaggtggtacatgcaaaatgctgagaaaaagccatgacttggagagtctgtttctacaggaacagccaataaagccttagagatggagcaggaaggtggcaagccaagagctgagcaagcaggaccttggagggaccaagggcagggcagccaagccactgtgaaatggaacaagctctgcaaacggaggccagcccggccaccctccccctcacctctcacacaagattggacttctatttcaccccaggtgcggaaagtggagtgaattactcctcagtttctggcatggcaccacggtgcagtgcaaaaccccctcagctgaggtattcctcttctcttgaatgtgtgcgcattcttgtgaagtgcatttgctcatcaaatattgagtgttcagaatgtggcacgaagacagcggtgaacaaaatagacagaaatccctgccctcttgtagctttaagcatactgtcttgtgtacaaatacatttttaaccaataaaaattgtgtcatactatggtctagatatggtttgttttggcccctgccaagtctcatgttgaaatgtgatccccagtgttggaggtggggcctggtgggaggtgttttggtcgtgggggcagatccctcaggaatggctgggtgccattctctcaagagtgagtgatttcccactcttagtttctgcaagaactgattgtgtgtgcgtgtgtgtgtgtgtttcaagatgtaatctcgctctgttgcccagactggagtgcagtggcacgatttcagctcactgcaacctctgcctcccggattcaagagattctcctgcctcagcctcccgagtagctgggattacaggcacccgccactacatccagctaatttttgtgtttttatttttttctatttatttatttatttatttatttattttgggacacagtctcgctctgtcagccaggctggagtgcaatggcaagatctcggctcattgcaacctccacctcctgggttcaagtaattctcccacctcagcctcccaagtagctggagttacaggcaagagccaccatgcctggctaatgtttgtatttttagtgcagagagggtttcgacatgttggccaggctggtctcgaactcctgacctcaagtgatccacccacttcggcctcccaaagtgctgggattacaggcatccagtcgagaactgatagttaaaaataacctggaaccctcctctgtctcctattcttccctgtctccttcttccttctctcatcctccttcctcatacccctcttctctccctctctctctctctctatcttaccatgtgatctacacacaccagttcctcttcacttctgccatgagtggaagcttcctgaagccctcatcagaagcagatattgatgccatgattcttgcagaatgatgagccaaataaactttttttctttgtaaattatccagcctcaggtgttcctttatagcagcacaaacaaagacacttgctataaattgattctattgctcactttttttccccttgtgctttgtttttaagatccatccaggccgggcacagtggctcacgcatgtaatcccagcactttgggaggctgcggtgggcggatcacctgtggtcaggagttcgagaccagcctggccagtatggtgaaaccctgtctctactaaaaatacaacattagccaggtatggtggcgggcgcctgtaatcccagctactcgggaggctgaggcagaattgctggaacccaggaggcggaggttgcagtgagccgagattgcaccattgcaccccagcctgggcaacagagtgagactccatctcaaaataaataaataaataaataaaataaaagatccatccatactggcatgtgaagatcagacctgtttttctaactaccgcagtcatatcccacagtgagtatctgtcatgctttgcttatctatccccttctgatgcgcacagcagtggcttccaataccccgctaccacaaacccacctccttgaacatgcttgggtgaaactttctctggggtataaatccaggaggggaattgctgctgctcagtctttaatatgcacaggactcacccagggatcttgttaaaaggcagattttgactcaagaagtctggaaggagactcgagaatttccatttctaacaagctcccaggtgatgctgatgctgctggtctgggaccacagagaatatgcagccttcatttgctttagtatcagatctctctagaatgaccgcgccagtccacagtcccagggcttgcttttaaagggggccaaaccccactggcccccctaacacggtgtagacttgcagggctctgctgagagccaccattaaccacaagcatcatgtctgtattgctaccgttcgtcaatacccttgaccatcttgccttaaggaaccctcaatttccaagcacatctccaaatcagagccccaccccctccacaatgcaaagtgggacaatctaggagaacatccagcccaacctcctggctttataaagggagaaaccaagactgagagacttgcaagaaatcacaagaaattcccgtttctttgcatcttactcctccagagccctctttgagtgatcagtaattcgtccacaatttataggacttagttcactttacccatctttttccatctccctgccccaccccactccaccctccccatcccatatcccccagcccaccctgctttttaatccttgctagaatcatccattttgcgaccaagtattgacttcaaatgatatatgagacaattgacatttcaaatattccaggcaggatacagaattctgatcacggcccagtctgaaacatctcctccacatctctttccttattccttctgggcaataattgtccccccaccagcccacccccctcccaacctcgacattaatttcccctgattcatttttcatgcctttgaattctgccttttcaaagcagaatatgtttctgtagctgtttctcatacctcccttcccctcatgaatatttcaaatgcaatagtgatatgatcgttcaaccttaagaggcacaccaactttatcttatttatcttaccgagctgcttccgatcccgggattaagtccaaaacatcctttgagagtttgtttgggttgttttcccccaggctgttgctgctgtgtatgtaaattacaaagagaagcagcctccccctcccctcagccccagccccgggcaccagcccccggcccgagacgcccgccctccctctgccaatccttcctgggagatgcaagacgcgctcctctcaaagccaattggcaggcctccggacgggtccctgccagggcatgtctccctgacttcctccagtggtctcttagaagcccaaaactcaccatgcgaccttgggtagggcgttccgccactcaggcaagtttccccatctacaaacaaggggattagacacggcgaccctaaagtcctttcagctctgagactccatgtgacgtgatgtaatgtaacagacacagcccttcctggttccaatccaagctctactactaaacgagtgatgagatggctcaccaactgtacctaccactgactagctgtgtgacccttaactaactgtacctaccactgactagccgtgtgacccttaactaactatacctaccactgactagccgtgtgacccttaactaactacacctaccactgactagccgtgtgacccttaactaactgtacctaccactgactagccgtgtgacccttcactaactgtatcaaccactaaactatccatgtgtcttttaattgtgtctaccattgactagtcttgtgacccttaactgtctgccactgactagctgtgtaacccctaactaactgtacctaccactgactagctttgtgacccttaactagctgtacctaccactgactagctttgtgacctttaactaaatatacctgcctctgactagatgtgtggcccttaactaactgtatctaccactaaactatccatgtgtcttaaactatccgtgtgtcttttaactgtctaccattgactagctgtgtggcccttaactgtgtctaccactaactagctgtgtaacccttaactaactgtatctaccactaactagctgtgtaacccttaaatctatcactaactgtgtgacccttaactgtgtccaccactgactacctatgtgacccttaactaacagtatctaccactgactagctgcacaacccttaactatgtcaaccactgactagctgtgtgactcttaactgtttctacaactgactgactgtgggacccttaattgtgtccaccaccgagtcggtatgtaacttgtttctaccactaactagctgtgtgaccatgatgcgagttacagaagttctcagggtctcagtttcctcccctgcagcatgcattggttaatagcagctgcctctggggctgtagtagggtgaccagccatcctctttggtttatctaggaccgaagtggttccaggtatagggaacgctcagtgtcaaatccagtaaagtgctaaagcaaacacaagtttgtcacccaaggttgtagtgagaactaaaggtgaatgaggtgacatggataaaatctagcacatcaatataagttagtatcattgctattgctattgctattgctttttgtttgtttgtttagagatagagtttcactcctgtcacccaggctggagtacaatggagcactctcggctcactgcaacctccgcctcctggattcaagtgtttctccatactcagtctcctgagtagctggcattacaggcacccaccaccacgcctggcaatttttgtatttttagtagagacggggttttgccatgttggccaggctggccttgaactcctgacctcaggtgatccacccacctcggcctcccaaagtgctgagattacaggcgtgagccaccatacccggctgctattgttaacggttctgctcatggctataaaggaattttttttcacttctaattttttctagaatttcagatttctctttatcaaagcagtacaagcaaatgatacaaatgacttgaaatggaaaacaaagctgtcttaccccagcccttctcccatcaaatccctctccccaaaggcaggcagttgaagtcctttttagcgactgatcttttaaggctgactctgcctcagtcacgctctgttcccactacttcaggccctcaccacattggccaggctggtcttgaactcctgacctcgtgatcctcccacctcagactcccaaagtgttaggattacaggtgttgagccaccgcaccaggtccatcggttttcattaccaccacctgacaggtgagcaggctggttcacactctggtcacctggcatggcttgtcacatactggtgaagctgtcacccgcaaaatccagacctgggactgaggaaagagctaagcgatcctaaagagatacagtctctcaggtggcccttgatgggggcaaagagaggaagggacagttcctcttttatttgtccattcacacatgttgggagccaggcattaaatttgcaagccagaaaaggcaggaaaaaccaagtttatggcttttcaagttggttcagaaattactgtacgggccctccaaaaggtttaatgtctctgtggtgtcatcccaaagagaagcacagagaagcaagaggatctgcagctggagagcccagaggcaatgaacactcaccttgactctcttctcatttctgaggctctatcagttaaggttcttagtttgcaagcaacagaaccaaatctttttttttttttttttttttttttttgagacaaagtctcactctgtcgcccaggctggagagtagtgcatgatctcggctcactgcaagctctgcctcttgggttcaagcgattcttctccctcagcctcctgagtagctgggagtacaggcacacgccaccatgcccagctaatttttgtatttttagtagagacagagtttcaccatattggccaggctggtctcaaactcctgacctcgtgatctgcccaccttggcctcccaaagtgctgggattacaggcgtgagccaccatgcccagccaacagaaccaaatctttacattaaaaagcggggagcttataggatcagagaaagaatagagttcccagacttgagggggttccagttggaccatctttgtatggtggtggatctcaaccctcactgcagccaacagtcaaccaaagagacttttagaaaccactgatgctgggccctcaccctcagaaattgagatttaagccgggcacggtggcttatgcctgtaattccaacagtgtgggaggccaaggcaggcagatcacttgagcccgggagttcaagaccagcctgggaaacatggcgaaacctcgtctctactaaaaatacaaaaattagctggatgtggtggcgcatgcctgtagtcccagctactcaggagactgatgcaaaaggatagcttgagcccaggaggtggagattgcagtgagccgagattgtaccactgcactccagcctagatgacagagtgagaccctggcagggcaaggcagggcaaggcagagcaaggcaaggcaaaaaggaaagaaactgagatttaactggctcaggtctgtcttgtttcacacctcccctaggtgattctaagatgaggttgaaaaatgagattcactactctcgggatgcaactgcaccgtgagtccagaaaccagcagtactggcatcaccatctccagtagagctcgtcagaaatgcagactctctctcagaaccaccccagacctttcgagtcagaatctgcccgcgaacaagatcctccagttagcgttaagcagattaaaggttgagaagcactaggctgcagggtcgtggaatgactggactctaatcactctacatccttgatgatctctccttaagatgcaaattcccagaaggcaagcatgtgatgggccatgcttttgtcacaccatgatagaagatctgggcataagaaattctgcagagtggtcccaccagacccacaggcaggagaagggccatccctgaacggagtgggatgcggggctgataaatactacataggttaagcacagcgaccttcacagttcagagatagtgatgccaactaccacttattaagcacctactgtatgccaagcacagtgccaaggactcaaattactcatggaattccccctataaccatgaagccaatattattattactgctacagctactactactattattttataaaggaagaaactaaggtttagagcagtagatccaagtttagcacggatcagaatcacctggaagatttgtaaactcacagacttctggaacctaccctcagagttgccggttctgtaagtctagggtaaagcctgagaatttttatttctagcaagttcccagatgatgctgatgctgtttgtccattcacacatgttgggagccaggcattaaatttgcaagccagaaaaggcagtaaaaaccaagttaatggcctttcaagtcagttcagaaatcactgtacgtgcccccaaaaagggaatgccaaacattagggaagtccccatcttcacaatgagaacttacccacctcagagagatggtttccccaggaaacaagtgcagatggcattttgcagaaagtgcacattgaaagaaagcaaactggcttagaaatatggttaatgggaattctttggaattcatagcatcaggagagagtcgtttccttctaccacacacctggctgggagggtgacaatgtctttaggagggagagactgggaaacattaataccagagccctggctattatttgcaatgtatagcaatgtttttcctcaaggtagatctttggtgagccgtacacagtaaagctagccattcaggtggaattacatccaactagtcatctctgtcatactaaaaacagtaaacaatgcttgaagaagtcagatgcctggcatcaaatctaagatccaccatttactggctgtggtcattaggcaagatgcttaacgtctttgtaccttattatcctattttgtaaatgggggaattataataatacctaatctctaggttactggatggactaaatgaaataatgtgtgaaatttttagtaacatagctagaatattacaagctcccaataagtctattgtattagtccatcctcacactgctataaacaactggccaagaatgggtaattgataaagaaaaggggtttaattgactcacaacaggtctgcatggctggggaggcctcaggaaacttacaatcatgacagaaggagaagcagacatcttcacaaggcgataggagggagaagtgagagcacgggaaaaaactgccacgtttaaaaccatcagatctcatgagaactcactcactatcatgagaccagcatgggagaagccgcccccatgagccaatcacatccctccttcgacacgtggggcttacagctccctccctcgacgcaacacctggtgattataattcaagatgagatttgggtggagacacacagccaaaccatatcacctattttatttatcataccattagtgttattattattattggtggatgtgctggtggcgttaatattgttggcaaaactggaactagctggatctttatcaataattgcaatcatgattctgacatctgacccttccatgccactggtaggcatgtaaacaggcacaatttttctggaaggtcatttggcaatatgtatcaagagccttacaaatactcacccattttgacccagaaggtccactcctagaaatttattttaggggagtacatccagttgaggacaaagatgtatgcccaaggaagccatcacattattgcaaatggtaaaaaatgaagtgtcaaccaacagaaaaatgtttttgaaattacactatgttcgtacaatgaaatcttcttccaattattaaaataatgttcatgccttttaattggggtgattgtataattttatatctttataaaaatatatgtatgtaagacttcatatagatgatgaactcagttatgtaaacatatgatagaaaaagagaagggaataatccaaaagccatctgctctgggtcttggaatgggaattcttatggttttgtgcatttttgcagctatttctcaatagtcccctttataatcagagcaggctgggtagaatctggtacaggagattgtggcaaactagataattaacccagagaacattatttctgtctgggtatgccattaagttacaaagaccttttgtaaatgtgggtaataatgaaaagagggctatagtgttggaaaggaagacaggagataaggaggaatgaaaaggagtaggtattatttctacagagtcttgaaagattaagaaaaatgaggcagccagatgcagtggctcacacctgtaatcctaacacttcgggagatcaaggtgggaggattgctggagcccaggagtttgagaccagcctgaatgattgagtaagactcccctctctacaaacaaaatttaaaaaactagccaggcatggtggtgtgcacctatgctcaggaggctgaggtgggaggatcacttgagcccaggaggttgaggctgcagtaagccgtgatcacaccactgcacttcagcctgggtgacagagcaagtccctgcctcagaaaaaaaaaaaagaaagaaagaaacaaaagaaaagaaaagaaaaaatgaagcaaaagataccagcagcattggctgagccctagaggtaatgggaagggttgatggggcaagatcagagacttctgtgatgtttccatttgatgagacaaaactcagcattagcagaattaaagttacctaatctctagattaggaaagggaacagagaaatacctcatggcaacacatggcctttttgagttgcaagttgacagaaactcaagtcaaactggcttcactgagaaattcactctaggtgagatctgtcatcaggttggaggggatacaggctgttaggcagtgtgatcggctttccttctcctctctcagctcggctctcctgtgatttccttctcaggcaggctctcccccagggtgatgagatgaccaccagcagctcccggtttccaccctaccaggtttgcaaccccagcaaaaagagaacccctctttccctatccacctaacagaagtcctgccactgatgctctttgaaccaccttaaaggcaggtttctgaatcaatcacaacagccaggagaatggcattctcccatctgccaaacccagtctctcgagtcacccaaaacacatgggctgagaatggaggagaggtcccacctctcccccaaaaaagtgagatactggtctaagaaacagaaaaacgaagcttacataggctaaatgaacccagaagcactatgtggagtttttccttccagaacatgaaccaagtactcaagttacccccagatggtatcagaaggaaggattcaacagtgcccttaaaaaagggccatggttctcaaccaggggtgattcctcctcctcccctcaggggacatttggcaatgacaatggggcagggggttgtgctactggcatctagtgggcagagcctagggatgctgctacacaccttacagtgcacaggacaaccctcacccaaaggattatctagcccaaaatgtccacagtgctgagactgtgaaacccagaattaggatgaccttataagttattgcccaaaccagaatgctttcgagacaggcaaaaccaggaaagcagtcgtaacagggactgttgcagcaaatgaggacatatggttaccctactctcaacacaccgtccaaacagaaggcaaagccattctcactgaaggctgtgattcaagggaaacgtttcaatgctccccaccccaatcatcaattacaggaccacaaagatgctcttcccagccgaggcttgtctttgaccccttctgctctctcccacttccggcatggctgacagtccctcccatctacttctaagaggtcactaaaaatcgaccagggcttgccagcctagtggggttgcccaaatgtctgcccacagatgctgcttcgaaaagctgtctctggcatggcccctactgcagcggcgcgtgacagactgccttgcttggtggaaggaatcccaccccgattaaattgctggagccctgctgggaaggaggtggaggcaggaggagaaggagagtagggagccaggcaagccactcctgcctctcctttttcatcttggaagagccaatttcaagcttgcctcgggtcataaaagaaattaatttgattctctcagccttgctcagagtggacacacgtcttcggctggagcatctgctgctgctggatccagagcaaggagaccatcccctcgaaacgattccatttctgttgcaaggcagggccagaatcatctgcctggagctggagaagcagctgcctggaataccctgggctgtcatttttgctggtaagttccaaaaacggttctcacagctaaggtgactcccaagtctcaggaggtttacccagagagatacgcacgggtggggctggttcttggaaaactcccaaccagaatttagcactggcagctgcctaacccacttcatattgatcagcttgatcacactgagtcctcttaactgtcaggcacggcccctgggctgtattcctgattgcacacagctaaggtgactcccttgtacaagcctccccgcctgagagaggatggaatttgtgacctgcttctaatcaacagaatatggcaaaggtgccgaatgtcactctcttgatcatgtttccaaataagatttccccttaggagacttagggactcccttgctggctaggaggaagtaagctaccatgttgtgacagggccatgtcaaagaatgcaggtggcctctagaagctgatagaggtccccagctgacagccagcaagaaaacaaggcctcagccaggtgcagtggctcacacctatcatcccagcaatttgggaggctgaggcaggaggatcgattgagcacaggagttagagaccagcctgggcaacatacagaaacctcatctctaccaacaatttaaaaattagccgggcgtgaaggcacctgcctgtggtcccagctacttggcaggctgagatgggatgatcccttgaatctaggagttaaaggctgcagtgagctacgacttaccactgcactccagcccgggtaacagaacaagaggctgtctcaaaataataataataataataataataataataataataataataatttcatttaaaagaaaaagaaaacaagaacccagctttacaactacaaggtaagtcaccagcaactgccatgaggacccattgtctaaatcttttaatgtaaaataaaactacattagaaaccacacaaaccaaatgtgtagcttcttcagcctttccttatttttctaaggttgtacaaaactattgtatttacaaaaatggcacaaaagtgaattcagcagtcaattcacatgcatacttccttcacatcttcaacaacaaaaggtattctaactccaactctacagagcttggcagttttcaggagtactggggacggattttgcaggatatatctctgtattagtccattttcatgctgctgataaagacatacctgagactgggcaatttacaaaagaaagaggtttattggacttacagttccatgtggctgtggaggcctcacaaatatggtggaaggcaaggaggagcaagtcacatctgatgtggatggcagcaggcaaaaagagcttgtgcagggaaattcccatttttaaaaaccatcagatctcataagactaattcactatcacgagaacagcacgggaaaaacctgtccccatgattcaatcatctcccaccaggtccctcccacaacacgtgggaattatgggagccacaagatgagatttggaacacagagccaaaccgtattagcctccatttgagtttgtctgatttttttcttttttcatgattagactcaggtcatgagtttttgcaaagaataccacagaggtgaagtgcccttcttttccaagcttgtcactcatccatggtgtggttcaaactttcccttgtctgtgatgttcctgcaactagttctagatttttagactgcaataatctcattataaggtacagagctcattcaagaaggataaggggcatattgatttcctaaggatgattaacaaaacagcacaaacgaggtggcttgaaacaagagaaatttattctctcacaattcttgagggaagaagtccaaaatcaaggggttcacagagctgtaccccgagcctctggggaagatcccatcctttcctttcctggcttctggtaaccataggcattcctgggcttgtagcagcttcacttcaatctctaccttgtgctcgcttcggcagcacgtacattaaaatggaacttcaatcgctatccccattgtcacaagggggtcttccctgtgggtctgtgtccaaatttcctacttcttctaaggacaatctcgtattagattaagggcccaccctactccagtatcacatcttcgtaattacatctgcaatgaccctgtttccaacagaggtcacattctggggtactgagatgttagggctttcaacatatctctttggagaacacagttcaacctattaaataaagcatcccacaaaaccaaagtcagaaagcacagcagggttttgggatagaaagatagcaggagtcaacacagcctgtctctgtctttctgggagctcccggtctgtccttcctaagtctgtattgtgttctcaatctcttctttctttctctctctctctctctctcactctctctcccccatcttctcgctccccatctccctctctccctctctgtctctccgcccccccatgtattagtctgttttcacaatgctaataaagacatacccaagactgagtaatttataaagaaaaagagcggtcacggactcccagttccacatggctttggagatctcacaattatggcagaagacgaatgaggagcaaagtcacgtcttacatggtggcaggcaagagagtgtgtgcaggggaactcccctttttaaagccatcagatctcatgagacctattcactatcacgagaacagcatgggaaaaacccgccccatgattcaattacctcccaccatgtccctccgatgacatgtggaaattatgggagctacagtttgagatttaggtggggacacagccaaaccatatcaccctgcatatcagttttttctattgcaattgtccacaggccaaacatgactatattgtcaccaactttctatccccctctagtttcaagcaccttccagagataagctcagagattttcaactccaaatttctgggagagagtccacatggcctggctgtaatcccatatccaaccccttggtacacagccatggccagagccaaaagaatcctatggggttctggatctcctagggctctgggaagggcaagtttccgaaggaggaatgggggtggacaaaaattattggctgagaaaatagctggtgaatgagacattatttctggtagggaatgaatgcaagaggccactatgttctggagcacagagaaaactcccactggattctcaggaccgtctgagaggagaggaatttgaaagcagctgaattatcacaggagaaacagaatggagtcagaaaaattctgctttgtggcacttagatcaattctacgtctcatatctttgggagcatgggtggtttcccccaccctccattttcctcttctctctgaacaaaagttttagtttgtgaagtcaaatctcatctttttttttttttttttttttttttttgagacagtctcactctgtcacccaggctggagtacaagtggtatgatctcggctcactgcaacttccgtctccaaggttcaagtgattctcctgcctcaacctccagagtactgggattacaggtgtgcaccaccacatcttgctaatttttatatttttagtaaagacagggtttcaccatgttggccaggctggtcttgaactcctggcctcaggtgatccacccaccttggcctcccaaagtgctgggattacaggaatgagccaccacaccctgcccaaaccttgtcatttctgaaatagagtgtcagggtagtgtcttagttagcttgagctgctataacaaattataatagactgtgaagcttaaacaacagcaatttatttctcacagttctgggggctgggaagtctgagatcagggtgctggcatggtcagggtctggtgaggactctctcctggcttgcagatggctgccttctcactgtgtcctcatgtggtggagagacgggtatcatctctctcatatctcttcttacaagggcactaatcctattcatgagggctccaccctcatgatctcattactttccaaaggcctcacctcctgataccatcacattgggggttagacttcagcctatgaatctgagggcaacacaaccaatgtctgttagttcacggcagacagtgaaatagtggaaaggagggtgtgattgattctgggaagggctggtgttgaactctgactgcaggataaagccctcattggttctctgggccccggtaactgcccatctccccaagagggttcccacatccatttcctcccactctgggagtgagcccagcccagcatttcatcaacaactgatctcaggagccaaaagacacagggagaatatggtgatcagggagctgaggaagagggtgaaaaaaggcaaggggtgccaagcaactcaaccagcacttcccctccatcttctgctggatttgctcctttgtctccccagcaggtaggagggattgtccaagacaaagcattggttaccatctttctgtgccaaggctctgggagacaagactggattgcggtcctccttccttattgtacttattgtctaaccttaaggtacttccttatggtaccattttcacacgctgataaagacatacccccacaccccagactgagtaatttataaggaaaaataggtttaatggattcacagttccacatggctggggaagccttacagtcatagcggaagacaaaaggcacatcttacatggcagcaggcaagagagaatgagagccaagcagaaggggaaaccccttataaaaccatcagctcttatcagacttatttactaccatgagaacagtatgggggaactgcccccatgattcaattatctcccactgggtccctcccatgacacatgggaattatgggagctagaattcaagatgagatttgggtggggacacagcaaaaccatatcacttattctgtaggaagaaatgacttccaaggcattctccacccctgtctacatctgacagatagaattatatttaactatatattagtatattactatgacaataataactcatttattcctcacaccaaccctgtgctatccccgtttaaagatgagaaaacagaggcacagaaggtttgagtattatgcccaagatcattcagctgataaatgccatatccatctaactccaaatcccttgtggttgtacagtcagctgagctggcttttggataaaattggttggaggtgaatagagagaatgggttgggggaaagtggtggatgcccccagcaggtgtctcagaaataatgtgttgtcattttcactgtgaatatctcaggctcaagaataaaatcacttttctatataatgatttgcaatagtcatgattctttatgatgaaaatataacccaaatcaaacttgcctaagcaaaaaaatatatatataacataaaattcaccttcaagggatggggctggagttacccccggaagcaagaagaaaaattatgcagagcgcctggtatatccatcagagaccaccaatgtgttcctgtcaccccaacaggaagcagagaacccaaggctgtgttggcaagtagaagaccctagggacccagagggcccagagagcccagggattcccagtgcaaaccctcagatgccttggtgccttaaggaaaaacacaccagcctcatgctgcctaacttcagcaagaaaaaaaaggaccattcccttaatacaagcctcaattgccctgatgccttatggctgttattttagagaattataatgccacctatgattaataccgcaatgtggtcacacagcaaacgctcataagtaacctcccagcataaataccaagaaaatccagacttaccacggcttcatatacattttagatttttgctaaattggcccttgataaagcgtgtggccaccttcatcacagaaatcagcttcctccccaggcctaaaattagaagccccaactgccagtcgttaggtacagagctcaatgcctgctgagattcccctctcatttatcttctgcggggagcatttcaagttatcgccagctctcgtatcagctggcccggggaagggcagcaggcagcgagaggggcagctaacataggaagaggtcagcaggtgaggggtggctctggaggcggtggaactggctggtccctggaaagcttcccgctgcaggtctagagtggagaactcggactccaacagggaagattgtggctgggaagaattacagaccagatccagggctggattctgaatttagatggggcccgtaacaatttgcctaaatgatttatttcaacaatcaacacatccatatgctcagccactcagaatgatgactgaaataaaaatgaaaggtaacaggctgggcatggtggctcacacctgtaatcccagcactttaggaggccgaggtgggaggattgcttgagcccaggaattcaagaccagccctggcaatatagtgagactgcatctctacaaaaaaaaaaaaaaaaaaaaaaaaaaaagagcaatagaaagagagaattggatgcatgctataacagcctatgatggtagatccagctggtctggggaaaaaggagagtatccaactaggcttccccaaggtcatgaatttttttttttttgagacagtctcactctgtcacccaggatgaggtgcaatggtgcaattacagttcactgcagcctcgaccttccaggctcacatgattctcccacgtcaacatcctaagtagctgggactacaggcatgcagcaccacatgcagctaattttttgtttttttttttcttttggtagagatggggtctcacttcattgcccaggctggtctctaactcctgggctcaagcgaacctcccacctcggcctcccaaagtgctgggattacaggtgtcagccatcatgcctggccagatgatgacatttaagctaagactaggacaatgaggagttatccaggtgtcaagtgagaggaatgcatttatacagagatagtaacatgtgcaaaggccctggggtgagaaggagttccatgtgttgaaggaattggaatgttgggaggaatgaaaagggtgtggcaaaatatgtgggctggggagggaggcaggggctagctcaggcaggatgagataaactctggtaagggttgtatgtgctcacagaaactcattaacacttcactgaatgctaatatttatttatcaggtttcagagtctgtttgttcgtgaggggagggttttccatcttctccacttgaatataaactccttgaaggcaatgacctttggttcacagttctatcaccagcacctagaacaagaactagaacaaaggtaaataaagacacccttatcaggcacaatgttgcaaagacttagtggttatcttccaggagccagtgaagggccagacctttcttaggaatgtgcaggatttgaactccccagacctgctgagtcaactctactgcaggggaccatacagagatgagaaagatgcgacattctttcacttctgggtagcagagtcaacaaatggaaccagggtgcccccaacgcccattacctatgacatcttcctctgaaataagctcaacagatgatggtccctggctacagtgacttttgtcagggatctccaagaccgccctcaggcccattgatttgccagaaggacccacagaatcaggaaagccattgtcctcatgaacattgtttattgcactaaaaggatacagattaaaatcaaccaaggtacaagatgcataggtctctccaagagagaccaggggtaagtttccaatagttttctcccagtggagttagaaggatagctcctaatgctctgtattagtctgttttcatgctgctgataaagacacacccgagactgggtaatttatgaaaaaaaaaagaggtttaatggactcgcagttccatgtgactagggaggcctcacaatcatggcagaagagcaagggagagcaaagggatgtcttacatggcggctggcaaagagagaatgagagccaagtgaaaggggttctccttataaaaccatcagatcttgtgagacttattcactgccatgaaaacagtatgggggaaaccactcctgtgattcaattacttcccactgggtccctctcacgacacgtaggaattgtgggggctacaattcaagatgagatttgggtggggacacagccaagctataagagacaattagcaatgtatacaaagtactgccagccacagcagctcccccaagccttggtgtccaggggttttatcagcatttcatcacccaggcatggagcacctgcatgggtgacttttgttactcagtctccagcccctctagaggtcaaactgacacatacaaaaacaggcactcaccataaattgcattgttagcatggactagctagctcagcctgaggccataggtaaacaaagacactcttatcaggcagaatgttccaaagacttggcggttatctcccaggagccagtcaagggccagagctttctttggaatgtgcaggatttgaactccccagaccggctgagtcaactccttactgcatggggaccatatagagatgagaaagatgccatattctttcacttgtgggtagcagagtcaacaaatggacgaggctgaacgaagacagtcaggtagaaccagaaaccacctccacctgcacccctgcataggacctaaaaaaatgtcataggaccatgacaacttttttgagacagggtctcagtctgccacccaggatgaagagcagtggtgcaatcatagctcactgcagcctcaacctcctgggctaatgctatcctcccatctcagcctcccaagtagctgggggcatgcaccacatctggctaattttttgacttttttttttttttttttttggagagatggggtctcacttcgttgcccaggccggtctctaactcctgggctcatcaggagttagatgatcacccagatgaacaacagggacctcatccctccccaggggtcctggggtaggaccctcagcagatgagaggagtagctctcctggcccatacccatgccctgttgtggtgtttataagcctgtcataggtcaggtttctagagagacaagctgtgggatggagatctgggtgcagggggtttactgggaggagcacctgctggaaagcaaggaagcagcattgggcagagaggggagtggcactgtggaacagtcgccaggacccctgagacaccccctgtgatggttaatactgagtgtcaacttaattggattgaaggatacaaagtattgtttctggatgtgtctgtgagggtgttgccaaaaaagattaatatttgagtcagtggactaggaaaagcagacccaccctcaatctgggtgggcaccatctaatcagctgccagcataggtagaatataagcaggcagagcagcatagaagggcttgactggctgagtcttccagccttcatctttctctcgtgctggatgcttcctgccctcgaacgtcggactctgagttcttcagctttgggactcttggacttttgaccacagactgaaggctgcactgttagcgtccctacttttgaggctttgggatttggactggcttccttgctcctcagcttggagatggcctactgtgagacctcacctggtgatcgtgtgagtcaatactccttaataaactccgctttttatatacatctatcctattagttctgtccctctagagaacgctgactaatacactcccatacggaggggcaagggacagagcctttgtaaccctccaggattatgggatgcctaggaggggaggaggatttcccagcactaggtggcttcctgcaggtgccttcttgccagaggcaggactttgctatgagctgttagcagctaggtctcccagcagctggggggacagagggcctcggtggtcctgcacagaggtctgagtggtgcagcacccacagcgaagccagtgaccaaagtggaaagataaagatatgaaaatctttcaactaattaagatttaaaactcagattgatgtgaggatcctgaattgactgtttaccaaagagactaggttttaaatgagaagggtctgggtttacattgacttggcaagactgagtgtcctatcactggagtgacaagggaggctggtggggatggatccagggaaaagaagcaaagtatggaacaaagaagtttagaataaagaaagtggccaaggctgggcgccacggttcacacctgtaatcccagggtggccaaggcaggaagattgcttgagcccagaagttcaaggctgcagtgagctatgatcatgccactgcactccagcctgggtaacaaagcaagaaaaaaaaaaagcaagaaaggaagggagggatggaggaaggaaggaagggagagagggaaagagagagagaaagaggaaagaaagaaaaagaaagaagaaggaaaaaagaaagaagaacgaaagaaagaaaggaaggaaggaaggaaggaagaaagaaagaaagaaagaaagaaagaaagaaagaaaaaaagacagagagagacagaaagaaagaaagaaagaaagaaagaaagaaagaaagaaagaaagaaagaaagaaagaaagaaagaaagaggcatcaaacctcacaggttgaggtaactgtaaatacacggtagtttatccctgagcacaaaatctcaatggcacagtcaaagccccaaagaagtaagaaacaaacatcatttccaccttttgggcctgaagaagcaggtacattagagaagggcagccacaatatctgtgaacagtcattaagctctcagacacagcatcccaccttcaccaatctgatctccttgacgggggtgatgctccctccaagataacaaagaaaacctggccaggcacagtggcccacgtctgtaatcccagcattttggaaggctgaggcaggaggattgctagagcccaggagttcaagaccagcctgggcaacatagtgagacccctgtctcttaataaaataagaaaaaagaaaaggaaaccttccctttacatgaaggcatcataccttaaatgcacatcccatctgcccaggaggctcacctctagatttgtatcctactgatgaacacacaccaagatggacatactagcataaattgtggagaatgacagaaaatatcctgaatgtccaccatgagggaactgattaatttatacacatccgtatactggaatactacacagctgataaaaagaataaggaatgtctatatggactgctatgcaaaaacctcaaagatatattgttgaatgaagtcaagatgcagtgtaatatgtacaatgggctatcatttataaaaccgggaggagacatatatacatatgtttttctatataaagattgtatctctggaaagtttcaagagaagccagcaacacttttgaccttggagaagaagaactggtggttgggatggaaaacaaacttaattttcactgtatactttttctggtactgtttaattttttttttttaccatatgcacacgtttcctattcaaaagagaatttttttgaataggaaacaatgaaaaatcttataggcatacaaactaaattaattagccatccctatagcttcaacatgcatttcaatttgcaagcaccctggcctccaagattgattgattggctgtaaattgagaacctcagcaatttcctttcacagggacagatgttgacattattcctgtgatttttcacagatgtttcccttccagcatctttaaaatcgagttttctgtcaatttggaaatcccaaatttctcatatcaaatcgagatgacaggaaaatcaaaaccgttatcacattttgaaagagtttatggatggcaaatgacactgggaagggagatgtttaaggagcagccgacgtctcttaaccctttctcatcacttcctgcctcagtttacctaagccagcaaaaggggaaatttgattcaatatacagacaagggctttagagtctgcgtagcggtgcgatctcactttggctccaactctctagctgtgatactttgaaccagttcattaacttgcccagcctcctctctctcatctgtaaaatggggataatatccccagccttgcagtgtgattttacaattcactgatgcaaaaatggaaaatgcgtggcacttagcaccacctaaatgttttttcctttttttttccctttccctcctccttcaccaatcctccaagcagcttttcttccttcttcatgtccccattttgctcacgagattccaagatttacccactgaagctctcatgagattcccagatttacccattgttgagaaatcagaaacatcccccaccccctagaattctcctgacctgtgtcccctccccttaggactctgctctccctcagtgacaacaggcaggaatatgatctactcatacaaaccaaacctctgctgtttgtacatcttagctaataatgcccaacacacagccaacatttactaagtcaggctcttgagagccacttcatctgcatgacgccacaaaatcctctcagcaacaaaaaggcactgttattatttctgttttagagatgtggaaatgagcaccagaagtagatgtaacttgacaaatatctgggtggtagatctggaaatcaaagaaccctgaaccccaaccacagacacatcttcagttcaggctgggtctctacgctttgttatttttaacggggcattacgctccctggatggctatgatgctgcagttaactctgctcttgtggatgaatgcaattatctggggagctcgcacttataagatgtacagctatgggcaacctaaggcacatcgtggagtcttaatttcctcatctgtcaaatgagaatagcaaggatggcagggagggattaaggagcatttttggaaaaggaagtgctatgaaatgaacgtttgtgcctccacccccaaactgatatgtcgaagctgacaccctaattaccagtgttacggtatttgggtatttgaagatgcggctttggtgattatgtttagatgagatcataagcctaaggtcctggagatgtgatgtgtccatattagaagagacaccagagatacctttctctctctctcactcttgcttgatctctccctctctctcttgcactctctctcatgcttgcgtgctctctctctcccctgtgaggatacaacaagaaggcttccaactgaaagccacaaagagggccctcactggagaaacaaatcacccagcaccttgatcttcgaattcccagcccccagaatagtgaacaataaatgtctcctgtttaagccacgtagtatgtggtattttgtatggcagcctgagcagactgccacagtagatggttggtctttcctccaaccaataatagatggcttgtcctttccatcgcccaccttgggcaaggcaaacaggacagtgaaggcaagcacatctcacagacaccagcattcatgtgctaatgaggctcactactagtattgcaaagatgggaagtcaaacagaattatgtccttgcgaacatacaataacttggaaaattttattgaaagacattaagtttgcatacacacaaaaatgagtgaagagttttttgttccattgaataatttagaggacatctaagagaacacaagtttgaaatcttattatattttgtataatgatacataataatttccatgataaagctgatgtgtattgaggagatcatatgtgccaagcactcactgtgtgttaagcatattctattcattgtatcatttaatcctcaaaatattatcaccgcctgtattgattggggttttccagagaaacagaaccaatgtctaaacagagagagagatttcacgcaattatggaggctaacaagtgctgtcatctgcagggtgaggcagcaaactggagaccccagagaactgatggtgttagttccagtcctaaggccagcaggctcgaaacccggaaagagcagtgtttcagtctgagtacaaaggcagaaaaaagccaatggtgcagtttaaaaaccttcaggcaggaggaattctctcttacttcggaaaggaccgacttttgctctattcaggtcttccgtggattggatgaagtccacccacattaggaggggcaactgctttcctcaatctgccaatttaaatgacaatcatcccaaaacgccctcacgaacacacccaaaatgatgtttaggcaactagctgtgcacctgtatccctaagagttaacacataaaacctaccatcccatcactctttccaaatagaaaaagtgaggctcagagaggttaagtcacttccccaaagtcacagagcttcttataagtggtggagggtttgactgaggacccatgctctattgtaatcatagaaaatcctagtggaattttccaatagaataaaacgcctgcccagctgcagccaaacgttccatagacaatgtctctgggccttttgtggcagaaaaaccaacataaggaaaagaaggctggagatgccagttttatcaaactcccataaggtaaagggaaatatctttctggggaaaggagactaaaggagaaaattaacagccacttttcagggagagagaaagagcagggacccagcccctctgagactgtgggctgggtgtggcctgagctgattggcagctccattgtaactatactgtaaaggaatgactctacccaaactgagctaaaggagagtttgaagcatttttaaaaactctgcccaggccaggcgtggtggctcatgcctgtaatctcagcactttgggaagctgaggcaggcagatcatttgagatcaggagttcaagaccagcctggacaacatggtgaaacctcatctctactaaaaatacaaaaatcagctgggtgtggtggtgcacacctgtaatcccagctctttgggaggccaagacaggtgaatcacctgaggtcgggagtttgagaccagccaggccaacatggtgaagtcccatctctactaaaaacacaaaaattagctgaacatggtggtggacacctgtaatcccagctacttgggaggctgaggcaggagaatcacttgaacccaagaggcagaggttgcagtgagccaagactgcgccactgcactccagcctgggtgacagagcgagactctgtccaaaaaaaaaaaaaaaaaaattctcagacaaccagcagtgatacaagagataaaaggcatctggctttacgctgcaaacaaaagggaaacaggaagtgagagagcagttggcctctaagaagcatccatttgttttaccctgccaggtgcctacaaggtgatggttttgcctcccaaatataatcaggggcccaatctctgcattcagagaagtatatttcagcaacccataagtaatccaaaagcagttccccacacatcagctcaaacagtgttacaggacaggcattcttggtgccatcagatccaatgtcccatgttttaaccaacaattgaaaagccctcttttttttttgagacagggtcttactctatagtccaggctggagggcagtggtgggatcttggctcattgcaacctccacctcctgagttcaagcgattctcgtgcctcagcctcccgagtagctgggattacagatgcgtgccaccatgcccggtacattgttttttttgtatttttggtagagacagggtttcaccatgttggccaggctggtctcgaactcctgacctcaaatgatccaccagcctcagcctcccaaagtgctgggattataggcgtgagccaccatgcccagctgaaaagctctcttttctaccctgaaaaaaaaaaaaatgtgctgatcctataacccatctactcttctaaccaatcacaattgtgccctaattataataaaaaggagaaatgaaatgatgaggatttctaatgaaataatatatagagaaatgatatgggtttccaccaggaaagacggagcgaagcagtcaagtgctcacacacgtgtgtgtagaataaccagtgacagtcacaaacgcagacagcgtggtgtgttgtcgcatcggctttactgagagtgccatgttcttcaaaagagtggctctttcttgataaattcccataccaaacagagtcaaatcttctcttgatttacaccatagctgctacattcttggaaacatcagtgttcattcaacacttacatgtaaaatagaacatgtaaacatataaaatagaataggcagataaaatagaagaaggttggaccgggcgtggtggctcacacctgtaatcctagcactttgggaggccaaggtgggccgatcacaagatcaagagagcaagaccatcctggccaacagggtgaaaccccgtctctactaaaaatacaaaaattagctggacgtggtagtacccgcctgtagtcccagctactcgggaggctggggcaggagaatcgctggaaccagggaggcagaggttgcagtgagccgagatggcaccactgcactccagcctgggtgacagagtgagactctgtttcaaaaaaaaaaaaaaaaatagaacaaggttatagactctgataatcatggttcttctaacccatatgaatttgggatctacacatatatatattcaaaaaactaccccacaccgtaatgactcccccatccctatcattagggcaaccaaaagctctctgcagatttaaaacacacacacacaaacacacacacacacacacacacacacaaacacacacacacacacacacacaaacacacacacacacaaacacacacacacgggacaattcagtccccagtgagaacctctgtaataaaaggtccaattcctaacccgcaataatattcttttttttttttttttgagacagagtctcgctgtcgcccgggctggagtgcagtggtgcgacctcagctcactgcaagctccgcctcccaggttcacgccattctcctgcctcagcctcccgagtagctgggactacaggcatccgccaccatggccggctacttttttgtatttttagtagagacggggtttcactgcgttagccaggatggtctcgatctactgacctcgtgatctgcccgcctcagcctccaaagtgctgggattacaggcgtgagccaccacgcctggcccacaataatattcttaaagtcccctttcccgcctcctcagttctcccacaattcccagtttccccagaacaaaccccaagagatttctctgcccttccccccacccccaggcagagatgtcttccaactcttccccagcactgtaactctccactctggtcaagtggactccaccttggggaaagaatgtttgtaccgggcaccaaactagactttggagatacactagttcttagtatctgctagtgtgataattaaggtaattatttagaccaggaatctgcaaaatacagcctgaaggccaaatccgagctgcttgttttcctatggcctgaaagctaagaaagaatggttcttacattttatattattattattattattattattattattattattattattactattttgagatggagtctcgctctgtcgcccaggctggagtgcagtggcaccatctcagctcactgcaacatctgcctgccaggttcaagcgattctactgcctcagcctcctgagtagctggaattacaggcacctgccaccacacccggctaatttttgtatttttagtagagacagggctttaccatgttgtccaggctggtctcgaactcctgacctcaggtcatccgcccacctcggcctcccaaagtactgggattacaggcatgagccactgcgcccagctagttcttacattttaaatagttagtgggaaaaagacaaaaggaataatacgtcattacatgacaattatatgaaattccaatttcagagtttataaataaagtattgtctgtggctgcttttgtactacaatggcagggttgcatggttgcaagagagcacatggcccccaaagcctcaaataatccactatctgggcctttacagtaaggttgtcagcccctggcttaggcactaaacaagtgctttcaagcacctactatatgccagacactaaggtaatagagaggggagacaatcaacaagaagcattctttctcaaaagttttaggctaggcacagtggctaaagcctataatcccagtactttgggaggtcgcggcaggagggtcaattgaatgcaggagtccaagaccagcctaggcaacatagtaagaccccgtctcctcaaaaaatgcaaaaaaaaaaaaaaaaattagttgagcatggcagtgtgtgcctgtagtcccaggtagttgggaggctgaggtgggaggatcacttgagcccaggaggtcaaggctgcagtgagccaagccatgatggtgcaatggcactgcagcctgggagacagagtgagaccctgtctcaaataaataaataagttaattaattaattaattaaattaaaagcatgttattcagaatcacatagacttgggctcagctcttcagccataagcatgtttcttttctctttttctttttttttttttttgttgagacagagccttgctctgtcacccaggttggagtgcagtggcacaatcttggctgactgcaacctccacctcgtgaggtcaagcgattctcctacctcagcttcctgagtagctgggattacaggcacgtgccacgatgctcggctaatatttgttttccttttttttttttttttttgagacggagtttcgctctttttgcccaggctggagtgcaatggtgcaatctcagctcactgcaacctcctgccttccgggttcattcgattctcctgtctcagcttcccgagtaactgggattacaggtgcatgccaccacacctggcctaatgtttgtatttttagtagagacagggtttcaccatgttggccaggctgatctcgaatgctgaacctcatgatctgcccacctcagcctcccaaagtgctgggattacaagcgtgagccaccgcgcccggcccatgagcatgtttcttgacctcagtttccccttctgtaaagcatggtgtggattgttcacctcgcatgggcatgtgaatatcaaatgagacatcctgtgcaatgtgcctcagacaaagaaaggagatcagcaaataatatttcctttctagttcatcctctcttcccatgtatgccaagaaagcaggcgagattgagtgagggaggtcatatcctctttgtctaaatgttttcttgttagagaacatctttcttcttaacatcccttcctacataaagaatctctgtcagaggaatattaaaaggccctaacctacagttagatggaaggcgagactccgatctcacagctgaatcactttagtctacctctctacccatctaatgctacccccttcaaaaataataataataatatgaaagttgggaagtggaaaaccatcctctggagttttcaaaaactaattccattgtaatcatagaagactgaaggcaggattcatgacacatttctcttcctcctgggcagatgaatctacaatttgtatttgattttaaatgtgattctcctgcatcttcagtgggtttgattgatagagcacatggggccactcagtaaaatgatacagtggagatcaaagccggaaagataatttttgccaaaatgtctgcagccgacagtgagttataagcctttgtctcccactttacggaacacaattttatttaaagccgaaatctgtcactttggtattgtttattgaaatgcatcccataccacggtcccgtgaagaacaacgtcaagtcaaaaggtaaaaaaatccaatggttacaaacagcccaggaccaaataaaggagggagaatgcttccaatctgcgtaaatattacccaccagtgatgcatttggggcaagcaatgaagtcattcatctgcaaagtaaatatctggcattgtcagaggtgcctgacacagccccataaacccagtgagttctgttccattcagcagctcacacatctctatttgataactttgctttatttatgggtccacaatgggagtcataactgggtttttatctttgcacaacttttttactttattttttgagacagggtctcactctgtcacccaggctggaagtgcagtggtgtgatcacagctcactgcagcctcgacctcctgtgcccaagcaatcctcccacctcagcctcccaagtagatgggattacagaaatgcacttccacaccttgctaatttatattagtttttgtagagacgggctctccctaggttgctcaggctggtcttgaactcctgggctcaagtgatcctcccacctaggccttccaagtagctgggactacagatgcacaccaccatacccagctaatttttaaattttttatagaaaaggagtctcactatgttgcccaggctagtctcaaactcctggcctcaagacattctcccaccctggcctcccaaattgctgagattacaggtgtgagccactgtgcccagcttgcacagcttttttaaaccttttttttttttttgcattcattcacgcttttcatacatcatgattgaggatctaccctgcagactgtatggagttatctagaaggcaggaaggcagagaactaaaacctttggttaaaatatctggggttgagctcagtgtttcctgctctccagctatgtgaccttgatcgggtctcttcacctgtctgaacctcagtttccccactgcaaagtggagagcaaatgagaccatggacttggaaatgcttcatacatttctgagtgcctcacagatatgaagcccaaagatagcaccattctaggctctgtcaggacaatgaggccaaagttgtcactgatgccataaagttgtctctacagcgaaaggtccctggaattagcaggaggcttttgtggagcaaatgcctccttttctgcgtagaaagtgagatgcctcaatcactctgcctagatgcctctagatgcctcaattcctctgccaccaacagactctgtgacattgggtcacttttgagattcctgggtcctgcctacttcaccagaatgtcatgttctggaaccttctcagtctccaacctcatcactcacaagcttttcttatgctttgatagatgctacaattgcttgtcaaaaaaagagcctcatcttctccgttgctaagagaaccccaatttttaaagtattgaacagtcacatgctttaggagaagttgcccttctgagcctcaaggagtgaatcttgactgacctaaactaatcatagtaatactgaccccctgtctagtgattgctttcgaataggcacgtgacccattgtgaccaatgagagttgatggaaatttcctccttgctgtcaacaatggacacaaggaagacacattttctcctctgacctttggacattgaacgttattgtgttaggatgtgatgtaaggcactgtggcacccattttgtgctcattagaggaaaagactggaattaagcccttgctctgtaagtcagagcacaaagatggcaagagcccaggtctttgatgatacaactgaactactgaataaaccaaccctagactcacctacccccaaattccttttaatgtgagagaataatgtcccatcttgtttaagcaatttcaggtttccattacttactaatgaatatatttggattccaagttgttatttccttgcatggaatgcttctgacacaactcacccttgctagcctcaagggtggtggccgaactggggagggtccaagaggaattgcaaaaaacagagctgcaaggagcagccttatctctgaccgctgtggtgagccctccactttgtataccctcccccaaccgtgtgactctggatcagccaatcaggtgatctctcttggcaccttgactcatgatgcaagaacacaggccctattgggtttccatgaattctctgcagggagagcaggggtccccagatcagcctatccctaacgcatgcccttggaggagttgccactataaagctatctggagtcaccttgtatggggtgttttccaaggctgggccttcagcagtgccttcggcatgttctctttctttggtaagagtcagtttctggggtgaacaactgagaactcagggacatagacaagaaatcatgtctcattcttaaaagcctcagcacaagtcctggcatagagtaagtgttgatgggaggttggatgaatgaataaaggagtgagaaagttaattgcttcccttctctgggctgctgtatcaatcaaggttgtggcaggaaatacatagtaaactgaaatggggtaactaaaaagagtttagcaaagggctatatatagctgtataagtgggattaaaaaaaacaaaaacaaaaagggaggttgcagtagccctaactagcagcagtgaggagccatttctacccctagacctggaggggaaatagttatggaacccaaggagagtagccacagtcttcagggaaagacagctgcctggcaggagcttccaacctatggcaacccaacaggaaggagccacagaaataaatatccgaatccctctctcctcccaccttctagtattctatgatccccaccccattggccaaacccaagcagccacaagaggatgggagaccacatgtgatgtagtccatagaagtcagcctcctggggtacaaagcaggaaatgggggtggacagtggatgtaaaggagcaaatacaaaatatccggcacagatattgctatggtttgcatgtgttccccaaagttcgagtgctggaaacttaatccctgatgcaaccgtgttgagaggtgaggccttcaagaggtgtttggatcatggggacatcatctttctgaatggattaatgcctttatcatgggagcgggctggttttcacaggagtaggtgctctctctcaccctctctctcacccatgtgatgccttgggtcacaccatgatgcagcaagaaggccttcaccagatgtaagctctcaacctcggacttcccagcctccagaactgtgagccaagtaaatttctattcattgtaaattacctggtctgtggtattctgttatagcagcacaaaatggactaagacagatagtatctagtgataggatagactacaagaatctctttcacccagatcctgcagccacaaaagggccaacgctctttggagagtttatctctcacccaagcagccaccagcatcatcagcaaacagcaatgttcctctacacgcttgtgtgtttccttcattggtacaagtttccaccattgttttgctcataagagaaaccattctccaaagcccagagtaattatagagcccataagtcttggggctttctgaatttgaagcagattcagggctcaagagagccaagaagtcatatcaatgccaggaatctggaccccaggcagacagcgtggataacctaccccaacagaggtgcaggctctcttcctttcacccaaaaaatagcaaacacatttattgatcaccgtgggccttttccttccacctggaggttagcaggaactttcaaaggtttagtgtcatccatatcccattgtcttcttcatgcacagaaaagacaaacttcttcatctctggaaaggagacatggactcacactccccttattctgaatttttgcccactaagccatttcacaggaagttagccatggtttgtggatttttaaatgcttctgggaggagaaggatttactagtgataagaaataaaaatgcaaatgttttactgatgagatatgcatgtaaagtgcttgatataatgcctgacatggaaaaaacactcaataaacgttagtcatcagtatttatatcatcattccttttaatacacgccatcgactgggtgcagtggctcacgcctgttatcccagcactttgggaagcagaggcgggaggatcacttgagcccaggagtttgagacgagcctgggcaacataagaagaccccatctctataaaagaatctttaaaaattacctaggtatggtggcatgtgcatacagtcccagctactcaggaggctggggtgggaggatcaattgagcccaggaggtcaaaatgaggctgcagtgaaccatgatagtacaaaaaaatagttagaaagaatgaataaggccgggcgcggtggcttactcctgtaatcccaacactttgggaggccaaggtgggtggatcatgaggtcaggacttcgagaccagcccggtcaatatggtgaaaccccatctctactaaaaaatacaaaagttagccgggcgtggtgacaggcgcctgtagtcccagctacccaggaggctgaggcaggagaattcctggaacctgggaggcagaggttgcagtgagccaagatcgcaccactgcactccagcctgggcgacagagcaagactccatctcaaaaaaaaaaaaaaaaaaagaatgaataagacctactatttgctagcacaatggggtgactataatcaaaaacaatttaatcgtacattttagaataactaaaagagaataattagattgtaacacaaaggaaaacgcttgagatgatggataccccatttagcctgatgtgataattacacattgcatgcctataatatctcacgtaacccataaatatatacacctacgatgtagtcacaaaaactaaaactaaatataaaacaacaagcatttatcatctaattgtctggatttggaacccacaagccaactcagctaagtgctctggcttagggtctccaatgaggctgcaggtaagatgtcagccaggactgcagtcatctgagcgtttctggggctgaagactaggcttccaggctcactgtgtggttgtctctattccttactggctcttagacagaaacctcaattcctcaccacgtgggcctctccataaagtgccttagtgtcctcaaaacatggcagctggcttcctccaaagcgactgatccaagaaagagaaagaaagagccaacaatggaagctgcagtctttcatgacgtaatcgcggaagtgacataacatcacttctgcggcattggtcacacacgagccccaacatggatctttccagcgtgggaggggactaaacaaggtgtgaatggcagcaggcagggattgttgcgggccatcttgaaaactggttccctcagaggagagctggaaggctggggacaaggacacaagagaggcttttttatttttttatttttttgagaccgaatctcgctctcgctgcccaggctgaagtgcaatggcgcgatctcagctcactgcaacctccgcctcccgggttccgggaattctcctgcctcagcctcagcagagttccccaagggtacctgttggcctagtttgagactcttggctctgttagtgggagtctcaaactatgctccaggctgctgattgttctgagggatttctctctctttctttctaacactaagaaataggaacttggcctcccagagtgctgggattacaggcgtgagccaccacgcctggcctgtctgtaatctttaaaagtaatagcatattagctctgagggtcggttggattttcttttttaaacagttggcagtcatttgtagccaagtcaggtgaaaagggtaggtgatcaagctcattacaatttttattgaaataaaatttatctttagtaacgagattgattttttgtgtgtgactccggagggcagtttgcccagagcagtggttttcaaactcttaacaaactatccctgagaggaaaagagaatgaattcatactctgtggagtgtagcccaaaataacctctgcaaaggtgaaattttctttgaagtcttattttaccttaggtatttgtgaactctgcgttctattttgtgccacatgtgttttaagttactattactctactaaagtttattcatcctccaggaagatgatgatgtttgtactgtagttttttatgtcccagggatacagcagggttccccaagggtatctgttggcctagtttgagactcttggctctgttagtgggagtctcaaactatgctccaggctgctgattgttctgagggatttctctttctttctaacactaagaaataggaaacacagttttcagtttaaaaataacataattacaaagtgtagaaaagtctctcttggccgggcacggtggctcatgcctgtaataccagcactttggaaggccgaggcgggtggatcacgaggttaggagtttgagaccagcctcgccaacatggcaaaatcccatctctactaaaaatacaaaaattagctgggtgtggaggcaggcagctgtaatcccagctactcgggaggctgaggcaggagaatcccttgaacccaggaggtggaggttgcagtgagctgagaatgcactactgcactccagcctgggcgacagagcgagactgtctcaaaaaaaaaaaaaaaaattacaggcaaaagaggttgcccatgttctcatcattggcagcagcagcatcaaaatatggcacccactccagtgatgcctttccagaaggagcaacactcatgtgaaaccaccagctttgctttgtttttgtttttgttgttgttgttttttcagagagagtctcactctgttgctcaggctggagtgcagtggtgggatcatagctcactgcagccttgaactcctgggctcaagcgatcctcctacttcagcctccccagtagctgtggctacaggtgcacaccagcacgccttgctaattcaaaaaaagaaaaaaaagaaaagaattgtagagatggggtctcgctatattgcccaggctggtctcaaacttctgacctcaattgatcctcctgccttggcctcccaaagtggcaggattacaggcataatccagccattgtccctggcctggctttttttttttttttttttttaatgtagctcatgaccacaaacggagtttggtttccttgctctctctttttcccatttggtacttttctttctctcccatgcactcctcttcaaaccaaaagtgaatcttgttatttcttgaaaaatgtgtagatgttgaagggatgaaaaacctgaactctaacgtctgactatctgaacccaaattctagccgccccactcagttgctgtgtgaccgtgagtaagttcttaccctctctgagcctgtttcttcacttggaaaataaaagtatacacatatacagctgttagccagaactcagcctagggtaacctttcaataaatattagcatcatcaaggaaatcgcttgacaaattaattttcattaagcaatgagggtctataacagtgatgacttctgaccaaccaaccagcccaatggctgacaaaggactgataacactttacatttttataatttccctagatttcaaattctccataaggagcaagtacagtttttataatcagacatagaactcgcgttcactctgctcatcctgaccctagccactggccaccaatttctgggttggctgctccaacctgagaacacagctactggaatcagaggcagaggagctcctcttgcgttcgttgttggtttcccttggttttgtaaaaataaataaataataaaatagggatacacccttcagacagcaggtaacttcctaagctaagatgaacaggaggaaatttaaatgtctttccccggttcaaatcccctaccctctcccatctgcctaccctgggctccaacactcgggagaaagaccataagtcgttcagatgatgctttggagctggacaatcaatcgtgatcaaaaacaggggcatgggagcctggctaacgtggagggatgggagaaaatcaggctgaattagagaagggtacattgtggagtgtgttttacaacgccattagttctaagcacataaggatttcaaatcaaggagcatccacacacacacaaactcttggattccttaagagataaggcggatccaaaattagcatatagatcagaggcatgcagttgagtgctgctaaagtgggctataaatgcttgggggaaaatagttgtttttctgaagaaactttacaacattccaaaatcttgtccaggaagtgtgaactctaagtccaatggactgaactgtgtcccctcaaaattgatatgttgaagccttaacttccattatgatggtattaggaggtgggcttttttggaagactattagtttagatgagatcatgaggatgaggtcttcgtgatggaattagcatccttacaagaaaagacaccagacggcttgctctcttgctctgtctctcctcttccctccctccctctctacctccgctccccccaccccccacttcctccgtcatgtgagaatgcagagagaaagcagctttctgcaagccaggaggagggtccgctgggagctacatcagccagattgtggcacttctcagcctccaaaactgtgagaaatagatttctgttgcttaagccatccagtttatactattttgttatttgcagcctgatatggttcggatttgtgtccccacccaaatctcgtgtcgaatcgtaatccccagtgttggaggaggggcctgggggaaggggattggatcacggggacagacttgccccttgctgttctcatgacagtgagtgagttctcacaagatctggttgtttaaaagtgtgtagcactttcccctttgctctcttcctcctactccagccatgtaggacatgccagcttccctttcaccttctgccatgattgtaagtttcctgaggcttcctcagctatgcttcctgtacagcctgcaaaactgtgagccaattaaacctcttttctttataaattacccagtctcaggtatttctttataacaatgcaagaagagactaatacacagcccaaactaactaagacaaacccactctgacccattctgacacccaaactaactaagtcctggtttgaacccttcactattgtgtcaccttggggcaagtcacccaacttctccaaatgtttgtttcccaccaggaagatggaaatgacagtacctctccttcctaccccgcaaacctatcaggaggatcgaaagggacatggcaagcaaatactttctaaactgtaaagtgctgtgcaaatgcaagacagcattactctctttttatggagttatttatactctacctggttacagcagaggatttatggtagatgtcagtaagactctttattttgaattttaagagagaaataagaatctttgttatctgtagagaaacaaatataatttccatggggcactaatataatataatataatataatataatataatataatataatataatataatataaatataccttaccgaataaaccctttgctcagacgtagtgaaaaggtaaattccccttcaacctaatgaagtttcagtcgctcacattttctgaatttgccgaacagaaatgcgatcaggtgcctactaagtgcagtacccagcacgatgtctaacattgaaacatacagtgtatacaccagcacctccaccaaacccatatccagcatgcaaaacatacccttttcaagtcggaagcacatagatagattttttggagttcaaaaggtcttaatgcaaactggctccaattccttttttttttttttttttaaatctttgaaacattggttaagtcttctcagagctatcattttgcacacatggaaactttagaccatccatccttcaagtgtcttggggtaattagagatactgaaggttaaggacctagcatactactaatagattttcaacaaatggtagctactgttatttctcatcattgcagatttaagagtgccaattctcagagcacttcagataaaaaccctacctttcttaaggcaaaaaacaacggcattaacttttttttttaattaacctaagttcccattatgtttagagaagagatcacaatgataaatgcttgccctgtctctcttttttaaaaatttactgttcttacatgtgacatatactgtggtacttagtgtcaccctacaaagaataaatttaaattgaagaaacagaaacacgggagagtccttgtttgggtttaatttgtatctgactacaataaaattctatcctggaagctagagtcataaaactaaaagtcaggaaggaaaagaatggctaattaagctccaaaactaaaagctctttctttattgctatttctttaagtcctaacaattggtcaggcacagggtcttagctgtgccattctagttaatggtcggttacaaatttccaccataaactcatcttccttctagcaacttaaatctcaggcactgggatgtaataaggagagaaagctcttaggcccagggcaatctctctctcaatcccaatctcccttccccccatccctatcccaccacagtaactgttagtaagagcttttggttgcatgcccagaaatctaactctggctaaattaatcaagaaacgaatatactggtttacccagctgaggtcatttacggaaagggaatgctaaggtttgaatgtgtctcctccaaaattcatgttgaaacttaatccttattgcagtggtattaagaggtggggccttttaggaagtgattcagtcaggagggcttggcccttaaggaatgaattcatgccttataaaggggtagagggaactaacttaggcccttttgcccttccaccttccacatatgaggatacagcattcatgccctccagaggacacaaggcaccaccttagaagtaaggaacagagccccttaccagacacaaaatgtgcctgtgccttgatcctggactcctcagcctccagaacggtgagaaataagtttctgtcctttataagttatctagtcttgggtattttgttacagcagcaaaaacagactaagacaggaagagaaaagaaccagagccccagggactagaaacaggactcactgcctcaaagtacatgtatactctctctctctctctctctcgctctctctctctctctctctctctctctctgtctccatttctcttcactgtttgtctttgctcagccttattctccatctctctccatgtgggagggcaagtagaggctggcacctccagatatatatcctctctgttcaagaaccacaataagttaatccccagggaagattctgatgcctgtgccactccaaggtccaacactgctgggtggatagagcctgatgtttgaccagatatgtgccacttaccaaccatagcagacactggcaatggccacccatgtcccttggaccctccccatcccatacaagctgaaggcctccctctgcaagcacctgcaactccccacctgaaggccttttctcggcctcggcaagacaggccagaagttcaaggatgtcaaagtccctgagagaatcccttggtcaatgtcagatgagtgatgaaagataaatatctcagttttctcaacactcaggtgggacactttgaggtgtgttccatgccatcaaccaaagcccatcaaaaggaccaagccccggctgcccatagaagtaacttactcattaccttgctctattctggtttagatttccttgtctcattttgccctgtgatggttaattttatgtgtcaacctgactgggacgctgagtgcccagataattggtaaaacattattctgggtgttcccgtgaaggtgttttcagacgagattaacatttaaatcggtagacggaggaaagcaggttgcactccagatgtgcgtggtcctcatccaatcagttgaaggtctaaatagaacaaaaggccaacccttgcctgagtcagagagatctcctcctgcctgagggccttcaaactgaaacgtcaaaattttcctgcctttagactcaaactgaaacacggctctttctggatctcaagcctgctggttttcagactggaactacaccactgggtctcctgggtctccagcttactgactcattctgcagatcttaggacttgtcagcctccataattgcatacacacacacacatacacacacacacacacatatatataaaagtgcatatagatacatatatgtatgtgaatgtatgtatataaaagtgcatatagatacatatatgtatgtgtatatatatatacacacatacacacacatatatgtgtgtgtgtgtgtgtgtgtacatatacatgtgtgtatatacacacacacacacacacacacacacacacatatatatatatatatatatatggaccatagagaagtctctaagccaaagctggggacaggggaatcctgtgtctccttgggagaggtctgctttagtgtccctgccatgctcagtcattagccaggagcacctcatggaaggaagcatatggattccccatatgcttatatatgtgtgtgtgtgtgtgtgtgtgtatatgtatatgcatatgtgtgtgtgtatgtgtgtgtgctattctattggttctacttctctaaagaaccctgactaatacactcccattctcctactggtgcttcccagagtcaccctacaaataaaccattacatggaaatcctcatcacaggatctgcctctgggaaaacccagcctaagacatccatgactttcataggagaagaaagagctctagaattggcagccttactgaaccatgtggaagaggaaaggagagcacctaaacaaaagggtattaaccaattaaaataacctaaacccacacttgtccaaattgctgagcaagtgggatgggatgaaacaactttcaaccagtgtccaaatattgctgtgactcctagactggcttgacacaaaggcagtgtccaccagctctaaacatccatctcaactaagatttctccaggaaggctagaactgacaccctctgcttaggttctcagtgacttcacccagccagcaaaggagctcttaggaaggcagacaagccctgaagtctgtctgctcagactccagctacctgctctattcctgctttatcaacctctagcttagtcgctcaatctccagctttgctccttcccattagattctatggctgaacctgactgccatagtttgtttctcagatgaatttaaggcaagggttgcaaacttaaatgcacacatgggcagacaagtaacacaaatgagtgaagagtacagattagggcaactgggtctggtggagactgtggcaaactagagagcacacaccctatctaaggaggcagcgaggactcaattttgcaagatttgtggaatggactcccaatgttgccaaactgccactattttttaaagagaagcaggaaatccaggggtttttaaagatgtaaaatacacagtttgttgaatgctggcgactgatttttttttttttttttttgagacaagagtctcactctgttgcccaggctggagtgcagtggcatgatctcagctcactgcagcctcctcctcccacattcaagaaattctcctgcctcagcctcctaagtagctgggattacaggggtgcaccaccatacccagctaatttttgtatttttagtagagatgaggtttcccccttgttggccacgctggtctccagctcctaatctcaagtgatctgcctgccttggcctcccagaatgctggggttacaggtgtgagccacagcacccagccctgattttttttaatgtaaatactgtatgaacccagacaaatgttctgccaggccagtgctgcatggctcaccacgtggtggccctgagaatgggcctcatcgacctgcctctactgggagtgtaattaaccagggccccagctgctgcgctggggaatccatatgcttccttccatgaggtgctcctggctaatgactgagcatggcagggacactaaagcagacccctccccgggagacacaggattcccctgtccccggctttggcttagggacttccctatggtgttcgcaccctaacttttttctcctctctcttttactcagagtcagacttgcattactgtctcaggttctcccagctttatgtggcaccttctttgctttctctcaagggcatttcccttaataaaaatcacatatgtgtaatcctgtatgggagtttgtttctcagaactgggctgacacaccatcttgcaaactctgctttcggcattcagctcacacttacttacaccctccaaactccaactatttagggctaattccattccagctcccacccgttgaatcccttccccctccccctgcttcctcctcccattctgctttcctggaaacagcatttccacttacttttgaacaatggtccttccttcactgttcattcatggagtttggatagcaccatcttctaaagctagggctgagcacatgatcaggactgactaatcaccctcttctacttccttagccacaataattcgttcagagatgggcacctgactcttacaatgcaatgagagtcagcttcttatgccagtgcttttggcaaaggtaagttcattttcccctgggattactaagctggtaggaggtaagtcagcagctgctgatggcataagaaaagggcctgataatgaagccaacatggatgaaaagagagctgagaagtagagatcagacagatttcaaagcatatcatttaagcatctggatccagccatacttgaagtccagtctatctgtgggctttgaagttgcatggaacaatagcaagatgtagctgagagagttttggctaatataccacctcacctctcattcagtttcatggaatataacagacattgccaactaaaatttacaaacagcattgatataaaagctccgccatttaaaaaaggaaactttctattctttcactgtgtggccttgggaaatttctaatccgttctgaacttcagcttttttccctctcaaatgtagcaaatacaacataacttgcttgccatggagggaaatcagatgcccttatctaggaaagtaaagatagaggtataaaacattgttatttcaaaaaaaaaaaaaaaaatccagcacataagtctaggagcattgaacaagggtcagattgcatggattcagattccagctccattactaactggctgtgtgaccttggacaactcaattgacctctctggccctcagtttccttatcagtaagacggaaactccaatcatatctattgcacgggatagttgtagaaattaatagatacataagtgcttagtgcaacatgtggcactcaaaatatgtgtggtatgattgttattgacacaatgtttgacccatgaatgattgtgatgccaaccccctcacagttggaaatccacctataacttttgactcccccaaaacgtagctactaatagcctattgttgaccagaagtcttaccaataacacaaacaatagacacatatgttgtattttagatgattatacactgtattcttacaataaaataagccagagaaaacaatatatgattaagaaaatcataaggaagagaaaatgtatttgttattcattaagtggaagtggatcatcataaacgtcttcatcctcattgtcttcacattgaggagactgaggaagaggaggaagaggaggaattggttttgccgtctcagaggtggcaaaaacagaaaaaaatccatgtataagtggacccatgtggttcaaatccatgttgttcaagggccaactgtatttatattacaataaatgctgttaatgttgtcactgttgacccttctattccattcccaacatcacttcctatgcccagtggaaaattccatcttaaaatcacccagcccaagccctcttcagtagactcagatagatggcttgtcaagggcatgacttaacttctccaaacacaaccagcccagtttcaactgccatttggggaactttcccaattaccacatttccgcacgtcaagtatgaattactttaattgccccagaagaacgcactgttgaaacatttgacttgcccagaactaattgtctgtcaaaaagatattttgcagccaagctgatctcttaattggacatctaatttaactgaaaacctttttccctgcttgttttatgctttcttctcctgtttttgccaaattctggatgctgggcactgctttcagaaataatttatcttgttattttctattataaaagtaatacatgttcattatagaaaaactgaaaaaaaaaattccacatgaagaaaaacagtggatcctagactcattgcccagaggaggactatgaacattccacatgaagaaaaacagtggctcctagactcattgcccagaggaagactatgaacattccaaatgaagaaaaacagtggctcctagactcattgcccagaggaagactatgaacattccaaatgaagaaaaacagtggctcctagactcattgcccagaggaagactattaacattccacatgaagaaaaacagtggctcctagactcattgcccagaggaggactatgaatattccacatgaagaaaaacagtggctcctagactcattgcccagaggaagactatgaacattccaaatgaagaaaaacagtggctcctagactcattgcccagaggaagactatgaacattccaaatgaagaaaaacagtggctcctagactcattgcccagaggaggactatgaacattccaaatgaagaaaaacagtggattctagactcattgcccagagaaagactatgaacattccaaatgaagaaaaacagtggatcctagactcactgcccagaggaggactatgaacattccaaatgaagaaaaacagtggatcctagactcattgcccagagaaagactatgaacattccaaatgaagaaaaacagtggatcctagactcactgcccagaggaggactatgaacatcttagcaagtctcccctcaggttgtcctagaatagatgtctctacgtagttaataaaaacatacattcaagttttgcagctttttgttccactttacattttaagttgaacgtttacacttcccattccaagatcttcagaaacatgtttagaaacagaagaatatcccaacaacagtctgtttaacctcttcccctaatgctgaactattgttgctttaagcatacattttctgtgtgtgtttcagatgtagtttccttaggaaagattctctatgctgtgcaacaattccccatgtgtctcttacatttctgcacatcttgtgtcagcatttgttctagaccgtctttataaggatgtttgtatagctaatagcattggaagatagggctaatatagtagaagacagatttatttgctgattaggattataataataatatctccggaccaggcgcagtggctcatgcctgtaatcccaccaatttgtgaggctgaggcaggcagatgacctgaggttgggagttcgagaccagcctggctaatatggtgaaacccccgtctctactacaaacacttaaaaaattagctgggtgtggtggtgggtgcctgtaatcccagctacttgggagacaggtgggagaattgcttgaacccaagaggcaggggttgcaatgagctaagatcataccactgcactccaacatgggtgtgacagagcaagactctacctcaaaaaaaacaaaaaacaaaaaaagaagaagaaaaagaaaaagaaaggattataatgacaatgtctccctccatccagggtaaaggttgaaaagaccaagattcctaaacttggggttcctcaggtgtgatgcaaatccactgcaggcacagattctacctggatccatccgtgtattactcatttctcacactgctaataaaaacatacccaaggctggatgtggtgtctcacacctgtaatcctaacaccttgggaggccgaggtgggcagattgcctgagctcaggagtttgagaccagcctgggcaacatggtgaaacctcatctctactaaaatacaaaaaattagccaggcattgtggtgcacacctataatcctagctactcaggaggctgaggtgggagaatcgcttgaacccgggaggtggaggttgcagtgagccaagaatgcgccactgcactccagcctgggcgacagagtgagattctgtctcaaaaaaagaaaaaaaaaaggctaggcatggctgtaatctcagcactttgggatgctgaggtgggcagatcacctgaggtcaggagttcaagaccagcctgaccaacatggagaaatcccatctgtactaaatatacaaaattagctgggtgtggtggtacatgcctgtaatcccagctactcaggaggctgaggcaggacaattgcttgaacttgggaggcagaggttggggtgagctgagatcctgccattgcactccagcctgggcgacaagagtgaaactctgtctcaaaaaaaacaaaaaaacaaacaaacaaaaaacataccctagactgagtaatttataaaggaaagagatttaattgactcagggaggcctcgggaaacttacaatcatggcagaagggaaagcaaacatgtccttcttcacatggcggcagaaaggggaagaatgagcaaaagaagaaaaagccccgtataaaaccatcagattttgtgagaactcattcactatcataagaacagcatgaagataactgcccccatgattaaattacctcccactgggtcccttccatgacacatggggattgtgggaactacaattcaagatgagatttgggtggggacacagccaaaccatgtcaacctgtgtcacccttgagggacttgggggtcaaagggaactggtgcagacatgaagctcaagcttcctgttgtgccatgaaaaataaagtcctttatctctcaatccagagtctcatgtcttctgcccacatccataaaactcactagcctccatgtaggataatatcttagaccagcacagttcttgacactctagaagtgaatttgttggatcaaaaagcatgaacaattgctaaaactcttaatatgtcttgtcaattagctctccaaacaaatatgagtcattgcctgaaatctcttttgtcctcaggaagggatagagctgcttgactcagatctctcaggtggccttagactgtaatgtcttcctttcgtgcagagctcttaccatcctaagccactacacctacctaatattctataaaaagctttttctccctacccagtgtctccaatgagctgactttcttttctggattactcttttatgtaataaaaagtagacatgagggtcaaacagaaagggaaaaaggggaatttgtttaatttctaccaagtgccaggcatagtacaaagaacatttagataaggcagaaggcattaattatttttatctacccagaacccactgccccacctaagcaccccagcccctgacctggccacgtgggtggctatgtgacctgagctgaaccaatcagagtccttccctgggatttttttcacatcataaccacatgagaaggtctcccattatgaaacagagaagcttgttggcagccatggttctagccaaggatggaaaaaacaaccaaaaaaagaaaagaaacaaaaaaaacccaccatggtaaaaaaatacatatataaaaataaaaaagatatgaaagacagacagacatggggaatggtctctttccagttgcccctgccactcaactgctctcctaccttcctggatttggttatgagagtcaataaattatccccttttattgcctaaatgacttccatatgagtttctgctccttgcaaccaacataatcttgacaattaatagtagctagcattttgtgagtgtttactgtgccatgcccattaatacacctaatcctctctacaattggacaggtaaggtgcttttagtaacctccaatgtacaaaaaggaaaacaagttgggtgaagtgaaatgacttgctcacagtcgctgggctaacaagggggcagagtcaaagtttaaagccagagcccatactcttccctattgtataacacagacatgctgtctctgttcccagtgctggggaatgcagagaactggggactgaaggaagagcaggcgttcaggtaagcattaatcaggggaccttccacaagggaaaagggagtactggcccagttgaagtccagccagcactcagcatggtcaaggatggggtggtgctctctccagccattcaaggtgctgagaaaagaacagaactttcatctgaggaatacaagccttttaaattattaggcccagagaggcaatagaacgagatagcaatcatgtcctacataccccctttgagctcggtattcatttcttaaaactgcttgccattgccacaagtagctataaattaatctaataatgccccactggatgctataacccacacctcatagcttaacaatgtatagccaatcactcgtcaatgttatttctgaaaaccagtgagaattcctggcaaccaactgtgtaccagcccactccatgtcccccttttttgcctttataaatccacttgtaactgctgctaattggagtgtatattcagggaaacttgaatctacgctccctggctacagtcctcaagcttggcccaaacagagtctttacttatattaattttgcctcagcttcttccttttaggttgacagtgctacaggctgaattatgtccccctaaaattcaaatttgaataaatgttcaaatatgaatttgaggccaggcacagtggctcatgcctgtaatcccagtactctgggaggccgaggtgggcagatcatcttaggtcagcagtttgagaccagcctggccaacatggcgaaaccccatctctactaaaaatacaaaaattagccaggtgtggtgacgcatgcctatcatcccagctacttgggaggccaggataggagaatcacttgaacctgggaggtggaagtggcagtgagccaagatcgcaccactgcactccagcctaggcgacagaacgagactgtctctctctctctctctctctctctctctctctctctctctctctatatatatatatatatatatatatatatatatatatatatatatatatatatgaatttgaagcccttcaaccatatggatcatatcttgaagccctaaccccctagcacctcagactgtcactgtatttggagataggggcttgaaataggtgattaagtttaaacctatttagctcatttagggtgagctctaatccaaccagactcatgttgttataggaagaggagattaggacacacagagagacaccagggatggacaggcacagaggaaagaccatctgaggacacaccagaatcgaccatctgcaagccaagaggaggtctttggaggaaccaaccctgctgacaccctgatctcagacttccagcctccagaattgtgagaaaattaatctctgtcatttaagccacccagtctgtagtactttgttatggcagctccagcaaactatatctacaggaatccatcaccacttatgacaggctctgccacatagtaggtgtgtgtgcacacaccacacacaaacatgtttagaatatgaaatccgtgaaccctactcccacactgataacagttcaggaacagttgattttccctcagggaatctggtttgttttcctagtttccatcccatcaagaccccttcccacctgctgggaaatacttgcctgaacccctcgttcctttcacaacacacacctgatggtaggaagaagcttccaactctgatattgacagggtgcttgtaacctagcaccctttctcctaccttgttatggaaaaataaatcctttatcctatttcaactacagtcttggcaaaggaaaaaacaaaacaaaaaaggaaaccagcctagaaatggaaaccaaagatcatgaacagtgctatgctgagttacagctaagggttggcctttctggagctggctgccttcagatggcagggctctgagtgtgtgtgtgtgtgtgtgtgtgtgtgtgtgtgtgtgtgtgtgccagaagcacaagatgacacaccctgtggtggggtcaggcaagctgattgtgggaaaggtgggaacagaatattttacaacaatgttggaaaaatgggtttacattctctgagaggaagatacccaaagcttcaagctcacctcaagggaaaattgagctaggtttccatgctctccacttggatctcacgcacatgaacacacatacaaccttctcctcaatattcacaagaggcctctgttgtctgcttctccagagagcggaggtgaatttacctgaagctaatgaggcttgggcttcagggtcttttccttgtacctgtctctttaaatgctggacttggggaaggctttaggtgagaagggaaagctgggtttcaataatgaagcacctctatgttcacatttctgattaattgcctacacagatcccagaagaatggaatggaaatagctaaaggctccagaattttctctttttatttttttgagacaacatctcactctgttacccccaggctggaggctggagtgtggtggcaagatcatcgctcactgcagcctctaactccctggctcaagcgatcctcccacctcggcctcctgagtagctgggactacaggcacacaccaccacacctggctaattttttgaattttttttttttgtagagatgggggtcttgccatgttgcttaggctggtcttgaactcctgggctcaagaaatcctcctaccttggcgtctcaaaaagctgggattacaggcatgagctaccatgtccaggcagctacaggaatattatacttaatttctcattccaaaataacattctcttttgtgcctaattttaaattcataattttgtattctttttcttaaacagagatccccatattataaaagcttcagtccccacaaaaactggatctggttctgccaaaatgatatatcctttatgatatttatagagacgttctgattatttctgaacatctcagactttctggaaccaagacaggttcgattatgaacatctgttgtctaattttaaagaccaagggggaagccgggtccttatgagggccataaaggctccaagctagatggatattgggggagtgggttagcagagatgtcctaaaacaatgaattacactaatgggaagaacaaaaggtaagtctaatcacagatgtcttggttttcaagctagtcagacttcagataactgtcaaatcttcagccataaatcgaaagtggaggagaattaaagatccatccttgtttgcttacagaatttacttaatttagccactctatccttaattgatagcaacaggttttttcaaaatagtcaaagtaatctatgctttgctacataatagcaaaagtaatagccaacattcatcaacacctactatgttatacccttgacagggtttcctattttagtagtcaaagcaatttcatggagtagcaattacagttgtaatttcactagtgagaatgcagagtgaggctcagagaggttaaggaacttacccaaggtcacacagctagtgagtggagagttggaatttcatctctctgattttaaagtctgggccctttcctctactgcctctctctgaactcaatgacacatcctaagtaagtaagggcttctacacaggatgtgttagactatgctgcagtaacaaacaacccctggatctcaggaacttaaaacaaaatttcaggctgggtgtggtgtctcacacctgtaatcccagcacattgggaggccaaggccagtggatcacttgaggtcaggagttcgacaccagcctggtcaacatggagaaaccccatctctactaaaaatacaaaaattagccaagcatggtggtgggtacctgtaatcccagctacttgggaggctgaggcatgagaatcacttgaacctgggaggcagaggttgcagtgagccgagatcacaccattgcactccagcctgggcgacagagcgagactctgtctcaaaaaaaaaaaaaaaaaaaaattctagaaataactccaaccttattttcttgaacacgactcatcctgaccctccagcactccattgatctgggctaaatatatggaatcctgcagatgaagacaccagcacccaaagctaatgggacacagaaaacagaggccactcaaataaatgtcagcactcctagttactgaatactctgtgtctggcaagtttcatcattagtcagttattcattcactcaatcaacaactacttactgagttaatatggcagcatggttatgagcacagactctggagcaagaggtcctaggttcaaatcccagttaccctgcttatcagctaaatgacttctcagtgccttggtttctccatccagaaaaatggggattataattaataattgcctacctcattgggttaagtggataaactaagaacagtggcatgcccatatgacatgctctataatttttattatcactgtgtgccaggcattattctatatgatggaggatgcagctatgaatagggcagacaaggtgcctgtctttacagagcttctattctagtgaaggagagaggctttattagcgagtaatccttgatcgagccatacctgaagctaatgccacatccttcaaccttccaatttccccaggcattaagttcttttttcttttctgcctaggctagcttgcactgagtttctctcccttgtgaaccaaagtgtcctgaccagtacagaggtctaaagcctaagctctttccagtctgccccttgcccctttccagctgaagccctattcatttgcacccaacatcatcattgcgtccagtgcctcaccacttggtgagacccttgaatattcaaaccagcgtgtaagcagagagttaggaactataaacagtaaattataacaagcatgaaatggaagcctgctgctgatcattcgcaagagagcaatcaaatctgtcttggtgcctacatgttttatggaaaacatgtctatgttttaaaagtgtttttgaaataaaaaataatttactaactaaattagatttccacatgttttatctagttaacccatcccttatcataagaaacgtaacttctttttttttttttttttttttttttttttgcgatggagtctcactctatcacccaggctggagtacagtggtgtgatcccggctcactgcaacctctgcctcctgaattcaagtgatgctcctgcctcagcctctcaagtagctgtgattacaggtgtgcgtcaccatgcccagctaatttttataattgtagtagagatggggtttcaccatgttgaccaggctggtcttgaactcctgacctcaagtgatcctcctgccctggcctcccaatcatggtgggattataggcttgagcccctgtgcctggcctagaaagctaacttcttaattgcaagctactttcatcaatataatgcatttgtctcactccttaaaggactcctgtcacagtggattggcaaagaacaggtcagacacaagaggcagtggagtattagtaaaatacacgtggatttggagtcagaccttcctaggtttaaatgctggttttatcgcatactagttgtatgccttcattggggtttcccaagaatcagaccctgagacaagactccaagagtaagtcatctatgtgggaggtaaatgaaacatgacacaggaaatgaaataggtcagggaggcagccagtaaagggcatattataaaacaagttactacttgggacaataactggaaaacttgctggaaaacttgctggaaaactctaggatacagtgtagaacatctctagcaatgtgctggtagatgtttaacaaccaacactgcagaaaaatattaaaagcccagatttgtagtgtctgcccatatccatggtgtaaatcctcccaccatggctgatttcacactaccttgtccctgaacaaggacttggggaaagatgcacataccagctcttgcttcatagttatctgacctaaggggtgagggagatggggtacttatccacatacaccaactctcatcagttcctggtggagggatgctcccagggcaggtgttgattcctccaagacttccaagccatcatacgggtgggcaaagacagtacaaccagaaaaagacctcagaaagagggccaggcatggtggctcacgcctgtaatcccagcactttgggaggccgaggtgggcggatcaggaggtcaggagatcgagaccatcctggctaacacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaatagctgggcatggtggtgcatgcctgtaattccagctactcaggaggctgaggcaggagaattgcttgaacctgggaggtgggagctgagatcaagccactgcacttcagcctgggcgacagagtgagactccatctcaaaaaaaaaaaagaaaagaaaaagaaaaagtcctcagaaagagaatgcaactacatttggatgggtcagtggatgcttaagaggtaaagggttagaagatacaagggaagcactgaaagcatctgttactctgtgcaattgtgaaaacgttatttcatttctctaggcttccaatattgcattggtaagatatgattcattgaatcttccaacaaatactcatggagcacttagtatatacccagcaatcttcaggccataggaaacagaatgttgagttaccatgacaaagtcactgtcacagagccagtggggaaagcagcctctaaacatgccacccagtaagtaacaaagatcatttcgggaatggtgaggactatgatgttagagagggtgatgggagggagaataatgtagcggagaggacatgaacgggaaaatctttctgaaagggtaacgtgtaaggtgaggctcaacagatgagaggaaatgtgttgtaaaaagatctgggagcagcattccaggtggaggaaactgcatgtgcaaaggcccagaggtgggaaggagcttggcttgttcatggaaaagaatggaagccagtgtgtctagatcaaaatgaatcaggcagaaggtaagcaggtaaccaggaaacagagtggaggggcaggcaggaatcagtgtctgcagtgcgtgctcagcatcataaagggtttgggtagtaacacaaccctgaagagttgttaaatgagctcccatgcatgtaactggcattactcatgttattaacctgggaaactgtcacgtctcttacttttccatttaatctcatgcccatcctctttgctcacaggagccaagaagtccagtatctcactccacatctgccttctcgtggtccaacactctgccgactcagttaatccaaagatcacttccaaacttcaggctgatggaaacctgaggagtcggatccattcataggcagccccattttcaccttcccttgtccccgaggctgccattaggttgaaaaccagtctggtactgtcagcgtgtctttgtctacagctatgaaaaagtccacatagtccagtctctacatagggcacaatgattctcctctacatctcagctaccaggtaccagcttgtcgaacacacatgcaaacattcaaacccttctcaggttcccctctagggccttcagggacttatccggcatacctgaggttggggccattgcaatctattcttagtctagtgttaagccgggtcaacagcggagatgctccttctccttgaactaattttatttccagagtttcattttccttccctgcaacattaggcatcatttggggatatttttatccatccatatggatttcaaaatctcataaagaaggagctgggagaagaatgaggaatcactgattttaatgactgtatttgttgatctcttactccattcctggacccatgttgaataacataaatatatatgcatgtacacatgctatacatggtatctggatgctatatgtgttatatataacatacatgttataatatatgttagatatgtatgtcatacatatcataatatataattatacattgtatattatatattatactattacatataatatataattatacattgtataattatactattacatagtataatatatacttatgtttatataataaaatataatgtatatgaaatatacataatacatatatgatatattatataattatatcatataatatataattatgtatatttcatataccatatattttatcatacataaatatataagttatatataatatataatgtcatatattatataaattataattattatatattatataaaacatatattatatataatacatagtttatatgttatataacatatataacaaattatatattatataacgtgttatataatataacatattatatattatataacgtgttatataacaagttatgtaatatacaatatgttattaaaaagatattacagaatatattaaataatgtatgttttatatattatattatatatgttttttatatattatataatatatatgttttatatatattatttttgttttttttgttttttgggggttttcttgagacagagtcttgctctattgtccaggctgcagtgcagtggtatgatcttggctcacagcaacctccgtctcccgggttcaagcaattctcctgtctcagcctcccaagtagctgggactacaggtgcccacaaccaggcctggctcatttttgtattttctttagaggcaaggtttcaccatgttggccggactggttctcaactcctgaccccaagtgccccgcccaccccatcctcctaaaatgccggaattacaggcatgagccactgcatccagcctatatatgttctttcatcatcaccacatcatctaattttacagatgagaacactgaggcttggggagatattaaatgtcttatccagattgcatgcatgtaagtgacataagcacgatttgaaactaagcaatccaacacgagagtcctaggtctagagcctctctgacctgctttctacctagaaattatctgagttctttatgcaaattgatgcactttttcatccctttggtctcttgaagtggcagcttttgctgcacccagttctcacaacaacttgcaaagaggatcaacacacacgactgatcacgagataaaggaagtctgaagcagtccccaccaaacatgcaaattcaatgaatgaagatccatttcttgcagctttctgctttgtataataacatttggctgtgatgatctattatgacactaatccttgcacagcccagagaagatgggcaatagttttctggatgtcagtgggactctggcacaagggccagccaattttggtgagcgcaacaggaaattctttgcaatgtccttgtgaatctgaggttacaaagactggctcaatctgtcacaggaagcatgctggaatgcctttgtccttctttctagtttttctttctttctttctaataattctcagtgtgggagaatattattctttctaataattctcggtgtgggcttacatcctttgctttgggaaaggtttctatcattagacctctcttttcccccaaccagccagctgtgaagcggttcactgcggacccaacctctggcatgactgtggatcagcagcaccaatgccatgaagactgcagacacactggagaaccaaggctaattcccttagccattgagcctccgctttccatccatgaaatgactctcaaaatgccagcttgggctattgcttgcttcagagcacctaagagcatctgaacaaaaggaatatctttttcacagatgtaaatgaggaaagcgaggattatacagtagaagaagtgctctataaggctgctgaagatcacaattttttttttttttgagacagtcttgctctgtgtcccaggctggagtgcagtggcgcgatctcggcttactgcaacctccgcctcccaggttcaaacgattctcctacctcagcctcccaagaagctgggataacaggtgtgtgccaccacacctggctaatttttgtattttttagtagaaacagaatttcatcatgttggccagacttgaggtcaggtcttgaactcctgacatcaagtgatccacccgccttggcctcccaaagtgctgggattataggtgtgagccaccgtgcccggcccgaagatcacaattcttatctaactctgctattcattggctgggccaccttgggcatgtccattagctttctggttcttaggaccctcatgtctaataacaaggtctttcctacctgccccacagggctgttgtgaggaccaaatgagatcaagaatgcaaaagctctctgtcaactgtgaaacactaccaggagtaaagattcacaaggcatgagttgccacaaggcagtatagcatggtggttaggaggttaagctcttaaaccagattacttggattccagtataaccccaggatacttaactttgttttgtggtgttgttgttttgttggtgttgttgcttggtattttgtctaattttcagaaacagggtcttgctctgttgcccaggctggagtgcagtgggcatgatcatagttcactgcagccttgaactcctgggcttaagctatcctcctgcctcagcctgtggagtagctgggactagaggtgtgcaccaccgcacctggctaatttatttaatttttgtggagacagggtcttgctttcttgcctcagcttgtctcgaactcctgacctcaagcaatcctcccatcttggcctccaaaagagctgggattataggtgtgagtcactgcgcccagccaatttaaattctttaagtctcagtttttccatttgtaaaatgggcatagtaatagtacatttgtcacagagttggtttgtgataggataaggtgatgcatgttcactagaaatgaagagagaagggttatgattcattgaaaagaaagaaaaacctaggctgggtgtattggctcacacctgtaatcccagcactttgggaggctgaggcaggaggatgaattgaggacagaagttctagaccagactaggcaacatagtgagaccctgtttctactaaataaataaataaataagccaggcatggtggcatgaaccctgcagtccaagctactcagaaggctaaggcaggaggatcacctgagctcaggaacttgaggctgcagtgagttataattgtgccactacactccagtatgggtgacagactgagatcttgtctctataaagaaaaaaagaagaagaggaggtagaagaagaaagtctgaactactccctgcaggaagagtagacaaggtaaagagccctagaaaagattcgtccccgtgctttcctctagaatgaggactccagtaatttataccagtgctggagcacaggcttgacaatggctggagctcagcctccacagtatctgctgtgattagtgctcaaaagcataaagcataactggaactaagaagaaacaagatgctcaaggtctccccttcagccttccttccaagtaacagaatcatgatttgatgatttgaccccttcttctaccacctcaatattgaaatctgtttccaattcccgttaccttagagaacaccatcagatgtccattgtatatctcagattcatttctgtccaaaaacgaatttaacttgccttccaaataattttactcctaatttttagctcactttctccatgaatatcatcgccattcacccagttacccaaaccaagagcctgaacaacatctttgagtccttctccatcacagcctacattcaaccaattgccaccttctcttttatatacctccttaagtcacggccttaatttgggaatgatcgtttctcatttggacttgacttcatggtcaaatatggcatccagagatctagccattgcatcctaattcaagaccaacaacaggaaaaatgggcaaagaaatatatggtcctcattctgagaaaatgtccatattactcttctctttgcattccttggccaaagctaattcacatggcttgggtagcttcatgagagactgggaaattagagggttttggttttgttgttgttgtttaaagcagagtctatgtcaccctaattaaaatcagtgtttcatcttttattcttcctcaaatattctgtgttaaagtcactaaagggcaccaaccaaagtaagcatcaatgagaggggataggacagagatctggcatggggtgttgaagcctagaattggtgcacgacctagttctagtcacgaaaaagcatcagacaatccccaattgagagctcttatacaacataaatggcctgtatcttcaaaagtatcaaggtcgagaaagtaacaaagagactgatgaatctgccggaataagacgtgacaattaaatgctatgataatcttgccctgcaagattataaaggacattattgggatggtcagtgaaacctgaatggggcctttggattagatggtggtaatgtatcaatgttataataatttcctgactttaatggtcgtattatgggcatataggagaaggtccttattgcaagaaacacacagtaaagtattgggaaatgattcgaggagagggaaaacttaattgtactgttcttccaactattgtctcagtttgaaatttttcccccgaaaataaggtgttatttcagagaagaaaagggaatgtagatgtttcaatatgtaaatagtaggctccaccacagatggtatttaaataatgtatcagaagaggtcatcccaagggagtaatatttaaatccagagccaaagagagaaagccatccacgtgaagagcaaggagacaaagttttcaggcagaaggaacatgtgagaagtagctgaacttgttttcagagttataaccctagcaatatggtggaaaataacaaataactagcaatgtggttgaaataaacaaactgctattccttcagaaacatgagtaagcaccactgtgtgcaggaacttgcagcagtcagctagatgctgtaagacaaacaaccccaaatcccagaaagagcttatttctctgccatgcccatatagcttggctggagcagctctgctggaggttgcaggtctgaagacatgctggggcggctctgctctagatgcatctcatttttctaggaccagtgaccaactaagtcatgtttttctcatagagaaggcaaaagcacaagaaggcaaactcatcacacgagagcatttcaagcctttcataagggttatgtcctctcacatcccattagccaaagaaagttaagctcaactcaacagttgaagggtagggaagtacactatgccatctctcagggaaaaggaagtcacatagcctagctgaacatcaatgatgtaataggagagggaacaaatatttactaaacaatagtctcatctaccgtaaagctcaaatacttcacaaaagagccacccttagaaatagcttttatctcatctattttatgggtgagtggggaagaaggatgacaaagcccctttaagaattttatataccctagacacattcacttttggaggtctcaccagaaagcatttgaaacatgctacaaatttgcctgtatcctacattaaatggatttttggctctaaacattttttgagaaaattttaaaattctgctcctgaaattatctggcaataggtgatttatttaaatttagattggatgtgatttcttggtaattgtgcatattcaggaggtctagaaagtgggaaattctaactatccacatttttcagatgtaatgaaatccctaggaatgttaaatttaacaattagtgatattgacaaagcagcacaatttgtaggtaattttttttttttttttttttagaaggagtttcactcttgttgcccaggctggagtgcaatggcatgatctcggctcactgccacctccacctcccaggttcaagcaattctcctgtctcagcctcctgagtagctgggattacaggtttacaggcatgcaccaccataccaagctcattttcatatttttagtagagacagggtttcaccatgttggtcagcctggtctcgaactcctgacctcaggtgatctgcctgcctcagcctcccaaagtgctgggattacagtcgtgagccaccatgcccagcgtaggtaatttttaagatattcattaatttcaattttgtcattttctcttttgcatttttaagccaatgtgtgtgtgtgtatgtgtgtttgtgtggtgttttttgtttgtttgtttgtttgtttgtttgtttttggtctcaaacatttctgtagatcttgaaaaacgtataggtcccgggaagaccctatgcctaacggattaaaaatgcacatgttgcctggaatcaaagctaattattattggttgggaaatggataccctcccactccagactcctcagcacaggaaaataagagcagctaactccaacagaacccaattcatttaggaggctctctgcctctgcataagggtgaatggtttgggattgctgctcagcagagcccttcatctcattcacgaagccattcacactgtatccagtccatttgtaaggcaaataaaaatgtcgtcttccaatcttggctcatttcatcttataagaaaagtctcccgtccgatgcctagccaacatttccctgttgtgattaaagaaacagcaggtaataaaagctggactaacggttggtcctctaaggaccaaaatatggttgaagaagcaataacttaccccagtgcccccaaggcaagttgtctcaataatgtaacaaagctatacttaatggcaacagagcacgtttcactgatactacaccgtaaactgcccgctttcaattagttgcatatgtattaaagggagtcaacacatatttacagcaatcatttctatgtatacaagatgccacaaaaatgtagctttctgctccttctggtcatttggccacataggaataatcaccaaccatagatgcaattctggaaaagtcattaatgctcatctctatggttgcaagagattattgggcttctatttcatgccaaggcactttacatatgtaaataatggtgcatgctttgaatgaagtcatgtttttgtgacctacaatccccactggctgctgcagcacctggcacatattagccactcaagaaattctcgttgagtgaataaatgaaacattcaatggctctgagaccctacctttcagattatcagcaccgtgaccctgcttttgagacccctactctctctcccttccctattatctcttggtgaatattggggaatggctcacctgaactgccccacgatttcatgcctctgttttcgccattacctgtcaccttacctggccacagtcattccttccaaagccactattcacatctctatcagatgctctgcagttctggggctcctgcctcttgggacaaggctagtactgtcataccaggtgtgatggttaatattgagtgtcaacttgattggatcgaagggggcaaagtattgatcctgggtgcgtctgtgaggatgttgctaaaggagatttacacttgagtcagtggactgggagaggcagacccaccctcaatctgggtgggtaccatctaatcagctgccagcatggctagaataaagcaggcagaagttggaaagaacagacttactgagtcttctggccttcatctttctcctgtgctgtatgcttcctgccctggaacattggactccaagttcttcagcttttggactcttggacttacaccagtggtttgccaggggctctcaagcctttggccacagaatgaacgctgcactgctggcttccctacttttgaggttttgggactcagactggtttccttgctcctcagcttgcagatggcctattgtgggacttcaccttgtgaccgtgtgagtcagtacccctgaataaactccccttcgtatatacatttatcctattagttctgtccctccacagaaccctgtgtaatacaccaggccagcagaagggagacatttgctttcctggacattttctgttcattttacatttgctcaatgaaaaaaatcaggttgcaatacatatataaatagaaaacacagaaagacataaatattttttaaaaagaatcagaaacgtatgccccaaaatgctaatatgattacatccgggtggttaatatttattttctgtttctattctctttgtgtttccccaaatttgcttgttgacagaacatgtgcattgcttttggccaataaatgtttggcttatttaaagagttatcttgatgatagccaggtgtggtggctcacacttgtaatcccagaactttgggatgccaaggtgagcagatcacctgaggtcaggagttcgagaccagcctggccaacatggtgaaaccccatctctattaaaaatacaaaaatcagtctatcttaaaaaaaaaattagctaggtgtggtggcacgtgcctgtaatcccagctactcaggaggctgagagatgagaattgcttgaacctgagtggcggaggttgcagtgagccaagatcatgccactgcactccagcctgagcaacagagcgagactctgtctcgattaaacacacaaacacacacacacacacacagttatcttgatggcagttcaggaacttgggagatgagggctgttctcctaaaaccctataagaaccctcaggtgggttatgccacccattcactaatatcccatttacgggtgaagggaaaggtggaggagaccaaccaacccaccagcagtggcctcagtctcaaataaaacttagtccctgagttagaagccaacttaaccatggagaggaaagagttcatcagatgggactaaacctgctcacttccttccaagaaccaccccaagggttcatttcccaggcaccaggagccacccagctccaacatgctgttttctgtcttctggtgacttatcacttgttgtttcttcaagaataagccttcgttgttccaagtaaacatctcaaatgcacacattcttaaagtagtaagtcatgtatccacctgtgcatccaacaaattattatgtagtgaacacccatgagggacgtgctgctgtgttcaatgctggggacaccacagggggccacccacggacttggttcctgccatcatggagctctcggtccagtggaggaattagacatgaaccaaataaaacacagtcatgaatgtaaaaccagaaactagagtaagtgctcttgaaactgccttagcaaaattatgactgagacagtgaaagagatttaacttgatcaattccatcttgcttctaacctccaagctgtccttattcattcttgggtgtaggctgacctaactttgggagaaactgagttcatggttcatagtttgtagtttaaagcaaagatgataacagccctttcccaaagcagacctccttcttgcctggggactagattgcctttgttaggactaaaatgagccacaagattagaaactatggtttaggagtcaggcggctggaggttacaagattctgaccctccctaaactgttcctaagatcagtgcttgagataatttgcagaccctgcacgtgacgggtcaggtggcaccacccagatcgatcaactggctcatctgatcttgtggccccaacccaggaactgactcagcgcaagaggacagcttcgactccctatgatttcttccctgaccaatctgcactcctggctcactggcttcaactaaccacccctaccaagctgttcttaaaaactctgctccccaaatgcttgtggagactgatttgagtgataatcaaactccagtctcccacaatgcccctctgcatgaattactctctctgtattccaatccccctgtcttgataaatcagctctgtctaggcagcgggcaaggtggacccaatgggcggtcacactctgtcgagaaggaacacagggagttgcggaaggcttccagaggaagtgcctgggctttgaagaatgagcaggcattaagtgggcaaaagagcatgtgcaagggtactgtgcaatgtgtcaccacccagggagagaggagaagtggactatgaggctggggacataaacacggtcctggccatggagggccttgtaaaccccatgaaggatgtttgctctttatcctaatatcaacatgaagtgattagaaggtagcaagcccttgattaaccaacaattctagatccttctccaaacttctcttttagggaaaggaaacctagaagtcaaaacataaggtggtgggatttcagttgaaaaggtgtccagggtcggcctcgggtcagtctatctttgggtctatcacaaacactatattaattgcccctattaatctttcattatgtgccaggcattgtgatgatgtatactttatatccattggcacatgtaagcctcaccacaagatttagggcctatcattatgcccatttcacagatgaggaaactgaggttcaggggggcttgtaacatgtcccaaatggtgtagctagtaagtggcaatgccgaggctcaaatccctccaaagattctctctccaaaggtcattttcctttccctaagccatgctggtgcatctggggtcctggaaactaggagatgattttcagaattataagacttaggtcgtgcaagcttcttaatcatcaaagaaagtctggaaagagaagaagatgtttgcaggaagctgccacagaagagaacattttagacagaggaacagcatgaagaaccgaacacacgtggcatcccctaggggccatgaatatagcagggaggcaaccacagagttgggaagatccagagagaggcgggacagatacagtgggtcctgaaagtatgttaaataaagtcacagtgacacggcaatcaggagtggcaagggagccacagacacacatgattagacacaaaaatcatgttttcaaggcacagcccacttagagatcacagcaagatgctttatccaacctccgccggcaatcagagcttgaaaaaggagcattgtcgtcaatcaacttccctttgggcaaaagacacaggcaaaggagaagatacttcacccaccttttaataaatgtgtcttgaggagagagttggcccacatagtacagtctccaagatctaagactccacatgggtagtggcaggggagacaatgggaaccaacaggacattggctggaatcacaagtcacaccttcagtaaaccagaggagtcatttctctctcccttattgactctgggccctggagaaatgccacagaaattcatgggaagaggagttgaaggtagacggcacctggacattatttctgccagcccatttgagttcatctggtaaacattttgcatttggaagttgacatcgtttaataataactgtcaatgtcaatgatcaatgccatcataatggcacaaatacccttgtgggcttggggttgggaggggtacggtggggactgacttctttgtctcctgtcctttcaatggttataaataatgatgataataatttctatttgtgtagctttgtgattgcagagagctttaggcttcctgagagctttcacctatattacctcagctgatccctctacaatgtgcagtatctattttggtcccctctgggaacctgaggcttgacaaggtcaggaaaggccacaccatggcctgttcctgaaacaggaaccacaaatgaaaatccttgcagagagtccaggcagataacataagtgaagaaagggaggaatgagaagcagtagggaatggtggggtctgtggtgaattggagtgcatgcctcattgaaagacgggggtagctgcctatcttgtatccaccaactgtctccacgtgggaacatgggcccaatgctgtcagagcttctaataaattaagagaagctaaaagccagatgctatgtcagtctcccagtttttaaatgatcgcaactgggagtcttgcaactctgtctcccaggctgtaaggcagtggcacaatcctagctcactgcagcctcgaaaccctaggctccaaagatcctcctgcctcagactaccgattagctcgaactacaggcatgtgtcaccatgcgtggctagttttcacaatgtttgtagaaatggggccatctcactatgttgcccaggctggtctcaaactcctgggctcaagcaatcctccctgctcagcttcccaattagctagaactacaggtgtgcaccaccacacctggctacaaactctccttgtcaccccctgttgataggtctctttccttcacaggctgagacaactccaattcaactctgaatccccaatacaggacctgcccagggaacagggctcagacatttatgctgggaaatactcagcttttggggctcagcgtccttttctgcaaaaagagttcccctcccaagaggaaatcccctaagcctaaggacaggaggtgatggaaagatggatggacgggcagatagatggatggaaaaaaatggacagttggaaacagacaaacttggtggatgagcagaaataagcctcattctcgcctaacaacgggacagcctgggggaggggtgggacacaccaaggctcccagttgacccccagcaattggacaagagagtttataaaccagcattggggttttaggagcattgtaagctgcagagtgcatggggtcttcagtgggaagcatctccttccccatccctgttctctgtcctggggttgcccatcaagctaatcacatgtccacccctggggtccctctggcctctgccactcttcaccaaagtacagttaaactccaggggcaaatgatgtgttgggggtgtggcagacagggattgtgtctcagcagagagggcacagcactcacaaaatagcttcaatagttccagggtcagtagatgtgcccgaagaggaaccccacatcgcaagtggcctaagcctggggtagggtgagcactgctcactcctgcccagaggagtagctgaggggcctaagctctagctctgagcccaccagccattccatccaccacccacctgaaactgttctgttgacccacagcaattggtcctggtgccaggcacagaacagatgctcaaaagatacggttgattctgtctgggtgcagtggctcacgcctgtaaacccagcactttgcgaggctgggatgggaggattgctggaggccaggagttcaagaccagcctgggcaacatagtgagatccccatctctataaaaataaaaattagctgagcatgatggtgtgcgcctgtagttccagctactcgggagactgaggtggaaggatagtttgagccaggagttcgaggctgcagtgagctacgatcatgacactacactccagcctgggagacacagcaagaccctatttaaaaaaaaaaatggtatggttaatctgcctttactgattacaaatcaataaatttgtattatcgtaataaatctgtctttattgattacaaggcactttctcatcccccatcacctaagacaactgcataaagaccgcatgagctataaagaccatttccttgccccaggtcacacggaggaaaagagacagagccaggatttaaacccctgcccctggctttcattcctttgctgtgtccctgcagacccgaggcccacctgggtgaagaacaggtgggtggacattggcagtgttcaccaggggaagcatgccaggtgcaaggaaacatgtgagcacctgtccgtgcccaatgggtctctgtttgtctccctgcatcttcacccaaaccagcttctcacacccccacggccaccaccaccactccaggcctctacctgggccctttaatgccccttcctcattcctcaagagcccactggcgtcccttccctgatggcctgctggcctcctgcctccctccctgacctcagcctcctcggattttcaacagcctggggttgcaggctgagctcagcatctggcaggggcctggaagaaatgacctctagagggcccacactctctgggtgtcatattttggggctattatcacaaaataccttagactgggtaatttataaatgacagaagtgcgttgctcacagttctggaggctgggatgtcccagatcaaggcacctgcagattcagtgcctggtgaggagggctcactctgcatcataggtggtaccttgttgccgtgtccttatatggcaaaagaggcaaaggcgcttgctcaagccccttttataaaagggggcactaatcccattcatgaaggtggattcctcatgaattagtcacttcctaagggtcccctcttactactatcacattgggtattaagttccaacatatgaattcaaggggaacaatgacattcagaccatagcaccagacgtctatctggggaagcccccaaatatttgtctttttttttttttggaggcagggtctgcctctgtcattcaggctggagtgcaatggtacaatcacagctcactgcagctttgaactcctgggctcaagtgatcctcctatctcagcctccccagtagctaggaccacagatgtgcactaccacatccgactatttttttattttagtttttttgtagagacagagtctcaccatgttgcccaggctgatctcgaactcctgaccccaagcaatcctcccaccacctcagcctcccaaagtgctgggatcacgagtgtgagccatcatgcccagccagccccctcatatttgatccaggcattaagcctcctggcaagaccagcagctccctgcccctgaggcagggctgagtttcagaagctgcttttcattctcagactatgctgagcctggtactgtgcacacagcacatctgaactttgttcaacatatccctgcaccaacctggcaggacggcctcaggccagggaggaaccggggagatgatgtgggatgagaagagagatcagacagaggctgtctagacacagtttcctggcaaagtcaccaagagccctgcgagcagctgtccacacctcctggcactctctgtatctgtcccgtccctgccagctccccacccgcccagtgcttcaccagctcacccctcagacactgtccaggtgggaaccattcccctcaactccctccagaacaaccagatggcacctgccagcagccctgggagccagaatcccacccacctgacccaagggctctatctgatctcagcctaacccatgaatcaggccctttggagagccaaaggaaaattgggcttccctgccagctgactatgtgacagttcagatgtcccagagcacaggaaagaggcagagacagggtcgtgaggagcccttgcttctccttcaacatctcccataaacaactggagaggggctctcacagggtccatgggaagagaccaaggaggggcatggaggagaggggagggctgagaagaccagggtgaaatggatgaggagaaggaagcagatggcagggaccctcccatctcccacatgggctcccttaggtgctactggccttgtgcaaatttgcacactcacattcacacatttctgtctgcttctctccaatcgttcagatacctagcacacaccccagcctctagaatcaggtagtcagtctagcagagtctttagcatttgacttctgggtttaaatcctggctttagcacttcctagcttcacggccctgtttaggcagtttatatgcctccctgagcttcccaggttttggggaggaataaatggcatagcagatgggaaacatctagcactgtcctgctatatcatagactgtgaaagatcactgtttttgtactattggccttgctttgtagtaattatcattaacttttttttgagataaggtctcactctgtctcccagcctagtgtgatcatagttcactgccacctcgatctcctgggcttaagtgatcctcccacctcagcctcccaagtagctgggactacaggcacacaccaccacacttggctaatctctctccttttttttttttttttttttttttttagagaccgggtctcattatgttgcccaggctggcctcccaaagtgctagaattacaggtgtgagccactgcacacggcctactttgtaataataacaaacaatacagccgctactttttggtagtttcaaaccatgatcccagaattttttgattcatcaaaaggtagaacctatgtcatctaccgttgaatccagactgtgcgattgcttgaccaatagaatatagaagaaacgttatgcgacatccaaggctacatcataaaatgtgacagagcttccactgggttctccttgtcttagagcccagccaccatacgatgaggaagcccaagtagctgaagagaggagaggcccaaacaaaggaaccaagtcccctggaccacagcctagctgagctcccagccaaccagaaagcgccaacttagcaaccgctagaggagccatctcagaaatgaattctgcagccccctggtgagctccagctgatgccatgtggagcaggaacgaactgtcccctcaacatcctgcccaaattgtggatgtgtgagcaaaataaatgactgtcatgttttaagctactacatgttgggtggtttgttgcacagccatagacaactggatgacaaacacatatctgacgctttatccgtcattgccatgctaagctgcagatatttttgtaatctacacgtttagaccttttccagcttttagagctcacacttcccttcagtacacctgcaagctccctgaattcattttcatgtaatcctccacttttttccttcagccggttcatgttaggtttctctcatagcccctaaacacagtgctcaaataccaataacctggatcccatcttgcggctctgcaggaagctgtttttgcacaaggttcttccacatttctgggaaccaggagatgtctacttcagctacaatctctcctgctcgtcccctgtcccctcgggagggtctggctcagaacagatttcactgtgggacccaagccaacctgttagccactcctaccccaggacgggtgaaacacagtcttgcagtaacaagacttacttttgaaggatggaattacaatatggaaaaaatacaacttcacaaggtacacgttcagttcatagcagcagccaagactttgaaggaagagttcaagtcgccacaaaaacatagcagagggaatagtacggattttagagccagatagtactggagacttggagactgcagggctgggagggtcacagacagtcctgagttcaaatctccactccaccactcattgcccacgtgaccttgagcaagttatttaacctctctgagcctccatttcctcaaaggcaaattggggataataaacccagtgtttgtgaggatagataggatgcatattctgctcgtggttgtgccaaccaaggacacattcagagtaaattcaagactcttcttgaagagtcacgagcacagtggcccatggcagtaatcccagcactttgggagggtgaggcgggtggatcacttgaggtcaggagctcaagaccagcctggacaacatgttgaaaccttgtctctactaaaaatacaataaattagcagggcgtaggcatgcctgtagtcccagctactcagaagtttgaggcaggacaatcccttgaacctgagagatggaggttgcaggcgctgcagtccagccagcctggatgacagagagagactgtctcaaaatacaaataaaataaaataaaaaaagaatgagactcttcttactgcaaaaactgacctctggggggtggaaacaaacaaacaaatgagcaaaaaccattgttcttgcctagctgttaaagaatattgcgttttctcataacttgacacgatacagaaacatacaatgaagaatctggtgggtattgaactgtcaattgcaaaataattattcatcactgcaggtccagcctgttctccgggaaggactgtttgaatgtcctgggcctccaagccaagctcccagagcccagaccgtctctttggctaatgctggctctatctcctgaagaaaatagtttgatgcaaggaagaactttcattatcttttgccctggagcaccagtaactgtctacaaagagcagagcaagggaagaagggcagtgagaaattaatctttgagtttcctccttggtgattcatccatttagaaatgggtagattcagagaagtgtttcttcatccggtccctctgttcccatgatctcaaaaatgaaaaggcagccaaccctgatcaccacccatcagtcagcctcttttcacaagtgggaggcatgggctgtgctggaccaagtgcaaatgcaagacatgtctctaacaggccttctggaaccaggggaagctggtggcttggatgcacccactgtgaggtagagtgttatactgcagcccccataaccctgcacttctccaagtctatgattatttgactctggaatctggtgtagcacatctgctcagttgctcagtcattacttactgagcacttacaatgtgccaggacaggcagggtataaaggattgagaattgaacaaggtagtcaaggtagtatgatccctgccctcaaagagcttgttttagtatatagggtttctcaactttggcaccattgtgggctgaataattctttgttgtggggctgtcctatgtactatatttttttttttttttgagacagagtctcgctctgtcgccgaggctggagtgcggtggcgctatctcagctcactgcaacctctgtctcccgggttcaagtgattttcctgcctcagcctcccgagtagctgagattacaggcaccaaccaccacgcctggctaatttttgtatttttagtagaaacgcggtttcaccgtgttggccagggtggtctcgaactcctgacctcaggtgatccacccacctcggcctcccaaaatattgggattatgggcatgagccaccacgcccggcccactataaaaactttagcagcatccatggcctctatccactagattccaatatcacaccctttctcccaattatgacaaccaaaaatgtctccaagcattttcaaatttcacccgagggtcaaaattcaccccaccccactcctaccattcacgattgagaatctctattccaatgaaagaagcaggcagcttagtggaaagagtgtgagcttcggagccaggtgggcctgggttctcccttccactttattagctgcgtgatctttggggaatcacttctctctcttacgcatacgtagattatttgaaaattatgggtagcaatcatatttttacaaggttgttgggtgagctaaagatcaaatgtgtaaagaactgtggcaggctgggcacggtggctcacacgtgtaatcccagcactttaggaggccaaggcgggtggatcacctgaggtcaggagttcgagaccagcctggccaacatggtgaaatcccgtctctactaaaaatacaaaaatcagccaggtgtggtgccacacgcctgtaatcccagctacccgggaggctgaggcaggagaatcgcttgaactcaggaggcagaggttgcagtgagctgagatcacgccactgcactccagcctgggtgacagagcgagacaccatctcaaacaaacaaacaaacaaacaaacaaacaaaaaacaggggcagacactgtcaacaccaaaagtcatcctcttgtcttaattcttcttgctaacagaaccccagttctttcaagggtccctatctcagaagttgggctcagtccctagagggggtgggcatgcaaaccaggtctagttaatgagctatttgagggagggggccctctgggggtagaaggttaataaaaagtttggttattttatttttatgcttttatttttttagagacaggaccttgctctgttgcccaggctagagtacagtgccacaatcatagctcactgcagcctcgaactcctgggctaaaggaaggtggggactagaagatggataagcactccacacttgttagctatctattattgctgttagcactgtcattatcagtattttttttttttttttgacggagtctcgctctgtcactcaggctggagtacagtggtgcactctcggctcactgcaacctccgcctcccaggttcaagcaattctcctgcctcagcctcccaagtagctgggattacaggcgcctgccaccacgcccggctaatttttgtatttttagtagagacagggtttcaccatattggccaggctggtctcaaactcctgaccttgtgatccgcccgcctcggcctcccaaagtgctgggattacaggcatgagccaccacgcccagccctttttgctttttttttttttgaaacagggtcttgctctgtcacccaggctggagtgcagtggtgcaatcttggctcactgcaacctccacctcccaggttcaagcaattctcctgcctcagcctcttgagtagctgggagtacaggcatgtgccaccacgcccagctaatttttgcatttttagtagagatggggtttctccatgttggccaggctggtctcgaactcctgacctcaggtgatcttcccgcctcggcctcccaaagtgctggaattacaggtgtaagccaccacgcacggccctttatcagtattattattattaacttttactaaggaaagagggaggcccttggccaggccgtaggattgctggccttccagggagtgtgttacccagggaagtggcataaaattacagaattgggaagctaagaggtagctctagacatcacacctctaacctttttgatattctgttgctccatctacaaatggcatttagaatttttgttcttaaagagtcacaaatcacgtgcaggaagcttgaaaccagtcctgttaccttcctatgctctgatgccacctgggaatttgagctggtgtttcgggtaagagaacagcttataaccaggcttttcaggacaatgaagactgcctttcagtgggaagatgaacaatctgcctaagtcataagaatgatacaatggactttggggacttgggggaaagagtggaagggggtcgagggacaaaaggctacaaatatggggcagcgtatagtgttcagatgatgggtgcaccaatatctcacaaatcaccactaaagaacttactcatgtaaccaaataccacttgtaccccaataacttatgggaaaaaaatctacccaaggaataaaactaaatcgagactttaaaagcgagacattaaggaagttgactcttagctgacctggacacaggcctatcatggtaagtgctgcaggtgaacaaacagcagcaatttgacccttcttccttatacatcaaattcctttttttaaaaaattatttttgagacagagtctcgctctgttgcccaggctggagtgcagtggcacgatctcggctcactgcaacctctgcctcccaggttcaagcaattctcctgcctcagcctcccgagcagctgggattataggcacccaccagcacgtccggctaatttttgtatttttagtagagatggggtttcgccatgttggccaggctggtcttgaactcctgacttcaggtgatccacccactttggcctcccaaagtgctgggattagagacatgagccaccgcgcctggcccaatttcatttttttttttttagacagagacagtgtcttgctctgtcacccaggctgcaatcagtggcgtgatcatagctcactgcagcctcaaactcctgggctcaagagatcctcctgcctcagcctcctgagtagctgggactacaggtacatgccaccacgtccgactattatttttattttttgtaaagatggggtctcattatgttgcccaggctggcctcaaattcctgggctcaagccatcctcccacctcagcctcccaaagtgctgggattacagatgtgagccaccacacccagcccaaattccaattttctaaagaatctggggctctctgtgttttaagactattaggctctccccagtttcaggggatgaatcttgagcagtctgatggagggctggcaagccattgcctaaacccggcccaccacctgcttttgtacggctcaggagctggaaatggcttttacatttttaagtagttagaaaagatcaaaagtgtaataatatctcctaacacataaaaattagatgaaattcaaatctcagtctccataaataaacccattcacttatttattatcatctatagctgctttcacactgcaacagcagaacagagtggttgctacagaaactgtgtggccacaagcctgaaatatttattctctggctcttcagaggaaaagatcttaggaagccagaggttctcaaactcagtgtccatcagaaacccccggagggcacgtttaaacatagactatgggccgggcgcagtggctcacgcctgtaattctaacactttgggaggccgagagtttgagaccagagcattgtttaagccaagagtttgagaccagactggacaacatagcaagaccctgtctctacaaaaaataaaaaaaatagctgggtgtgggggtgcacacctgtagtcctggctacatgggaggctgaggcaggaggatcgctcaagcccaggagttggaggctgcaatgcgctatgatagtgtcactgtactcctgcctgggcaacagagaccccgattctagtaaataaataaataaaaacatagatcccaccccagagtttctgatttagtaggtctgaactggggtctgagaatttgcagttcttaaaattgcctagacatggcagatgctgctggcctggggatctcgctttaagaagcactggtctaaggcaaccttgggaattccattcccttgccagcaactggcttagaaaagggcacgtgatacatttctgaccaatgcgatgaaggagaagtcagctggcagcttctgagaaaatgagaaaatgatcataaaaagggacagatgggctgggcgtggtggctcacatctgtaaccctagtgctttgggaggttgaggcaagaggatcacttgaggcccagagttcgagaccagcctgggcaacagagggagacctcatctctagaaaaaactctgaagttagctgggtatggtagcatgcacctatagtcccagctactcaggaaactgaaggaggatcacttgagcctagaagttcaaggctgcagcgagctatgattgcaccactacactccagtctgggtgacagagcgagaccctgtctcaaaaacaagcggggaacaagtggaagaaggctctcttctctcttgtccatattatcttgagaccatgatggggtgtggctgagggcaagagccagctgctaagaatggaatagtggaaaagtggaaggaaacaaggcccaccattccacaatggagccactgaatcaattaaccacatggccccctgcagagaaacaataacttccattagcatctacaccacttccagttgggttctcagtgatttgaagccaaacacaacctacctggcaaccctacaacttcacccctcaccactgtttggacactaccaaacttaggccatgatgattaaggccaggcatgagctccaccctccctgccaccctatgaggaataaagcagatatggggaaggtgaaagggcatgatttagggatccataaagccccagattggagccttagttctacaactcaataatggtgggctagagctctatgcaccccatactctaggatggggactcatacctgcatggttgactagtgcagtcatgtctgtgcatctgagcagttattttcttctctggaccattattaaccattagagctagcatttgtccccaggtcccgggcactgtgcaagtcttcacctacattatcctactacctcataagatagtttggatgtgtgtcccctccaaacctcatgttgaaatgtgatccccaatgttggaggcggggcttggcgagaggtatttgggtggtgggagcagatccctcatgaatagcttggtgccctccctgagtaatgagtgagttctcactcttttagttcacggcggggtctgattgttaaaaaagtgtttggcacccttcctgtctctctctcacccctcttctcaccatgtgacacacctgctcccctttcaccctccacagtgaagaaaagcttcctgaggtctcaccagaagcagatgctggcatcatgcttcttgtacagtctgcagaacgtgagctaaacaaacctcttttcttataaattactcaccctcaagtattcctttatggcaacgcaaaacaggctaagacacctcaatggactaatacataacagccccataaggtgagtgccaccatctcccccaccttacagatcaggaaacaggggctctgaaaaactgtggctcactcaaggtcataccgcttgttaagtgcagagataggattccaactcagaggcatctggctcaagaacccacgtgtctgtgtttcaggttgcaatgctgaggttaaacaagaggatgtgtgctaggagccccagcacaccacaggggctgggaaacgttattgcatcgagtttgagtccaacacacggtctcattcctccacccaccactcagcctagaaaaagggtcggaaggttgactccactttcagaagcttgccagctccagccagtcagccagagtgaagctgacaagagcaatgagggaaatacggaaagataaatccagatgtggacaatgagaccgtgtcccctgagaactgtggtggcagagggactcaaaggtccaggcctgctcggtgtggctgcggctcaggttcctgggccacagggctgccttacctgccagtttccatgcctggctgactccccccaccgcccctctggcttccacaccagcccactgatgccaccccagagaactcggctgtttgccttgctcctctagagggcaggtggatgcggtgaaacgggcagcgattccagagccatcacaactcctggctgaaaccaaacatgacagatttaccattgggcaggctgctccatttattatttaacactcgcaataaatatttgcatgacccagtgctggagggaacgctctgtgataactcactgcattttcctgccaaacaccagcacagtcggattccgaagctgcagcagagaatattttatgctattctaaaaatccaggtgatggccccttgttagaaaaccttttctcatccatttccatagaggaaaaaaggagcagggagaccttagctccgagaagcaactagaggaggaagaagaggaggaggaagatgctgacaggtgacatttacttagcacctactgagtgccaggccctaagctaaggacttcacactcattcattcaacacctctctctagagggtagggttgccagacttaacaagtaaaaatatacgacacccaattcaattttaaatccagtgaaataaggaatgattttttaaatacaagttatgtatctgatgtaatactggaaaattattcaatgtttatctaaggttcaaatttgggtgcaatggcatgcccttatattcccagctacttggaaggctgaggcagggaaatcacttgaacccgggaggcagaagttgcagtgagccaagatcatgccactgcactacagcctgggcgacagagcgagactctgtctcaaaaaaaaaaaaaaaaaatagaacaaactgggctacaaagttttgccaggcatggtggctcacgcctgtcaccccagcactttgggaggccaaggtgggcagatcacctgagatcaggagttcgagaccaacctggccaacagggcaaaaacccatctctactaaaaatacaaacattagccaggcctggtggtgcacgtctgtaattccagctactcgggaggctgaggcatcagaatcacttgaacctgggaggcagaggttgcagtgagccaagatcatgccactgcactccagcctgggggatagagtgagactctgtctcaaaaaaaaaaaaaaaaaaaaaaaaaaatgtaactgggcatcctgtttgtatctggtaacactccttaaggttggactaactatgcgaagacactgaatttaaaaggcttttcttttcatttattttttaagagacgtatctgtgtaactcaggctgcagtgcaatggctattcacagggatgatcagggctcactgtagcctcaaactcccaggcttaagagatggtcccacctcagcctcccaagcagctgggactacaagtacatgacactgcgtctggtgttcagtggtgcaatcacggctcactgcagccttgaactcctgggctcaagcaatcctcttgcctcagccaccagagtagctagaactacaggtatacagcaccacgcctcgctatttttttttttttttttttttgtagagatggggtctcaatgtgttgcccaggctgatctcaaactcccggtctcaagtgatcctcctacctcagtctcccaaagcactggaattacaggcatgagccaccacgtccagcctcttttttttctttaaggaggcttattttttagtgtgggttagggaagagccatgtgtgaagttgactctggagcagagatgtcaaagatgagaaagagctacccataacaaaaaaacggggaacaggattcctggcaaagaccccacaaagaccctggggctggaaaccatgtggggcattggaggagtcaagggaggtgacacttttggagctgagtaatggagaggaaagtgacaggagcagactgcacagggccttggtcacaatgaaggatttggatgctattctaagttaaagggaaggcatgggaaagcttttcagctggaagtggccaaactggggaccgactctggctgtacggatttctgagcctggagatggcacaaaggacctgacattggcaggaaaagaaaagaggaggaacaagaacacgagaaattgccttaaaagggagctggtcaggtctcgccagaaaagttcacgcaataacaaaccagccgcccacaacagacatctccacattttcccagagctgtcccccagccaggcggccggagtgaggggatgccgacggtgacaatgctatcaatttccattttgcttttgccaaatacggaaaaggacacttcaaagacttttaaaaataacttccaaacaactcaagggtgaaaaaaaagaaagaggtaaaaaattacagtctgcctgcttgagaatagcgataatgaaaataagtgatagaaataagaacagctgcttttgcacacgttatgtcatctgctccttagcactctatgaagcaggcagaacaggtcatggtatccccatttcatagataaggaaactgagacccagaaacataggatacaacagagaggaaatgatcaggtgggtgagaagctatgtttgtctggccccaaagcctgggttccccaaagccctctgcaggctgatatgagcctaaccccagcccggctcctggctctcagccatctcatcctcccagcccagctatggggagcaagatacctcctaccatgtcccttgcagccttcctccctcgcctgcaggggcttcctgcctggaaagcctgttcctttgcccttcttctccagaggattcacgtacctcagcacatgttcgacgacaaagtcacagcactgcagggacacctcccctggagaggaacacgatggtagagtggaaggggcacagctttgccattagaatgcctgagttcaaatcccagctcaatcaccaactggttgggtatccttaagctcttccaaggagtgggggataatccaatccatccccacaggatcctggtggggattaaatgagatgctgtatgtaaaacatcaacacagggccaggtgccatggctcacacctgtaacaccagcacattgggaggtggaggcaggagaatcgcttgaagccaggagtttgagactaacctgggcaacatagccagacccctatctatacaataaaatgtctttttaattagctgggtgtgatagcccatgcctgtaatcccagctacttgggaagctgagacaggaagattgcttaagcccaggagttcaaagctgtagtgagctatgatcatgccactgaactccagccatggtgacagaactagaccccaactctaaaaaaataaaaaacattaaaaaaaaatcagcacagtgcctggcatacagtcagcacctaataagtagtagctgttttttgttttttgtttttttttccatctctgaaaaaaaaaatcagccattttttaaaattagctgagtgtaatggtatatctctgtaatcccagctacttgggaagctgaagcagggggactgcttgaccccaggagtttgaagcttcagcgagctatgattgtgccactgaactccagccatggtgacagaacaagacccaatccctgaaaataaataaatcaattggcacagtgcctggcatatagtcagcacctaataagtagtagctgttagaataattacaaaaggccaggcgtggtggctcacacctgtactcccaacactttcagaggccaaggagggtggatggcctgaggtcaggagtttaagaccagcatggccaacacagtgaaaccccatctctgctaaaaatacacacacacgcaaaacaaatcactgggcatggtggcacatgcctgtagttagtctcagcttcttgagaggctgaggcaagaaaatcgcttgaacccaggatgcagagattgcagtgagccaagatagtaccactgcactccagcctgggtgatagagcaagactttgtctcaaaacaaacaaacaaacaaaaacaaaaaaaacactcaaatcatgggattgagtgttcaatcattcaatcaatttttattgaatgcctactacatgctaggtacttagggatataacaggaaataagacatacgtgattctaccttaatgaaacttagaagaaggaatatacttatggtatagtgaaagaaacatatttattagaaatcaaacataaaaagcataaaaagtgttgaagagtgctctaaaagaacagaggtttctgtgaatcatctactttatttatttatttatttatttattttgagacagagttttgctctgtcacccaggctggagtgcagtggcgtgatctcagctcactgcaacctccacctcccaggttcaagcgattctcctgcctcagcctcccaagtagctgggattacaggcacccgccaccatgcctggcttatttttgtatttttagtagacacggggttttactatgttggccaggctggtcttgaactcctgatgtcaggtgatctgcctgcctcagcctcccaaagtgctgggattacaggcgtgagccactgcacccagcccagaatcatctactttagactgaggcatctgagacgtgctcaaaggacatttcagtggagaaccatgggtgtgaaggagggagtcacacggagactgggaagggacagacctttgtaggacagacggcaacacgtgcaaagcttgtgctgggaggtgaagggagaacaactcgctggaggaagcaaggaagaggagatttagttagagcagacagccaggatcagagcatgcagggtctgatcatttatttccaagttattctgaaatcaaagagaagcaggcttttaagctaagaatgcagcacatcggctagcatagaataagagttcaaaaaaagtgtaagctcccttccctctcctgaaacaaccaaagtaaataaaaatggcccctctgttttcaattatttatttatttgtgctttcaaactgttttcttaaaaaaaaaaaaaaactacagagtagtgagtgggggcgggggggtaaggggtggaatactcaaaacgtgttcaaaatcaaacgagccagaaactcctcgctggaaattttctctctagatctctgcaggaatcagtggaaccatgagagacagagtcgaaagcagcagagcctggaattatttctctaagcaagacccagacgccaggcaggtagtgaaattgctcctgccccacctccatccttgctgcctatttgagaacagagtctgccaacccctcctgatgagagactgacccctcatagccactgcaggctggaagccataagcttaaaccacttccataccatgaaagcaaaatgtatggttggcaaaaagcaaaaaaaaaaaaaaaaaacaaaaactggttactggcgagtgcagaaccacagtctgggtcgatgacaaattatccagcatgaatcttggtgtgacttaggcccttcttagtcctctaaaattcatcacattttgtttattcgttcactacccacttacagtagatgccaagaaatatatataacaagattatagatataaatttaaaattaggactaaagaaagataatctagaataagaggtaaaagcagaacagagcaggatggaaggtagaataaagatatacaggccagaaggccagttactaaactggatttgagaacatggcgctgagttccctggtggccaagtcaaaaagggcagttggagatgttctcatggtccacaaaaagaaacacacttaactttgcagaacaagcactgtcctgccgtgtgacctcagataagtgatttaacctacttagactcagctgcctcattgccaaaaagttagtgaaaactattgaatgtttaggtaaaaagttgtaataaaaaacaagaatgggaaaggattccctatttaaaatggtgttgggaaaactggctagccatatgcagaaaactgaaactgggccccttccttacacctgatacaaaaattaactcaagattgattaaagtcttaaatgttagacctaaaaccataaaaacccaagaagaaaacgtaggcaataccattcaggacataggcatgggcaaaggcttcatgactgaaacaccaaaagcaatggcaacaaaagccaaaattgacaaatgggatctaattaaactaaagagcttctgcacagcaaaacaaactatcatcagagtgaacaggcaacttacagaatgggagaaaagttttgcaatctatccatcgggctaatatccagaatccacaaggaacttaaacatatttataagaaaaaaacaaccccatccaaaagtggccggaggatatgaacagacacttctcaaaagaagacatttatgtggccaacaaacatgtgaagaaaagctcatcatcactggtcattagagaaatgcaaatcattgtcagagtgctcagagagggcatgttccctgggtcttggtggatttagaggtcaagggaccatttctggaagctcactgtgtgccagggcagcttatatcagagctccgctctttttctttttcttttttttttttaagacagagtctcactgttgcccaggctggagtgcagtggcaccatttcggctcactgcaacctccacctcccgggtccaagagattctcctgcctcagcctcctgagtagctgggactacaggcatgcaccaccaccacacctggctaatttttatatttttagtagagacggggtttcaccatgttagcaaggctggtctcgaactcctgacctcaggtgatccacctgccttggcctctgaaggtgctgagattacagtcatgagccactgcgcttggccagagatctgctctggaagaccccccaggctggagggcactgccacaagcagacagtatggcgagggtccctatgaccacctggcaggcagggtggattctggagggaggtggcctgggagcaggctgaggatggggtgagggcatttgagcagcagagtgtctgcgtgaccgggcataactggagggacagtaaatgactcttgtgtgagaggatgagggaggggtgagaggggctgactacccccaggacttgaggtgcagtgagactccttagctttaaccagactcatgggagccatggaggtttgaggcagaggtgtgggctgctgggagagtgaggactcaccatccagagaggaaggtgaagctttcaactctaaatgccgttttattttcgtgtgttttttttttttttttgagacggagtttcactcttattgcccaggctggagtgtgatagcacgagctcggctcactgcaacctctgcctcccgggttcaagcgattctcctgcctcaccctcccaagtagctgggattacaggcatgcgccaccatgcgtggctaattttatatttttagtagaaacagggtttctccgtgttggtcaggctggtctggaactcctgacttcaggtgatccgcccgccttggcctcccaaagtgctgggattacaggcatgagccactgtgcccggccccaaatgtgttttacattttcttcctatttgattcatctttgtcgtgcaacataaatatgctacttttccactgataaaaagacaaaatggaatttaaaattggcctggacttctcaaaaaaagtcagtgtgatgaaaacatgttctagataaaacagaaatgagactgggcatggtggctcatgcctggaatcccagcgccttgggaggccaaggaaggagaatcacttgaggccaggagtttgtgaccagcctgggcaacatagtgagaccgcagatctactaaaaatttaaaaattagctgggcatggtggtgcgtgcccgtatgtctggaggctgaggcaggaggatcgcttgagcccaggatctggaggctgaggcaggaggatcgcttgagcccaggatttggaggctgcagtgagctatgattgtgccactgcactccagtgtgggtgacagagtgagaccctgtctctatttaaaaaaagagagacaagatgatcaggatgagcgcagtggctcacgcctataatcccagcactttgggaggccaaagcaggtggatcacatgaggtcaggagtttgagaccggcccagcctagatggtgaaaccccgtttctactagaaatacaaaaatcagctgggtgtggtggggcacgcctgtgatcccagctactcgggagactgaggctggacaattgcttgaacctgggaggcagaagttgctgtgagcaagatgacaccactgtgctccagcctgggcaacaggaatgagactctgtctcaaacaaaaaaaaaaaaaaaaaaaaaaaagggatgatcaaacacaatgcgtcaacctcccggagctgttgtgagcaagatgacaccactgtgctccagcctgggcaacaggaatgagactctgtctcaaaaaaaaaaaaaaaagcgatgatcaaacacaatgcatcaacctcccggagccgtataaaccctaaacctaaaccaggaagcaggcaagcctgtgtgtgagtttccactctattgctggtaccactcggctctggcaacctggaaggccaccttcccctgttgttactgtgtaaggaggaaggagcactggtttgcaagtcagaagcctgggttgaagcctctgcttgagttcctgctggctgtgggaatgtggggttacctttcccggctggcctcgtttcctacatgtccaatgcaggggttccagtcacatgcattgggcaccattacatgtccaagctgtgccaggatctagataaatggctgggctcagtccaaggggccttcctatctggcagtgaaaataagaggagataccaagggccctgagcctgagtctggaggaaaagtcatgagcacagggcagtgccagggcctgggagctgccacagaggagcccaccttggtgacagacacctgtaggctcatatgatgccgagtgcccaacacagggaactggacaaaggtttcatgcacgactcttttccctccttggctaccttgaggaccttgattataatagttagccttttttttttctttttttgagactcttgctctgtcgcccaggttggaatgcagtggcaaaatcttggctcactgcaatcttcgcctctcaggttcaagtgactctccttcctcagcctccctagtagctgggattacaggcgtgcaccactatgctcggctaatttttgtatttttactacagatggggtttcaccatgttggccaggctgatcttgaactgctgacctcaggtgatctgcccgcctgggcctcccaaaatcttgggattacaggtgtaagccactgagcccagccggattataatagccttttcatgcaccaggggctttatactcattatctcatttcattcatatgagttgaagtcagcttatcccccatttcacagatgaggaaaccaaggcccagagaggttaggaatttgtccaaggtcacacagccaggaagtaggattcaaacccagacagccaggctgtaacacctgggctcctctcaggctcatgcccttcccaggggtctgggaagccctgacctgcagcctgtcacctttgtttaccccccagcctccaggatattatgtgtgcaccggcgtgggatcctggaactggcaggaattgtgggttgtgttggtccctgaactcccatcgcctatgtgaaatatggttgcttttgtggcttgggaggccatggccagccccgcgatgccattgactggtgagtgcatgcctgggaccaggctgcaaaatccctcacactctggggtagtcaaggcttatgaggaagtacccaaaactgaagctggggtttggtccagggagatcccagtgtgcagtactactttgcaggcaggcagaggcctcttggataacatggccagtgaagccagatcttggtactagctgtgccttaccctggccatgggctgaaaacgttgccttaaaaaattggccaggagcggtggctcactcctgtaatcccagcactttgggaggccgaggccggcagatcacttgaggtcaggagttcaagaccagcctggccaatatggtgaaaccccatctctactaaaaatgcaaaaattagctgtgtgtggtggcaggcgtctgtaatctcagctactcgggagactgaggcaggagaattgcttgaacccgggaggcggagtttgcagtgagttgagattgcaccgctgtattccaacctggacaacagtgccaaaccctgtctcaaaagaaaaaaataataataatataaagtgaccaggtgtgttgactcatgcctgtaatcccaccactttgggtcgaggcaggaggatcactggagcccaggagtttgaaacgagcctaggcaacagagtgagaccctgtctctatattaaacacacacacacacgcgcgtgcacacacacacacacacacacacacacacacatacaaaggcagccagactatgcactaggaactgccctgggaatccctttgtgttctcacaacaatcccatttcacatgaagaaacctaggcacagaaatattcagtaacgtgtccaggtgcggtggctcacgcctgtaatcccagtactttgggaggctgaggcaggcagatcacgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgagctgagatcacaccactgcactccaacctgggtgacagagcaaaactccgtctgaaaaaaaaaaaaagaaatattaagtaacttgtctgaggccacatagttaccaagacgtgggagctgggacttgaacccaggcagtctggctggattcatgcctgcagcctctgcactcctgctacttactgtgtgagaagcgtctgttctgtggaaggttgtgggctgagatgtttccatgacttccactcatttacccccaaggctgttcttaaagacgggcatgacagttatgcccattttacagatggggccctgaggctcacaagggcacgccactcacccatttccacaaagctatagttagttagcagagggcagaattcggccgcctctcccctagcttgaaggctgtgattgacacagaggtttttttgttgtcgttgctgttgtttgttcctttttcttttttttgagacagggtcttgctctgtcatcccggctggagcgcagtggtgcgatgtcagctcactgcaaattctgcctccaagatgcaaatgattctcgtgcctcagcctcccaagtagctagaattacaggtgtgcactaccacgcccagctgttttttgtagagatggggttagtagagatttgtttaatagagacggggtttcaccatggtctctactaaaccctgtctctactaaaaatacaaaaattacccaggcgtggtggcacatgcctgtagtcccaggtactcaagaggctgaggcaggggaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaattttttgtgtgtttttattgtctcgagacagagtcttgctctgttgctcaggctggactgcaatggcgtgatcctggctcaccgcaacctccacctcctgggttcaagcaattctcctacctcagcctcccgagtagctgggattacaggtgcgtgccaccatgcctggctaatcttgtatttttagtagagacagggtttcgccatgttggtcaggctgctctcgaactcctgacctcgtgatccacctgcctcggcctctcaaagtgttgggattacaggcatgagccactgagcctggcctggtgagctaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcagagggcatggtggggccaatggaatcattacccaagacggggattttcagggaaacagcttagataaggccaggtgtacagtagctcccacctgtaatcccagcatttggggaggctgaggtaggaggactgcttgagcctgggagttcgagaccagcctaggcaacatagtaagaccccatatccataaaaaatttaaaaaaggagtttgtgttcctgtagtagcagacttgggaggttgaggtggcagtatcacttgagcccaggagttcaaggctaaagtgagctgattgagccattgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgacagagaaagaccctgtctcttaaaaaaaaaaaaaaaaaaaatcttagataagaggatgctgtgcctccctgggggtcttcagtcacccatagtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctgacatagccagatgacttccgtgcccctgttgcaataaccactgcttccaagtctctatagaccaccccttgggtatatctaatgtaagtgatatttattttatttattttttgagtcagtctcgctctgtcacccaggctagagtgtgctgatgtgatctcggctcactacaacctctgcctcctgggttcaagcgattctcatgcctcagcctcccaagtggctgggactacaggcatgcaccatcatgcccagctaatttttgtattttttcagtagaggtggggtttcaccaagttggccaggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaacaaataataatattttacataaccaaccacttctaaagattaaaaaaacccctatgattaaaaacctcaggtccctcaggcaatcataccagatattgaaacaaagcaataacataaggactgcagtattcattttatttttatattatttatttattcttcattagtttcttgagattatcatccgctgagggtggaaggggagtgagcagacacactcgggaggtgtcttgagattatcatccgctgagggtggagctgagggtggaaggggagtgagcagacactcggcaggtgtcttgagattatcatccgctgagggtagagctgagggtggaaggggagtgagcagacactcgggaggtgtcttgagattatcatccgctgagggtggaaggggatagagcagacgctcggaaggtgtcttgaggctcagggagttatcaattatagaatgttgttgagttggaggaggtggctggtggcccatcctgttttttaaagtttcagctgtgaggtagggccagtagggcaatcctgaagaatgacgatgctccactgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtgtcagtgtcataatatcacccttccactgagtactgccgacaactggggggtaaagaaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaatagacagtaagagacagtaagagaggcatgaaaagcccattgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacctaaagaatacttttgtccatggaaaaatgaggtgggaattctaaacaaagcaagttttaaaactgtgtttcacttcaagtgtagaagtcccatcgcgtgtaatcataggactcggcagcttttgaaggtacagaggccacacaagaaccagcttagctgagcatcatttaaggccttcatttggaattgtccctgtgggtaataagttacattcactcttcactaatttacagtcagggcccatttgctattacaaatatggaacctctgacacttagaatattagatgggggccccactgggtggggatgaaggtgtttttgcgcaacacggttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctgtaagagtacagtctgagccggtcacggtggctgacgcctgtaatcccagcactctgggagggcgaggcggatggatcacgaggtcaggagattgagaccatcctggctaatacggtgaaaccccgtctctactaaaaatacaaaaaattaggcgggggtggtggcaggcacctgtaatcccagctactcgggaggctgaggcaggggaatcatttgaacctgggaggcagaggttgcaatgagccaagatcacgtcattgcactccagcctgggtgacacagcgagactccatctcagaaaaacaaaaacaaaaacaaaaacaaaaaaaactgtacagtctgatccaaactgttgctgtattgattcctcctcttgcttactgcctgctgacttctgagatgatagcttccttccccattctcagtatatccctaattcatccttcattgagcatcttttatcataaagctgtattctctttgtattaatatctttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctccttttctccgtgctcacgttctttcatgcttagtttcctcagactagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaatggacacctcccattgagggataaaaaaaaatcacactctggcctgctggcaagtcacctgtcatttccagctcatcttcatagttccatagttagtcctattctttagtaaatataaagactattaaaagcttctatgaggtgcactatgtgcgtctctggggtcagtcttgtgcttgacacagcaaaagctcattttagttcagtgtgaaaaaccagacctcaccaattcatcacaactaactccatcggaagcagaggattgctcctcatctgactcctcctgtgtgagactgattctcagtcagaggctgatgccggaactgagaccatcagccatagagagatccttccagaatatggtgtcattaaccctgcagttcactactgcactttgccatgattcaggactggaactcttgtcatcgactttaaagatcctgaaaaggcaatctgaatgctgggcgcatctattgaattagaaatgatgggaatggctcctaagtcagggtgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcgtgatcctaaggatctcacctgatacttggttttataggaaggatgtgtaaaattcccagaacgctaggaaacagggacgaaaacacttcaaagagaaagttaatgaacttgtttctgaccacagggcatccttcagcacatgctgtctggagtggcctcaaacaaggagtgtgtggtgaggtgctgacaatgcaatgggagcagggtcctgtccccacgctaaagaagctcacagtttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgacccatactgaagtccactggctctggttgagacccagaagagtcatgcatcagaatagaggtggacaggaaataccctggcctttgtagggactgagcctgcacagacgacctcaattgcagcctgtatggaggacccctgaccatcccccagaagtagactcccatctcttctgcagcaagataacatgctactaggtctcagttcattgctaaatattttttaaaaagtatctcacatttaacaaaaaaagatcagtcatatggcagcaaaatacaatgtaatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggctgggcacggtggctcacgcctgtaatcccagcacattgggaggccgaggtgtgcggatcatgatgtcaggagttctagaccagcttggccaatatggtgaaaccctgcctctactaaaaatacaaaaattatctgggcatggtggcatatgcctgtagtcccagctactcaagaggctgagggataagaatcgtttgaacctgggaggcggaggttgcagtgagccaagatcatgccactgcactctagcctgggtgacagagtgagactctgtctcaaaaaaaaaaaaaaaaaaaaaaaaaaattggccgaatgtggtggcacacacctgtaatccaagctactcgggaagccgaggcagaattgcttcaaactgggaggcagaggttgcagtgagccaagattgcaccatagcactccagcctgggcgacagagcgagactctatctcaaaattaaaaaaaaaaaaaaaagcctgggtgtggtggctcatgcctctaatcccagcactttgggaggctgaggcgggtggattacctgaggtcagaagttcgagaccagtctggacaacatggtgaaaccccatctctagtaaaaatacaaaaattagctgggcgtggtggtgggcacctgtaatcccagctacttgggaggctgaggcaggagaattgcttgaacccaaaaggcagtgagctgagattgtgccattgcactacggcctgggcaacaagagcaaagctccgtctcaggaaaaaaaaaaaaagagagagagaaaggaaaaccaatgccagtactagcaactcctcttcccctgaaaaaatgacaaacaagattgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaactttggtttccacctgtctccataaagtaaagatgtcttccaggacaattttaattcctggaaaggaagaaactcttttctttgtgtgcatacaaacggacctcagcccttggtgagagtgaggagaggagaaggtgagaaacctgagggcaagaagctgttctttccctttccagggcaaactcatttccacactatggggactccaacagagccataccttcctgtctacggcagttggacctcctggctctctgctgtacatccgtggatccatcatgtccattttgagacgggaagatagtcttcaggaaagacacctaggaaataataatataagaatgacggctaggcacggtggctcatgcgtataatcccagtactttgggaggccgaggcagggtggatcacggggtcaggagttcaagaccagcctggccaagatggtgaaaccccatctctactaaaaatacaaaaattagccgggcatggcagtgggcgcctgtaatccaagctactcgggaggctgaggcagagaaccgtttgaagctgggaggtggaggttgcagtgagccgagatcacaccactgcactccagcctgagtgacagaatgagactctgtcacacacacacacacacacacacacacaaacacacaagaatgacatgaggctggcatggtggctcactcctgtaatcccagtactttgggaggccgaggcaggcggaacacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaaggttgtgttgagctgagattgtgccattgcactccaacatgggcaacaaaattcaaactctgtctcaaaaaaaaaaaaaaataggccaggtgcggtagctcacgcctgtaatcccagcactttgggaggccgaggcgggtgaatcacggtccagagatggagaccatcctgggcaacatggtgaaaccccgtctctactaaaaatacaaaaattagctgagcatggtggcgcacgcctgtagtcccagctactccggaggctgaggcaggagaactgcttgaacccaagaggcagaggttgcagtgagccaagatcccaccactgcactccagcctggtgacagagtgagactccgtctcaaaaaaaaaaaaaaaaatgacatgaatatacttcacacaactgaactgtacacttcaacatggttagatggtaattatcatcttgtaagtattttaccacaggttaacatgtttcacaacttgaaaaggaagtaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaacttaatgcaaaacattctcactaatgattgaattcccaccaagatttccatattatcacagtatgcttttaatcttcgaagatattaaatatttgttctcatcatagctaaaatgcaacgcaaatcccatctgagatgtgggtcagatacctatgaatctcctgaggtagtcattgaaatgacttttttcttgagacggagtgtcagtcaaccatgctgaagtgcagtggcgctaccttggctcacggcaacctccacctcccagattcaagcgattcttgtgcctcggcctcccaagtagctgggattacaggtgcctgctaccatgcctggctaatttttgtctttttagtagagatggggtttcactatgttggcccatctggtcttgaactcctgacctcaagtgatccacctgcctcagcctcccaaagtgctgggattacaggcatgagccaccacacctggcctgaaataatatctttcaaattctttgtagaatttgttttttcctgatttctgcacataggataaaaaaaaaatcatgtactaggatttcaagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatgacacccatgatgtccctgcttaggaggtaatgactagatgacaaggacaaagatgagaggtacaaagttgtccaagtccaacagctcaactgaactttcctaaatggaattgttaaaaagtggtaaatttaaaaacttcccctggctcacgtggtggctcacgcttgtaatcccagcactttgggaggctgaggcgggtggatcatttgaggtcgggttttgagactagcctggccaacatggtaaaaccccgactctactaaaaatacacaaattagctgggcatggtcgtgggcacctgtaatcccagctacttgagaggctgaggcaggggaatcacttgaagccaggaggtggaggttgcagtgagccgagatcacaccattatactccagcctgggcaacagagggagactcctcttgggggtgagaaaagaaaaaaaaaaaaagcttcctccaatttataccaaaaattctctgttcaggactaagtggcatagagaatgttaaatgtgcctagatatcttcataactcatatattttctgttttctacatatcttgaaaggcagtgccaaatgacgtgtaattatctaggcagtaaaactgaaacatacttcctcttcccttgaatatcaaaaagcattgtggtattagtacttttatcttggatcattgttcagaaggaggttcagcccccagacaaccacatttttactgtcatgaatggcaagacaaaatgtagagctcaacttacccaaaggaaaaaaggctcaaaagacaaattatggcacaacttagcagccaaattcttaccaagtacagacttttgacatacggatctctctccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctaccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagactttcccatttaagtgacgaaacctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaattgtttcatataatttattcttatttgtgattacaagtatacctctacagaaagttagtatactcacacaaaggtaacttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaattttttttttttttttgagacagagttctgctccactcagtcgcccaggctggagtgcagtggtgcaatctcggctcactgcaacctccagctcctgggctcaagccattctcctgcctcagcctcccgagcagctgagattaccggtctctgccaccatgcctgactaatttttgtatttttagtagagatgaggtttcaccatgttggccagtctggccttgaactcctgacaggcgatctgcctgcctcggcctcccaaagtgctgggattacaggtgtgagccaccgtgcccagccattttttttgtttttgtttgttgtttgtttttgagatggggtctcactctgtcacccaggctggagtgcagtggtgtgctctcggctcactgcaacctctgcctctcaggttcaagtgattctcctgcctcagcctcctgagtagctgggagtacaggtgcctgacagtgcactcagcaaatttttgtattttttgtggagatggggttttgccatgttggccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttatttttgttttgagacaaagtcttgctctgtcacccaggctagattgcagtggcatgatctcagctcactgcaacctccgcctcccgggttcaagtgattctcctgcctcagctactgagtaactgggattacaggcgcctgccaccacgctcggctaatttttgtctttttagtagaaacagggtttcaccatcttggccaggctggtctccaactcctgacctcatgatccacctgcctcggcctcccaaagtgctgggaatacaggtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaatacaatgaagagattatttcattcacaaataagtatcgaattttagttcttaaaaagtaacaaggtgggccgggcgtggtggctcacgcctgcaatcccagcactttgggaagccgaggtgggtggaccacgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccaagatcgcaccactgcacttcagcctgggtgacagagcgagactctgtctcaaaaaaaaaaaaaaaaaaattaccaaggtggagatcatgaaaatggcatgaatagtgtgggatttctctaagattgttgatattaattccattagactcttatgtgagtgaagacaaagacttcccctgagtaagttcagacagcttgtgataacatttctacatcaattcctcaggatttaactatatattcttgaaaacatctcaattttaaatgtttctttcaagatggtgaattaaacagagatagcccttcaacaggttgaactcagcatatgctgagtctgaaatggaaatgatggagttagagaagcatacaacaatggtaatgatttcagaaatacggtgttgagcagaataaagcagacacaaaagagtacctatggcatggcatgcatctgtatacgtgaaattccagaataagcaagctaacctatgataagaaagagactggctgggaagagtgagagttcactttctggggtgacataatagtgtagatcttggctgggcacggtggttcacgcctgtaatcccaacactttgggaggccgaggcgggcggatcacctgaggtcgggagttcaaaaccagcctgaccaacatggagaaaccctatctctactaaaaatagaaaattagctgggagtggtggcacatgtctgtaatcccagccactcgggaggctgaggcaggagaatcgctcgaacctgggaagcagaggttgcggtgagctgatattggcccattgcactccagcctcagcaacaagggagaaactgtctcaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggctgaggcaggcggatcacgaggtcaagacatggagactatcctggcgaacatggtgaaacccagtctctactaaaaatacaaaaattagccaggcgtggtggcctactaaaaatacaaaaattagccaggcgtggtggtctactaaaaatacaaaaattagccaggcattgtaatctgagctactcaggaggctgaggcaggacaattgcttgaaccccggaagcggaggttgcagtgagccgagatcttgccactgcactccagcctgggcgacagagtgagactctgtctaaaaaacaaacaaacaaaaaagtcatcaaaccagatgacacaaatcaaatgacatttcactttgttttggtccgttttgtttgttggagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcggccccctaaagtgctgggattacaggcctgagctgtgtaatttcatgccgcgtgacacagcccagtaaaaaggaagaaaccccgcgggtccaacgtctactcacacaggtggactgatggctgataaatcccagcaggagccaaaagagcagccacagcacccatctactcacacaggtggactgatggctgataaatcccagcaggagccaaaagaggagccaaaagagcagccaccgcacccgcatgtcctggtcctttcagggctccctgaggcagccaggacagaggtggaggtggcttagggcagggcggagggaaggggacggggaccggggccggatctgagttggggagggggaggggagggggaggggaaggggaaggggaggggaaggggagaagtaagggaagggaaaggaggagaagggggctgttggggaggaggaggaggagaagaaaggggtctgggaaaggatccggttcaaattaagttctcaagcgctggtggaaggtttagctacaggtcacggagaagatcagggaagcaacaggacaggcggggcaagggagcgtgaggcttaggagcaattaggagacaaaggttctgctttccaccaaaccttcttcggtctgggccctcccttagcaaccctggggctttagactctctctccaccaatccctgatgaccccggtggtgcctcacaatggacattccaagtagtgcccgcatcatcccaatgacccctcccccatctcagtcccccacgctcctcccaaggccaggtcctctctggaaccttcacaaacctgatttctggtcctccccaaccagctccctgtccctgcttctgggcgctccttccttcctgagctcccagggttcctcaaggtcacttttggcgacaaaacataaaaaacaaatgatggcaggatggcaggaagaacctcatacccaagcagagtgccaggttttacagcctccgctcagccattcatatcctaagcaacaaaacatcagcaggatgcggaaggtcccgatagtaaaccatctccatcacaaccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcataaaactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgcgtgatctcaaatcacccctaacccacctagacattttaacatccgaaaccgagtgatgatgtccttatctatattatcttactgcccgtgtgtgtggactttaaattctgaacccaaatgagggggagaaaaccaagctgactttcatgactggcctctcagggatgtccaaggaatctgtgcatttcaagaaacaaagctcatcagcttctctcctaaggtatttgcccacaatacccagagggcttggcagcatcatgtgtgatgggtggggagctccaagcaggtgggcaggacccaggggcctggtgaccaggacagacccccactgtccatcacctttcctggccctgtcctcagctaaacttcccacaggccttctgcccgatcacacagagtgtgcccaaactctctcaggcctctggcagctgaaaagcactgctttaaatccctttaccatttactatgacataaggttattgtaaacaggaaatattctattgatgctacaaatggaaagccaatgcctttaccataaatagaaaaacaaccctaagaagcaagcaaaacaaaagaaaacaggggctgggtgtggtggctcacacctgtaatcccaccactttgggaggccgaggtgggcggatcacaaggtcaggagttccagaccagcctggccaatatggtgaaaccctgtctctaataaaatacaaaaattagccgggtgtggtggtgggcacctgtagtcccacctacttgggaggctgaggcaggagaatagtttgaacccgggaggcagagtctgcagtgagccgagattgcaccactgcactccagcctaggcgacagagcgagactctgtctcaaaaacagcaacaactacaaacaaacaaaaaacagggttaacaaaagtatggaattcaattctttttatatgctgcagccatgttccagccctagatttggctgggcatggtggctcacgcctgtaatcccagcactttgggaggctgaggcaggcggatcacgaggttaggggttgacacgagcctggccaatatggtgaaaccccatctctactaagaatacaaaaattagctgggcatggtggcgcatacctgtagtcccagctactcagaggctgaggcagaggaattgcttgaacccgggagacggaggttgcagtgagccgagattgtgccattgcactccagcctgggggacagagtgaaactctgtctcaaaaaaaaataaaaaatatatatatatgtgtgtgtgtgtgtctgtgtgtgtgtgtgtgtgtgtgtgtgtatctctataaatctcaaaaataaaagatcatttttgagattatcattttaaaagacaagataatgttcaacttaatgaataatttaattattactactggactttttgtagactgcacagagcattcaaaacaaatgaaggagaataaaaaatatgtattacatgttgtaaaataaatgtgatgtggttaattcttttattcaaaattatagaacatatatatgtactgtagaatgtatttcttattatgagtcatgttaaaaagtagtttagaagctgttgatttgaatttccttttcaaattttgcaggataatttttttttttttttgacagagtctcgctctgtcgtacagtctggagtgcaatggcgtgatctcggcccactaaaacctccacctcctgaatttcagcaattctcctgtctcagcctcctgagtagctggaactacaggctgacaccaccatgcccggctaatttttgtatttttagtagggacgaggttttgccatattggtcaggctggtctcgaagtcctggcctctggtgatccaccagcctcagcctcccaaaatgctgggattacaggcatgagtcaccatgcccagcctaaacttggcaagataataaataacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgagactgcgtaagcttcccccagcatcacccgctatgagatgtgtggcagctgagacccgggaactgctcaagggcaccaggccccatctgtctgcactcactcaccttcctcaggtactcgcatgggcatgtcactgactttacgtgctgctgcagctccttggtgagctggccctggtcatgggacaggaaccgtggggtcaggacaatagagagcttcaccatttgcagaatgagaacaggggctcatgatgagtgccaacctattagacaattttaaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaaggtttcacgagatcatacctataaaacatccaagtcatttaaatgtatcatcatttcggtcataattagtgggatccatttcactattattggatatacagttctgtgcctgaaacctacaaaaaaagaaaatgttaagtctaaaaagcattagtgatttctcatttttacattactaattataaccctgtttaatcacacaaggccttgtccgcggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataacgagaatccttagctcattcggttgtggtgaggggtgaatgatttggcacacaggaggggcttgttaacattagctgtgatgatctccttccaaatcttcattttcagagccacagatgaggccatagtgcaaccaggtgaccttagagtgtaagtacacatgatcgccagctatgctctatctccaccataggtccaagactgggtagttctggcctggaggcttctgctgcatctgccttctcagtgttcacctaaggacttttgtattttcctcctcacatccccacagaaggggttcaggctgccgaacacagctgggtgatgccagggcagtggccacctgtgccagccctgtgaggtagctggaggatcattgctccttccttctcaggctctgggcagatgccagggctggggtgacccatgccctcaagtttcttgctttggagggccacattttcccttggcaaagagggtaaaggtcacaggatgccggagagctgtgacttctctgtgccctgggcccaaactatgaagacctgacacactatgctaaaagtccaaggctgggtgctccccagagcttcttgcctcaccacttctgctgagggaggaatgaatactatgtcctcccagagctttgggagcttgtagcaagcagcctccccagcgcaaaatctcttggaaacctctaactgtgtcggaaacattagtgcaaatgttgcatcctatttcccatatgtccgcatgttttaggaaaaaaccctcaatttcctaaatatgcaagaaaaattggtattgtaggacaatgtgactttttaaaaaatgttatttaaacatcttccccacctccttttctgccctccaagactgccaaatacttgttgaacaaatattattaaatgcctactacgtgccagccatgattcatggtcttggggacacagcagagaacgaactgacaggattcctctcttatgtaactcacattcttatatgataatgataagggttaacattaattaagctgtcactacgtgttagtcacggtgcagtcattcccacacattattacacttaaacctgctagcaagcttgcaaggtagttagttgtttttcctttaaaaactgagtctcagaatgatgaagcactttgtccaatgtcacacagctagtaagtgtggagaccttgcatccaatcaatgcccgtctcattctaaacaccacgttatgtgttctccagcccatggagaataattttaacacagtcaatgaaatttctacacaacaatgttcttgtctcaagtccaagaaagccataatactggctttctggtgagtaaagatgccattctcatgtgtaatcaggtggcaaatggagatatgaccaaagtaaccctttgcctacactcataaccctgtacacactcttcctgtgtcgattcaattcaagtaccccttttgatcacttagcaaatctgacctttaaaagggttaaggtttttatatccatgtaagtttctgtattgctttggaagtctctggttaaatgaacaccctttttaatagtgacctgtgattctgttttgatcaagtgttttcaaacttgacatctttgatgggtttctccagtgtcaaaatcctaaatcaggtctttttggcttaaaattaactttgggatttttccactgcgtcccttcgggagtctgaagaatgcatctctcatcttgtagagatattaagtgattcgatttatttggtagattatatgggcgggcattgtcaaatgtggtgatactgcatgggagggcactgtcaagtgaggtgacattagatctcatctcagttatatttatgggtatgttgttgatatacatgttccaaaaattacatacatttatacaaatttaatatgttatgatttgtaattttgatagttatactaaatatttgttaaagttatatttgtataaacatgttatgaatggctgggcaccgtcactcatgcctgtaatcccagcactttcggagacaaaggcaggtggatcacctgaggttgggagttcgagaccagcctgactaatagggtgaaaccctgtctccactaaaaatacaaaaattcgccatgcctggtggcacatgcctgtagtctcagctactcgggaggctgagacaggaaaattgcttgaacacaggaggcggaggatgcagtgagtcgagatcatgccactgcactcccacctgggcaacagaggtagaatctatctaaaaaaaaagttattaattatttctgaagattatatgaaatttataaaagtctggtggtcctgatgtgatgctgtcagtcatgattctgattactgtcttaaaatgctgcacataagtaattaaatttccttgtgaactgggaagtttcatcagacttttatcataactattgtttccatcatccacagttactgttttgaattcttctctaaaaatatttgtaattggcaatagtccaaattttcttttgttttctttcttgtttttgagacacagtctggctctgtcgcttaagctggagtgcaatggtgggatcttggctcactgcaagctctgcctcctgggttcacgccattctcctgcctcagcctcccaagtagctgggactacaggtgcctgccaccacgcccagctaattttttgtatttttagtagagacggggtttcactgtgttagccaggatggtctcaatctcctgacctcgtgctctgcccgcctcggcctcccaaagtgctgggattacagatgtgagccaccgcgcccagcttaatttttgcatttttagtacagaggaggtttcaccatgttggccaggatggtctcgatctactgaccttgtaatctgcctgcctcggcctcccaaagtgctgggattacaggcatgagccactgcaactgaatttttttttgtttgtttgtttgagacagagactcactctgtcacccaggctggagtgcagtggcatgattttggctcactgcaacctccacctcctgagttcaaacaattatcctgcctcgtccttcggagtacctgggattacaggtgagtgccaccgtgcctggctcatttttgtatttttactagagacagcgtttcatcatgttggccaggctggtctcaaatcctggcctcaactgatccactctcattggccttccaaggtgctgggattataggcatgagacaccacacctggctcagtaagtacattttttattatcaaaaaagagtagtgtatgattggcttattctgtgtagaatgtattttatcgatggcttctatttttataatttctgagttaagtaatttttaatgaatgctttttagtttggggcagattcagttgactaaagcacctcatttcccagatacatgaaataaaatatttggcttcttttccaatttcacactgatgttattttgtgaaaatcagtgctttaagataaatctttatactttaaggtaaacatgagaaacttgatctaatatttaatatttattcagttctacactttattaacttctacaccagcagatttaaaaattatgtaactatctcaagaagtttcacttgggtgtaacggttcacgcttgtaatcccagcactttgggaggctgaggtgggaggattgcttaagacaaggagtttgagaccagcttgggcaatacagcaagatcccatctctattttaaagaaaagtttcactttgggaggccaaggcaggcggatcacaaggtcaggagatcgagaccatcctggctaacatggcaaaaccccatctctactaaaaatacaaaaaattagccaggcgtggtggtgggcacctgtagttccagctactcgggaggctgaggaagaagaatagcgtgaacccaggaggcagagtttgcagtgagctgagattgtgccactgcactccagcctgggcgacagagcgagactccgtctcaaaaaaaaaaaaaaaaagtttcagcaaattccacctaagaattccaccagagttctgttgtctccaatgtcatgttccacagatttcaagttgtgaagccctgaactgttaatttatcttgagaatgtacatttaagcttaatttaagactatatacctaaaaattgagcatataatttgtataatttgtttatgtaagtttttgtaagtcataagtatgtagtttccaagtatataatttatctgaatgtaataggcattaatatattttacattattgggaccataatacagaaatttctaaatggtttgtaaaataacttgttatttgcaatgttgtaaaagtagttaatacaatggaaaaactcataataagaagatacattttaacatcaagaagtttacccaaggtaattatgaatactacctggcaaactttacagaagctgtggtatcacttttatgatagaagaatagtgtttgcattttgtgtaaaagtacttggggctgggagtagtggctcatgtctataatcccagtgctttgggaggtgaaggcaggtggatcatctgagcccaggagtttgagaccagcctaggcaacatggcaagagcctgtctctccaaaacctatgaaaattagccaagcatggtggtgtgagcctgtagtcccagctacttgggagactcatgcaggaggatctcttgagcccaagaggcagaagatgaataaataaatggatgccactgaatgagatgaggtctctcttgaaggagagagaaaaagagatttaaatagtaacaattataataaggctgggcgcggtggctcacgcttgtaatcccagaactttgggaggccaaggcaggaggatcggttgaggtcacgagtttaagaccagcatggccaacacggtgaaacaatgtctctattaaaaatagaaaattagccagacatggtagtgcgttgcctgtggtctcagctactcaggtggctgagacaggagaatcgcttgaacctgggaggaataggttgtagtgagccgataaatataaaaagtattagagtcctaacagaggaaagtttccactgatcaccttttagctttgaacaatgcagaagcatttgcccagtttacttgtaattaaaaatcatgcatcattcacaatttatcagtcttttttgtttgtacaaaaactaatataagttattctcttttgtctgtattgtgactggtttggtgagagggaattaggccactcgagagtttgtgtgtgtttaaaattttctggccaggcacggtggctcatgcctgtaatcccagcacattcggaggctgaggcaggggtatcacctgaggtcaggagttctagaccagcctgaccaacatggagaaacccccatctctactaaaaatacaaaattagctgggcgtggtggtacgtgcctgtaatcccagctactcgggaggctgaggcaggagaattgcttgaacctgggaggcggaggttgtggtgagttgagatcacgccattgcactccagcctgggcaataagagtgaaactctgtctcaaataaataaataaataaatacataaactatcacagcataaagtaggagggatatttcattactgtctagttaaactggttaatgcggaaaggaagtctggaaattccagttttaaagtaaaattttggacattgtaggattgattatttggcatagctgtgatgtttgttgctgcattatggttttgttggcagggcagcctttaaggacctgtatattttcttctagactctatatattccccgtcagtattagttgcatggtcaaactggcaaattttaccataggtataaataatagagaatgtggaagaatagtgaatagtgtcagagatagttaaaggtccatacagaagtagagaaggtaataagtaatagtggcttggactaaatatttgttgaataaattttttaaaaaacagcctacctaaaatttgtgttgaagatatgaatgaatgaagtttccgcacccttatgtggagccctgataagtaagcaaaaataaggaagggtccccaggttggggagagccccaagttgaggagaataatgaacaattattgtatgaacaattgttagagacagctaatcacaaacaacctgtgggtacaatgacctcattccacatgtagcacccttaagcatgaccctgtaaaactttcctccagcccttgcctctttgcaggtagctccttctctgctgagctgcccactgcaacatattttcataatttctctaataaatctgcctttctttacctacaactatcttggtaaatagctttaccacctgcaaaactgaccctagttagttgctacccgatatggtttggctgcgcccccacccaaatttcatcttgaattgtagctcccatcatccccatgtgtcgtgggagggacctggtaggaggtaatggaatcatgggggcaggtttttcccatactgttctcgtgatagggaatacatctcactaaatctggtggttttataaagggcagtttccctgcacatgctctcttacctgctgccatgtaagacgtacctttgctccttctttgccttccaccatgattctgaggcctccccagccttgtggaactgtgagtacattaaacctctttttctttataaattacccagtctcaagtatttcttcatagcagtatgaaaagtaactaatacactacccgagacaccttaggagatttgtaacagctgtaatgccaggtccaccatatttttagcataaagcaaatgtttacccatgatatgactgcacaggctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggtaacatggaaaaacacagtctctacaaaaaatacaaaaattagctgagcgtggtggcacacacctgtagtcccagcaccttgggaggctgaggcaggagtatctcttgaacccaggaggtggaggccgcagtgagcagtgatcatgtcagaggcatgtgaaccagagcaactccatcttaaataggagctgggaaaaatgaggctgaaactactgggctgcattccctgatggttaaggcattctaagtcacaggatgacatagaaggtcagcacaaaataccagtcataaagaccttgctgataaaacaggttgcagtgaaggagctggccaaaacccaccaaaaccaaaatagtgacaagagtgacctcccgtcatcctcactgctacactcctaccagcaccatgacagtttacaaatgccatggcaacatcaagaagttaccctatatggtctaaaaagaggaggcatgaaaaatccaccccttgtttagcatatcatcaagaaataaccataaaaatgggcaaccagcagccctcctggctgctctgtctgtggagtagccattcttttattcctttactttcttttttttttttttttttgagatggagtctccctctgtcacccaggctggaatgcagtggcgtgatctcggctcactgcaagcttcacctcccgggttcacgccattctcctgcctcagcctccagagtagctgggactacaggcgcccgccaccacacctggctaatctttttgtatttttagtagagacggggtttcactgtgttaacaaggatggtcttgatctcctgacctcgtgatccacctgtctcagcctcccaaagtgctggggttacaggcgtgagccaccgtgcccctcctcctttacttttttaataaacttgctttcacttcacactgcaggatcaccctgaattctttcttgcacaagatccaagaaccttctcttggggtctggattgggacccctttcctgtaactatcatgccactgcactccagcctgggcaacagagcaaggccctgtctcaaaacaaaaaaaactaatatgacttaatacattcattttggagggcaagtctctcaaaatgggcctttcactgggggaaaatggtaaaaatactccctggtaattcaagaattgcagactcctgagatgctgctcatattagctgaacacttaccaatacttcacttttttccatatatactcaaggaacaagtgctatttaaagtgtttcactctgctgtgctaggtgcaagactataaagaggtgtgaggatcaacacttttatgaaaaccaacgtcattctgaatgtagtttcagatgctagtgcaaaggaagttcttggtatacggaaaaagtattcaacaataaattaggcatggttgcttccattttctgcctcacacacttttttttcgtggttaaagtgataaaacgtctatgatattttagattggcagttgcaaactagtggtcctcagcgggttttttatgacacctacaaggtttgaagactttgatttcatattaaaaatctgggtttcagtctgggtgtggtgctgcacttctgtaatcccagcactttgggaggctaaggtgggtggatcacctgaggtcaggagttcgagaccagcctggccaacatgatgaaactctgtctctactaaaaatacaaaaattagccaggcatggtggcatgtgcctgtaatcccagctactcaggaggctgaggcaggagaattgcttgaaccagggaggtggaggttgcagtgagccaagatcgcaccactgcactcaagcttaggcaatagagcaagactccatctcaaaaaatgaataaataaataaataaaatctgggtttcaggccagctgtggtggtgcactcctgcaatcccagcactttgggaggctgagatgggcagacagcttgaggtcaggaattccagactagcctgggcaacatggcgaaaccccatgtctacaaataatacaaaaaaattagctgggtgtagtggagtgtgcctgtaatctcagcaacttgggaggctgaagtgagaggattgcttgagcctgggaggttgaggttacagtgagccaagatcgcactcctacactccaacctgggcaacagagtcagaactactcttaaaaaaaaaaaaaaaaaaaaaaaaaaaaaaattctgggtttctggcatctcaaaaaaaaaaaaaaaaaggaaaggtcagggcagctacagtcctctattaagcaatgtgccacagcaggggtccctaattcctgggccatggacctgtactggtctgtggcctgttaggaactgggccacagagcaggaggtgaatggtgggtaacaactgaagcttcgtctgtatttctggccgctccccattgtttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattagcatcctgtgccccatcccttgccgcctgtggaaaaattgtcttccgcaaagccagtccctggtgccaaaaatgttggggactgctgtgctttagaatctgcctggaatctgcagcctctattatatagttccctatagactttgcttcctaccatcttacattctgccttataggcatttgtgtttgcaactcttgcttttgtcagtatgctacgctggtgacattgaccaaattgaccacacattaattataagcttagttggtgatgacctcaatggaataacatgacataagtattgtgacactacttcttgcatgtatctgcaggtggaattgtaaacctggtggtccgagatggtctaattcgatcttcctatgtatctccttatattaatagtggtaacatttgtggtggtgattcagcgtttcaatgcctcttctcatggcaacaacaaacgttttccgtctgaatcaacattaacctagatgttactgcggatcagaattagactctacattttcaaccacagaaatattgggcagtaaacatttttcttaatattgattgcctacataggttgtgtaattagcatatgtttatagttctatgatttgtgcatggctgctgcagagctggagggggtaaagcaacagtgttttctcagttgtgcgagcagcattacattataatgaataggtaatattaaactgggctgataagagttgcaaaagactactttaatgttcatatggaaccaaaaaagagcccgcattgccaagacaatcctaagcccaaagaacaaagctggaggcatcatgctacctgacttcaaactatactacaaggctacagtaaccaaaacagcatggtactggtaccaaaacagacatatagaccaatggaacagaacagagccctcagaaataataccacacatctacaactatctgatctttgacaaacctgacaaaaacaagaaatggggaaaggattccctatttaatagatggtgctgggaaaactggctagccatatgtagaaagctgaaactggatcccttccttacatcttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaactgacaaatgggatctaattaaactaaagagcttctgcacagcaaaagaaactaccatcagagtgaacaggcaacatacagaatgggagaaaactttcataatctacccatctgacaaagggctaatatccagaatctacaaagaacttaaacaaatttacaagaaaaaatcaaacaaccccatcaaaaagtgggcaaaggatatgaacagacacttctcaaaagaagacatttatgcagccaacagacacgtgaaaaaaatgctcatcatcactggccatcagagaaatgcaaatcaaaaccacaatgagataccatctcatgccagttagaatggcaatcattaaaaagtcaggaaacaacaggtgctggagaggatgtggagaaataggaacacttttacactgttgatgggactgtaaactagttcaaccattgtggaagacagtgtggcgattcctcaaggatctagaactagaaataccatttgacccagccatcctattgctgggtatatacccaaaggattataaatcatgccgctataaagacacatgcacacatatgtttattgcggcactattcacaatagcaaagacttggaaccaacccaaatgtccatcaatgatagactggattaagaaaacgtggcaattatacaccatggaatactacgcagccataaaaacggatgagttcatgtcctttgtaggaacatggatgaagctggaaaccatcattctgagcaaactatcatcaggacagaaaatcaaacaccgcatgttctcactcataggtgggaattgaacaaagagaacacctggacacagggcggggaacatcacaccctggggcctgtcatggggtgggggaagcggggagggatagcattaggagatatacctgatgtaaatgacgagttaatgggtgcagcacaccaacatggcacatgtatacatatgtaacaaacctgcacgttgtgcacatgtaccctagaacttaaagtgtaataaaaataaataaataaatagggctgatgaatcatattacagtaatccaatatttcccttgtaaagtccctgaggtttacagaaggaaatcttttctaataacaaaaagagtgaggcatgtgctttggtctttatttcctagttatacgatcctgggtaaggagctcaacttttctctgccaaaattaaatgaggattaaatgagatcatatatgtgaagttgtgaaagacagtacctggcacatagcaggatcaatcaatgttagtatctctaaaatagagattgagtctgaagatccacaaagtggtagaaccgatcttaagattcccaaataatagaattgtgctttatttgcctaagtagtatggtattacttattgtatgcccaggggatcttttttttttaaataatatttatttatttattttgagacagagtctcactctgtcccccaagctggagtgcagtggcaccattttggctcactgcaacctctacctacccagttcaagcaattctcctgcctcagcctccggagtagctgggattacaggtgcacaccaccatgcccggctgatttttgtatatttagtagagacagggttttgccatgttggccagattggtcttaaactcctgacctcaggtgatccagctccctcagcctgccacagtgctgggattacaggtgtaagccaccgcacccagacctaatgttttattttttggtagagatgaggtcttactatgtggcccaggctggtcttgaattcctggacctaagtgatcctcccaccttgacctcccaaattgttgggattacaggcatgagccaccgcgcccagttcccttcttaaatagttttaagggggagaagaaagaaaaagactgattttcttcccttccactaccaaaacaggcaaaacacaccagaacactttgcttagcatttcttttcttttctttttttgagaaagagtctccctctgtcagccagggtggagtgcagtggggcgatcttggctcacttcaagctccacctcctgggttcaggccattctcctgcctcagcctcccgagtagctgggactacaggtgcccgccaccacgcccggctaattttttgtatttttagtagagacgggatttcaccgtgttagccaggatggtctggatctcctgacctcgtgatccgcccgccttggcctcccaaagtgctggtattacaggcgtgagccaccgtgcctggccgtcccatcattttttaagataaattcacataccataaaacttaccattttattttctctctcttttctctttcttcctttctttctttcttttttttttttttttttgcaggctggagtgcagtggccctatcgtggctcactgcaaccttgaattcctgggctcaagagatcctcccacctcagcctcccgagtagcagtagctgagactatcagtgcgcaccaccaagcctgagtaattacaatacttttttctttttccttttcttgattttccgtagagatggggtcttcctattttgtccaggctgatctggaactcctgccctcaaaggatcctcctgtctaattctcccaaagtgctgggattacaggcatgtgccaccgcgcctggccaaatgcaccccctttttttaagtgtacaattcaatggtttttaatagattcacaaagtcatggaaccatcacacctatctaatttcaaaatgttttcatcactccaaaaaataaccccatatgggaggccgaggcgggcaggtcactcgagaccagcctggccaacatattgaaaccccgtctccactaaagatacaaaaattagtcgggcgtgatggcgcacgcgtgtagtcccagctgctcgggaggctgaggcaggagaatcgcttgaacccgggaggcggaggttgcagtgagcccagatcgccccactgcactccagcctgggcgacagagcgagactccgtctcaaaaatatctaattaattaataaaaataaaataaataaataaataaccccatgccttctgcctctgtggctttgcctgttctcggtattttgtgtcaatggacccatgcatgggggtgggccgggcacctttcaaacgttcagcccccaggacggcccgtggcctccggattggacggcgcgagctgggtgtgtgtgggtcgctcaatcgctccggagcttctggagggggcagatgcaggtgccggctgctgcagtgcagtagctgctggaggctggggaggcccggacccggtgcaggaagacgccgaccacgcgggctcctgatcgcgggcgcccacagcgcggacatggcgggctggtggccggcgttgtcgcgcgcggcccggcgccacccgtggcccaccaacgtgctgctttacggctcgctcgtctcggccggggacgcgctgcaacagcggctgcagggccgcgaggccaactggcgccagacgcggcgcgtggccacgttggtggtgaccttccacgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcggtgaggggccgggaggggacctggggggtgggacccagtattgggggactggaggctgggactcggggatcaagcggctggagggagggcgctgcaggagcctggggacccgggcaggagccggggctctgagaccggagctgcttcagaggcctgaagggccagggcaaaggctagaggctggggtgtttgattgcgaaaatttgcaggaggcactggctggggagccgagaaattggggagccagaggtccaccaggtcaggaatttagaggactagggtcggggctcagactctggggttgggtgtagaccaaggctggaggtaggcagggctgcggaggtctttgccccctgaaaaaggcccacgggaaaataaaggagatcccagttcaaggccgtagcagctgcaatgaccgtgaaccagtcgtgggacagggaaggaaccgacctgctgttcagaaaatccacgcctggggccccggggccaacacaggaacaaaatgcaaggggatcagtgaccctgaggggcagagcaggtggaatctgaggttgggcctggatcttcagcaaattcatgcccaggggcctagtcctggtttggtaacaagattttcccctggggtctcacggaaaacatcaagggaccttggatccttgccatggaggactatatacctgtgagggttcagggaaccctctccttagaaaatccgacccgggcctggggtgtgggggacaggggcttgactgtggaaaccttctctactgcatacaataagaacaatggaaatggtacctgaaaaataccggggttcattcccttaacgagtcacaaaggactccaccaagaggcggattttgatcaatgggagttttacttggcacaagaaaggaagacactgggcgtattctcccaagtagtgtgtcccccagagaaagagacaggagggttttataaggtgatggagaaaggagagggtgcatgactgcatgtagagtaggggtcccagtgagtcatgatgctagcacataggctgcataggttgcataggttatagtcgtgaagctatagcttctcccggggtgaagactttagcatggtaatgaggagagttaacttgggttcatctacaagtaacctggggtcacttaggagctgatttaaacaaacagggtgacctcattccgcccagggttggggaagaacaggttgaggtcaggaggctgtaaaacaggctgatcgctcaagttggttaaattcttgtcatctttggagatcccccgtctgctcacaggaggggccctgtggcctctagcatcattgcgatttctagagccttgaaggggatggggtgggtaactggggagaaaatctctacgggtctcaagcctgaccttgggattggggatcacagatctccccccaaatgggagggaacttctcctaagggctgttggtgctttctaaaccaggttgaagtcagacaagccaccatcttgaagaaacctaccctgccccgtgtgccttatttttaagagttggattcacttcctttccctacagaccccaccagaaacacaaaccacctggttgcctgttgtcattgcggccaactacatggctgacggggtcagtgggtcaggagagcaggcagcctgagagctagggcctcctgttttatcagaaggtctgtgcctgtgcccggtgtgtgatttgcagactagatttgcaaacagcttcctagcacctgttacaggaacctggtacactggtgaaggggtaggggaccagaatgctatttaatcctcaaacaactagtgagattgttctctttttcttcttttttttttgagacagagtctcgctttattgcccagcctggagtgtgcagtggcccagtctcagctcactgaaacctgcatctccaggttcaagcaattctcctgcctcagcctaccaagtagctgggattacagatgcacaccaccatgcccacctaatttttgcatttttaatggagatggggtttcaccatgttggccaggctggtctcgaactcctgacctcaagtgatctgcccatttggcctcccaaagtgctgggattacaggcgtgagccctcacacttgagattgttcttaatactctcatattacaaatgaggaaactgagtctcaaaggggttctgtgactcacccaaagacaacacaatccaggcacttgatgctctcatggtgggaagtttgacagtttgcctgaaactgaaagatgctgagttactaacaagacttgaacctaagtccaggccaagctctctgatacagattcctggccagattgcagctttgctttggtcttcagtttttcttttctttctttctttttttttttttttgaaacggagtcttgctcttgttgcccaggctggagtgcaatgacacaatctcagctcactgcaacctcagcctcccaggttcaagcgattctcctgcctctcctgcccctcctgagtagctgggattacaggtgcccgccaccacgcctggctaatttttgtgtttttagtagagacggggtttcgccaagttggccaggctggtctcgaactcctgacctcaagtgacttgcccacctcggtctcccaaagtgctgggattacaggtgtgagccacctcacctggccggttttcagtttttctggttcagtttcccttacctcacatttcaatgaaaggggaagtggaaggggatagagtggaggtttgcgtaaggctttacatggaaattgcaggaatcaattgatctttgtgctggggctaccttggggaaccagagtcgtaacagattaacaactctggcttgggaatcagacacctgggttgaactctgtccgctattaacctctctaagctcttttcctcctttgtaactctacccaccttagcgaattgtaaggaggggcacatgaaatgaggcacgtaaactacatagcatttaattaatgctgggtaagtggaacacagtattaccaatattttgctgggtcatgtaagaatcgtctgtaattaactaataaagctcttatattccctccctcctaatcagggattggaaagaatttttaaagtactctcagttttacaaccttcctaaaataggagagctttgccttgctacctgaatttattgttacttttttccttttctttttctgagacagggtctcactctattccccaggctgaagtgcagtgatgtgatcacagctcattgcagcctcgacctcctgggctcaagcgatcctcccacctctgcctctggagtagctgggactacaggcacgcacccctatacctggctggtttttaaatagttttgtagagacaaggtcttgatatattgcccaggctgtgaatttctcttcagggatattgaagatcaaagtgtttttaggaagggtgaattggtgttccactttcaaattttgaatagggtaatactgatggaaaatttgtagtcgccagagtatttgggtccactggcctttttttatttttatttttttgagatagagtcttgctctgtcacccagtcaggagcacagtggtgcagtctcggctcacctcaacctccaaatcctgggttgtgtagtggtacaatcttggctcaccgcaacctccacttcctgggttcaagcgatccttctgcctcagcctctcaagaacctggaattacaggcatatgccaccatgcctggctaattttgtatttttagtagagacggggtttctccatgttggtcaggctggtcttgaactcccaacctcaggtgatctgccagatcagcctcccaaagtgctgggattacaggcatgagccacgcgcccagcccactagcttttttaaaaagacagaaattaaaatttcaaaatgttcaaatgttcaacatttcacaaaatgtttggaaggtagagaaagtaaccaatagacccactattgtaacctgattgtttttgtgaattgttagtttttgaaaaaataatcgttctgctataatttttatactctgctattctcacttcgtatttatcattcctttaaaatttatctagttttagagtggagattatgttttcttttttttttttttttttgtttgagacagggtcttgctgtgttgcccaggctggagtgcagtggcatgatcacagctcactgcagcctccacctcccaggctcaagcgatcctcccacctcagcctcctgagtagctatgactacaggcacgctactacacctggctaatttttgtattttttgtagagatgaggttttgccctgttgcccaggctggtctcttaactcctggactcaagcaatctgcctgcctcggcctcccgttacaggcttgagccacggcgcctgtctatgttctcttttcactgttgggtcagagggtcatattgttggatgatagtgatggttactttgcattttggaatgggaaacttaaacatgaactgttatacggtactctactgaatcttttaaaattttttttgggttttgcaaataggtatgagcattctccaaggaaaggatgacatatttttggacctgaaacagaaattctggaatacctatctggtaagataggcgtttgaaaatgtaatcactatatttttgtgtatatatgtatatatatgtgtataaaaatatatgttttgtgtttatatttataaagattaaaaaatcttttaattgacacatataagtacatattttcatatacatgtgataatttgacacgtgtttaatcacatcaggatttttttgtatgtgtgtgtgtatatatatatatatatatatatatatatttttttttttttttttttttttttaattaaaaaaacctttttcgagacagggtctcattctggcacccaggctggaatgcagtggcatggtcatggctcactgcagcctggacctcctgagctcaagcgatcctcccacctcagcctcctgagtagctgagactacaggcatgtgccaccacacccagctaattatttttaaattttttggtagagacagagtctcactatgtagcacaggctggccttgaactcctgtgctccagtgattctcccacctcaacattaagtacatttttattaaactattcctaaattagagctccagtttggttgacagaagggtccaatattttgacatagaaatcttaaagttattttgatagatgtatgaggagaggttttaagagtatctgtacttctcatgaactggaaagaaataatgtctctgggcccggtgcagtggctcatgcctgtaatcccaacacttgggaggctgaggcaggcggatcacttgacgttaggagtttgaaaccagcctggccaatatggtgaaaccctgtttctactaaaaatacaaaaaatagtcaggcacggtggtgcatgtctgtaatcccagctactcagtaggccgaggcaggagaatcacttgaacctggagacaggttgcagtgagccgagatcgcaccactgcactccagcctgggcaatacagcaagactccatctcaaaaaagagaaaaaagaagaaaagaaaagaaataatatctctgaattttagtccatgttctcagtgatttctgactttattatattaactcttagtaatgatcacaatttactttgtaaattttgcagccaaagggacaacaatttattctgtaaatttgggattctatttgcaaaatagagattatagattgtgagtggcttaatggaatcattcccacattcagagccaatgttttcaggtgagcatcctgcggagtcctggtgaaaagaactttaacatcacaaaggtattgatagagaaggagaaggtttccaagggttattccaaggtttgaagcaaatcagcatttttactgtttgctcggcacaaatatatacagtccagtccaatacatatttattcattgattcagttaatatttattgaacagtgtccttaaggcctggcaaaatcagggatggttttcatctctgccctagagcatgtttgattgcattcatcacaaggaggtaaatctttgggattacagaatgttcgcagactggcctagggcttcacatgttcttccttccctatcaaaagcagtgttgagccacacccagctattacctccacagcttctagcatcatctgttggatggtaccaggcccctgagccagcattacttgatggctagaggcagaggatggagaggtttgaagtcagaggcttcccctgagcctctatactcaggaacagtaactataagtgtgttcagaactcttgtgatttctcttagggcagaaattgaggaccccatggtgacaaccaaatgtgattttcttctggttttgttttttgtttgtgtgttttggtttttttgtttgtttgtttgttttttgagacggagtcttgctccgtagcctaggctggagtgcagtggcactctgcaacctttgcctcccgggttcaagcaattctcaattctcctgcctcagcctcctgagtagctggaattacagacttgcaccaccacatccagctaattttttgtatttttcagtagagatagggtttcaccatgttggccaggttggtcttgaactcctgacctcaggtgatccgcctccctcagcctcccaaagttctgggattacaggcatgaatcaccatacccagccacttcttctgttttactttagaaaaaggaacaagtttttccattatgttgtaaagtctatggagatatgtacatctaacttttttttttttttttttaaagagcaaggaccggaggcagtagctcatgcctgtgatcccaacactttgggaggtggaggcgggtagatcacaaggtcaggagatcgagaccatcctggctaacatggtgaaaccgtgtctccactaaaaatacaacaaattagcagggcatggtggcacaagcctgtagtcccagctacttgggaggctgaggcaggagaatcacttgaacccgggaggcagagactgtagtgagctgagattgcgccactgcactccagcctgggcgacagagcgagactccgtctcaaaaaaaaaaaaaaaaaaaagagcaagaagtaggcagctcacacctgtaatcccagcactttgggaggctaaggcaggaggatcactagagcccaggagtttgagaccagcctgcgcaaccatagtgagaccccatcgctacaaaaataaaataaattagctgggcatagttgcaagtgtctgtggtcccagctgctcgggaggctgagatgggaggattgcaagcctgggaggtcgaggctgcagtaagctgtgattgcaccgctgcacaccagcctgagtgacagagtgagaccatggttcaaaaaaaaaaaaaaagagagcaggaagtagaattgggaaagaagcttcaggcagggatttgtaaatgaacaaaaccacaggaacatttgcatactgtttaaaaaaaaaaactggttacaatgagtgagtctcatctaccctcaggagaagaaagagggcaaaccagtagtctgaagcccagcccatctggagattttttgggaagatttcctttaaagaggcaggatggctcacgcctgtaatcacagcactttggtaggccaaggcaggcggatcatgaggtcaagggatcgagcccatcctcgccaacttgatgaaatcccctctctactaaaaatacaaaaattagcatgagcccaggaggtcgagactgcagtaagctacgattgtgccactgcactccagcctgggtaacacagtgagaccctgtctcaaaataaaaaaataaaataaaataaagatctgaagttatgcacatactgggggacaggtcattccaggggcagaagagctgagtacagttgacaatgcgtaaagcaccatggtatgcctggaggggagaaaccacaggcagtttggtgttcacagagtatttgttgagcaacttggaatgagtttggatcctggagactgttgaacacccagagctgaggatcttgaacttcacagttaggtaatggcagcaaaggaaaccaaagtgggtggttatcgtgaccaagttcacataagaaataaggaagcatatcaggtgtggtggctcacgcctgtaatcctaacactttgggaggctgaagcaggaggatcccttgaagttaggagttcaagaccagcttgggcaacatagcaagaccctgtctgtatttaaaaaaataaacatggtggctcacgcctgtaatctcaccactttgggaggccaaggcgagcagatcatatgaggtcaggagttcgagaccagcctgaccaacatggtgaaaccctgtctctactaaaaatacaaaaaattagccaggtatggtggtgagtgcctgtaatcccagctactcgggaggctgaggcaggagaatcacttgaacccgggagacggagattgtagtgagctgagattgcaccactgcactccagcctgggtgacagagcaagactccatctcaaaacaaacaaacaaacaaaaaagaaatgaggtgagttcagcttgggaaatgttgaatgtcagatgcctttggcctattcagagggagattgccgaagcacagaggagagttcatggcagggtttaattatttttagcgctcacatgtcccagattcggccagtgggagttcccccaagctggttcctgtgtcctgtgcatcacccatcttctttctcctttacttctttcttaagccacttcctttctggcatgacagcgtgttccaggatcatcttgtacttgcacctgccctgccctggccctagaatcagccaattctttgaggcatcctgcttccttttagtgggggaatgatttgagaacaaaatatactactacatgatactacattctgacaagaaaaaaaacacagccataagaaataaagccatggccaggcacagtggctcctgtaatcctaaccctttgggtggcggaggttggaggattgtttggggtcaggaattcaagaccaacctggcccgcatagtgaggcctcgtctgtattaagaaaaaaaaaaaaaagaaagaaggaaagccatgtttggataagtttagtcttctgattatttttgctaaagttttaattttttttttttttttgagacagagtctcgttctgttgcccaggctggagtgcaatggtgcagtctcagctcactgcaacctctgcctcccgaattcaagcgactctcctgcctcagcctcttgagtagctgagattacaggttcctgcaatcacgtcctgctaatttttatttttagtagacacagggtttctacatgttggtcaggctggtctcaaactcacgacttcaggtgatctgcctgccttggcctcccaaagtgcagggattacaggggtatattttatatttaaagcatatttaacaattaagggccaggctcggtgtctcacgcctgtaatcccagcactttgggaggctgaggtgggcagatcacctgagctcgggaatttgagatgcacaacaagagcgaaactccgtctcaaaaaaaataaataaatataaaatatacattatggccgggcatggtggctcacgcctgtaatcccagcacgttgggaggccaaggcgggcagatcacctgaggtcaggagttcgagaccagcctggccaatatcatgaaaccttgtctctactaaaaatacaaaatttagccaggcatggtcgtgtgcacctgtaatcccagctactcggaggctgaggcaggagaatcacttgaacccaggaggtggaggttgcagtgagccaagatcgcaccattgcactccagcctgggcaacaagagcaaaactccatctcaaaaaatatatatatatacatacacatatacgtatatatgtgtatatatacgtatatatgtatatgtatacacacattatatgtaatatctacttttaaatataaacataaatattataaagcttttattgcaattgttcattttagaaacttcagaaaatacaaattagtaaaaagaagaaaataagtctgtaataccacttttaaggactattttgaaaacctctagctgttttttgagataaatttacataccaagacttttttttaaaaaatcataatgatgactttttcataggactgtgtaggataaagcttgtgaaatgtctatctaacatattttgtaatatatgaaaatttcagctaaacttgttctatagcatcacatggtttcaatatattattagaaaatcattccataaacaatggtttggtatatagtttcaacaattcaaggctgggcacagtggctcatgcctgtaatcctaccactttgggaggccgaggcaggcaaatcacctgaggtcaggagttcaagaccagcctggccaacatggtaaaaccctgtctctactaaaaatacaaaaattagccgagcatggtgtcaggcacctgtgatcccagctactcaggaagctgaggcaggagaactgcttgaacctaggaggcagatgttgcagtgagccaagatcttgccactgcactccagactaagcgacagaatgagattccatctcaaacaaaataaataaataaaataattcagcaggatgaggtggctcatgcctataaccccagcactttgggaggctgcagtgggactactgcttttgcctgggagttcaagaccagcctgggcaacatagagataccatgtctcagaaaaaaaaaaattaatttaaaaaaaaagaattcattgatgattctgtatttacaaatatattcctgcatcatttgttcatggtaaccaggaaattgcaatgcatatatacatgctgtcatttccaaagccgctgtcttccagaattggtactgattctagtagacttttcattctggtgttaaaaatataattaatataggaatgtcttctacctaatagcttttttccccacaactccccaaccccctcactctagaggccttaagtagtctaagttaatcagcttagtctgaaatataatactacctaggcatcttgttggcctagtatttcttactcttttatggaatgaactgtgcaattgttttgtgtggttaaaaggtattctaggtcaggtatagtggctcacacctgtaatcccagcactttgggatgccgaggtggtggatcacctgaggtcgggagttcgagaccagcctggccaacatggtgaaaacccgtctctactaaaaatacaaaaattagccaggtgaggtggtgtgtgcctgtaatcgcagatactcaggaggcagagacacgacaattgcttgaacccaggaggcagaggttgcggtgagctaagattgcaccactgcactccagtctgggcaacagagtgagaccctgtctcaaaaaataaaaaacaaaataaataaataaaaaataaaaggcaatctaataaagttgttgctttttttttttcccaattccagagtggactgatgtactggccctttgtacaggtaagttccacctactcagtaatatgaactcagggctttggtttccatgtggccctaacggactctctctctgttccagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtcaaggactctcttaaagggaccacattttttacctaaaatgcacagaattgcctgcagacaaaatatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaaatctcaggttatctcctgaacacttttgggcagatgaagttttataccaaaaaatagttcttagagtgaattttaatttacatagaactcaatcgaaatgaagatttaataaccagatttctttctccaaaacatacacaatttgttattttagtaaatacctttttttttttttttttttttgtggtggagtcttgctgtctccccggctggagcgcagtggcacgatcgcggctcactgcagcctccatcctctgggttcaagcaattctcctgcctcaggctcctgagtagctgggattacaggcacgtgacaccaggcccagctgatttttgtatttttgttcatttgcttttgtttttgacacagagtctcgctctgtcgcccaggctggaatgcagttgtgagatctcggctcactgcaagctccgcctcccgggttcacgccattctgcgtcagcctcccaagtagctgggactacaggcacctgccacgatgcctagctaattttttgtatttttagtagagatgaagtttcaccgtgttggccaggatggtcttgatctcctgaccgcataatccacccacctcggcctcccaaagtgctgggattacaggcgtgagccaccacaaccgacttttttttttttttttttttgagacagagactcgctctgtcacccaggctggagtgcagtggcatgatttcggctcactgcaacctctgtctcctgggttcaaacgatcctactgcctcatccttcggagtagctgggattacaggcaggtgccaccatgcctggctcatttttgtatttttagtagagagggcgttttgccatgttggctaggctggtctctgtccgtcctctgagctcaagctaagccatcatatcccagtgacctgcacatatacatccagatggcctgaagttactgaagatccacagaagtgaaaatagccttaactgatgacattgcaccattgtgatatgttactgccccaccctaactgatcaatgtactttgtaatcctcccacccttaagaaggttctttttaattctccccacccttgagaatgtactttgtgagatccacccctgcccgcaaaacattgctccaaactccaccacctatccccaaacctgtaagaactaatgataatccaccaccctttgctgactccttttttggactcagcccgcctgcactcaggtgaaataaacagccatgttgctcatacaaagcctgtttggtggcctcttcacacggacacgtgagacagtctccaactcctggcctcaactgatccactctcattggcctcccaaggtgctgggattataggcatgagccaccgcacctggctcagtaagtacattttttattatcaaaaacagagtagtgtatgattggcgtattctgtgtagaatgtattttattgatgtcttctatttttataatttttaatgaatgctttttagttttgggcagattcagttgactaaagcacctcatttcccagatacatgaaataaaatacttggtttcttttccaatttcacactgatgttattttgtgaaaatcagtgctttaagataaatatttatactttaaggtaaacatgagaaacttgatctaatatttaatatttattcagttctacactttattaacttctacaccagcagatttaaaaattatgtaactatctcaagaagtttcacttggacgtagtggttcacgcttgtaatcccagcactttgggaggctgaggtgggaggattgcttaaggcaaggagtttgagaccagcctgggcaatacagcaagatcccatctctattttaaagaaaagtttcactttgggaggccaaggcggttggatcacaaggtcaggagatcgagaccatcctggctaacatggtaaaaccccatctctactaaaaatacaaaaaattagccaggcgtggtggtgggcgcctgtagtcccagctactcgggaggctgaggcagacgaatggcatgaacccgggaggcagagattgcagtgagctgagattgtgccactgcactccagcctgggtgacagagtgagactccgtctcaaaaaaaaaaagtttcagtaaattccacctaagaattccaccagagttctgtcatctccaatgtcatgttccacagatttcaagttgtgaagccctgaactgttaatttatcctgagaatgtatatttaagcttaatttaagactatatacctaaaaattgagcatataatttgtataatttgtttatgtaagtttctgtaagtcataaatatgtagtttccaagtggataatttacctgaatgtaaaaggcattaatatattttacattattgggaccatagtacagaaatttctaaatggtttgtaaaataacttgttatttgctttgttgtaaaagtagttaatacaatggaaaaatggtttcgtaataagaagatacattttaacatcaaaacgtaggccgggcacagtggcttacgcctgtaatcccagcactttgggaggccgaggcgggcagatcacgaggtcaggagatcgagaccatcctggctaacatggtgaaacgccatctctactaaaaatacaaaaaattagctgggcatggtggcgggcgcctgtagtcccagctgctctggaggctgaggcaggagaattgcatgaacccgggaggcggagcttgcagtgagcagagatcaggccactgcactccagcctaggcgacagagcgagaatctgtctcaaaacaaacaaacaaacaaaaaactgtacccaagttaattataagtactacctggtgcaaaactttacagaagctgtggtatcacttttatgatagaagaatagtgtttgcattttgtataaaagtacttggggctgggcatgatcgcttatgtctataatccaagtgctttgggaggcgaaggcaggtggatcatctgagcccaggagtttgagaccagcctaggcaacatggcaagagcctgtctctccaaaacctacaaaaattagccaagcatggtggtgtgagcctgtagtcccagctacttggaagactcatgcaggaggatctctcgagctcaggaggcagaagatgaataaataaatggatgcaactgaatgagatgaggtctctcttgaaggagagagcaaaagagatttaaataataacaattataagaaggctgggcgcggtggctcatgcttgtaatcccagcactttgggaggccaaggcaggtggatcggttgaggtcaggagttcaagaccagcatggccaacacagtgaaaccccgtctctattaaaaatacaaaattaaccggacatggtagtgcgtcctgtagtctcagctactcaggtggctgagacaggagaatcgcttgaacctgggaggcataggttgtagtgagccgataaatataaaaagtattaaagtactaacagaagaaaatttccactgatcaccctttagctttaaataatgcagaagcatatgcccagtttacttgtaattaaaaatcatgcatcattcacaatttatcagtcttttttgtttgtacaaaaactaatataagttattctcttttatttgtattgtgattggtttgatgagagggaattaggccacttgagagtttgtgcgtgtttataattttctggctgggcccggtggctcatgcctgtaatcccagcactttgggaggccaaggcgggcggatcacttgagctcaggagtttgagaccaacttgggcaatgtggtgaaaccctatccctaccaaaaatacaaaaattagccgggtgtggtggcttgcacctgtcctcccagctacttgggggtgctgaggcaggaggatcactcaagcccaggaggtggaggttgcagtgagccgagatcacgccactgcactccaggaagggcaacagagcaagactgtgtctataaaaaaaaaaaaaaagaaagaaaagtaaattaactttggtatttcaggttgtatttatatggggacttcacatcaactatgttcactacaattgaccaagttaagtgtagacagtctctttaatagagagattatctggaactgcaattttttttttttttttgagacagagtttcgctttgtagcccaggttggagtgcagtgtcgcgatctcgcctcactgcaacctctgtctcccgggttcacgccattctcctgcctcagcccaagtagcagggactaaaggcgcccgccaccatgacccactaattttttttttttttggatttttagtagagtcggggtttcactgtgttagccaggatggtctcaacctcctgacctcgtgatctgcctgcctctgcctcccagagtgctgggattacaggtgtgagccaccgcgcccggcctggaactgcaatttctaactcatacatcattgctataaaccttatttgtttactgtttctcttccaaggacggtcagtcatcctttaaaattcatttgaagttatgaaaagatagtttttgttacatgggaaatttacttttagtacagtaaaatgttatgtgaatttctacagaatgtttgctagaatgaattatatctaggatatgcttaacaatatattctggaggcagctttcatttgaaattaggttcatcttctgagagtattaaaaagttaatgggtttttgtgcctgaagattttgatgttgcatttggctacatttaatccactttcacccataaggtttagcatctaaaaaaattaaatcactgctaatgcaattaaaatgactgaaaaagtttcttttaatactttcaacagctgatacataaaaagggaaatctggaatttgaagataaagtatgtgctggagttgaaaggttaggaacacatgaagatctgtgaactgtagctaaccttgtgaatagaaggcagtaattactgagtaacatttttggtatatatcaagtaaaagcttgtcttttcctagttctcttctcctttgttaagtgtatccttctctaactacatctttattcatccttttcttccttcctctttctttgtccacaacccaaccaaacccactgctctctcctctcaccccctgcccgtgccatgaccacttgaacattccaggagggcagaataattgtaataaggctaagggcttattacacttcttacacttaaggactcaacagccttgctttagagaggatggtagcggaggatcctctctggtctctgtgagaagaaaagagaaaggaccatcctacggagaatttatttttatttttatcttttttgagatggagtctcactctgttgctcaagctgcagtgcaatggcatgatcttggctcactgcaacctccgcctcccaggttcaagcgattctcctgcctcagcctcccgagtagctgggactacaggcatgtgccagcatacccagcgaatttttgtatttttagtagagatgggatttcaccatgttgcccagactggtcttgaactcctgacctcaagtgatctgcctatctgtctatgatattttaggttggcagttgcaaactaatggtccacagcgtgctttttatgacacctagaaggtttgaagactttgatttcatagtaaaaatctgggtttcaggctgggtgcggtggtgcatgcctgtaatcctagcactttgggaggctgaggcaggtggatcacctgaggtcaggagttcgagaccagcctggccaacatggtgaaactgtctctactaaaaatacaaaaattagccaggcgtggtggcatgtgcctgtaatcccagctactcgggaggctgaggtgggagaattgcttgaaccagggaggtggaggttgcagtgagccaagattgcgccactgcactcaagccttggcaacagagcgagactccatctcaaaaataaataaataaacaaataaataaatatataaaatctgggtttcaggccaggtgtggtggtgcactcctgcaatcccagcactttgggaggcggagatgggcagacagcttgagcttaggaattccagaccagcctgggcaacatggcaaaacgccatctctacaaataacacaaaaacattagctgggtgtggtagagtgcgcctgtaatcccagctacttgggaggctgaggcgagaggattgcttgaggctgggaggttgagccacgatcacactcacacacttcaacctgggcaacagagccagactgtctcaaaaaagaaaaagaaaagaaaaaagaaaagaaaaaaggaaacgtctgggcacatgcctgctacagtcctctatgaagcaatgtgccgcagcaggggtccctaatccctgggccatggacctgtactggtctgtggcctgttaggaactgggccacagagcaggaggtgaatagtgggtggacaattgaagcttcatctgtatttctggccgctccccattgcttgcattgctgcctgagttctgcctcctcttagatcagcagcatcattagattctcataggagcataaaccctgttgtgaattgcacacacaagggatccaggttgcatattccttatgagaatctaattcctgatgatttgtggtggaacagtttcatcccaagaccattaccatcctgcgctccatcccttgctgcctgtggaaaaattgtcttccacaaagccagtccctggtgccaaaaatgttggggactgctgtgctttagaatgtgccttgaatctgcagcctctattgtatagttccctatagactttgcttcctaccatcttacattctgccttataggcatttgtgtttgcaactcttgtttttgttagtatgctacgctggtgacattgaccaaattgaccacacattaattataagcttagttggtgatgacctcaatggaataacgtgacataagtactgtgacaatacttcttgcatgtatctgctggtagaattgtaaacctggtggtccgagatggtctaattcgatcttcctatgtatctacttatattaatagtggtagcatttgaggtggtgattcagagtttcaatgcctcttctcatggcaacaacaaatgttttccttctgaatcagcattaacctagatgttactgcagatcaaaattagactgtacattttcaaccacagaaatattgggcagtaaacatttttcttaatattgattgcctacataggttatgtaattagcatatgtttatagttttgtgatttatgtgtggctgctactgagccagagggggtaaagcaacagcgttttctcagttgtgtgagcagcattacgttataatgaataggtaatattaaattgggctgatgaatcatattacagtaatccaatatttcacttgtaaagtccctgaggtttacagaaggaaattttttctaataacaagaagagtgaggcatgtgctttggtctttatttcctagttatacgatcctgggtaaggagctcaacctttctctgccaaaattaaatgaggattaaatgagatcatatatgtgaaggtgtgaaggacagtgcctggcacatagtgggatcaatcaatgttagtatctctaaaatagagattgagtctgaaggttcataaagtggtagaacagatcttaagattcccaaatgatagaattgttatttatttgcctaagtagtagtagattacttattgtatgtccaggggatccttttttttttttttaataatttttatttctttaagacagagtctcactctgtcccccaagctgaatgcagtggcaccattttggctcactgcaacctctatctccctggttcaagcaattctcctgcctcagcctcctgagtagctgggattacaggtgtgcaccaccatgcccggataatttttgtagttttagtagaggcaggattttgccacgctggccaggctggtcttaaactcctgacctcaggtgatccagctgcctcagcctcccaaagttctgggattgcaggcatgagccactgggcctggcctttttttttttttttgtgaggcaggatctcactctgttgcccaagctggagtgcagtggcactaccatgcctcactgaagctttgaactcactggctaaaaagattctcccacctcagcctcctgagtagctccatgggtatgcaccaccacaccccattattttattttttgagaaggagtctcactctgtcacccaggctggagtgcagtggcatgttcttgactcactgcaacctccacctcccaggttcaagcaattctcctgcctcagcctcctgagtagctgggattataggcgcatgctatcttgcctggctaatttttttgtatttttgtattttttaactagagacagggcttcaccatgttagccaggatggtctcgatctcctgaccttgtgatctgcccacctcggcctccaaaagtgctgggattacaggtgtgagccaccgtgcccagccctggtattttttttttttttttttgtagagatgaggtcttactatgtggcccaggctggtcttacattcctggactccgaccttgacctcccgaagcgttgggattacaagcatgagccacctcgcccagttcccttcttaaatagttttaagggggagaagaaagaaaaagactgattttcttcccttccactaccaagacaggcaaaacacaccagaacactttgcttagcatttcttttctaaagtgaccaaaatttataatagacacttaaaatgtgtactggaatatatcccaattatatccccagtctataactcagctatatgcagctcctttgtcttattaatgctatgaatcagcaatagtttatgttttcatatcacctgaggccatgcaatcctcttttttggttgttgaaataatttctataactatttcacaatttcaattgccaacattaattcaacagtatttaagctgtctgtcccagacactatgctagcctttggagatttccaaggtgaataaggtgaggacccggctatttgcctacggtctagcagacagacctttttttttaattttttgagactgagtctcgctctgtcacccaggctggagtgcagtggtgcgatctcagcttactgcgagctccgcctccccagttcacgccattctcctgcctcagcctaccgagtagctgggactacaggcgcccaccaccacacctggctaattttttgtatttttagtagagacacggtttcactgtgttggccaggatggtctagatctcctgacctcgtgatccgcccgccttggcctctcaaagtgctgggattacaggcatgagccactgcgcttggccaccttttttattttttatttttatttttttgataggagtctccctctgtctcccagcctagagtgcagtggcacgatcgtggctcactgcaacctctgcctccagggttcaagtgattctcctgcttcagcctcctgagtagctgcaacttacaggtgtgtgtcaccacacccagataatttttgtatttttagtagagacagggtttcgccacgttgtcaggctggtctcgaaatcctgacctcaggtgatctacccgcctcagcctcccaaagtgctgggattacaggcatgagccaccgcacctggccagcagacagacttctaagcaaattacagctaccactttttgtatgctcactaactgtagataagggtctatgccaagccctttacatcatgtggtaattgatatggtgtagttgagtggtttctaccatcgatttccttacctcccccacttcccaacagctcccagttcctttttggggatcttcccagaagatgactttacttggctcaagaggtggagcacatgacagattaagccaatcagggcgtttcatgccccttgctacagggttcagagacaatcatgttatctgcagctgcccaattagagtgaatctcataacctttgatggaaaaccaggacaaaggcatattctctcattgtgtcatagagatgttaatatagatgtaaggcctaggactaccatagccattttttgttaccgtgaaagacatggaggcaagagggtatcactgaaagaatctcagagaaaccctgatgatttcataacctctgatatagcctatgcccaaagcctgctctgggcttttctgttataggagctaggagattccctttatttttcaaaccactgggaattaggttttctgttacttgaaggaaagcatcataaaggatacacaggaccttttttataacacagtagatattattctcattttatttttgtgtgttttgttttgttttgttttttaagacagagtctcgccatctcagctcactgcaacctccacctcctgggttcaagcgattctcgtgcctcagcctcttgagtagctgggactataggagcgcaccgccatgctgagctaatttttgtatttttagtagagacagggttttgtcacgttggccaggctggtctcgaacccctggcctcaatggatccacccaccttggcctcccaaagtgctgggattataagtgtaagccaccacactcagctgattcatttattttcatttttttttgccatacaaaccaacaacttgcaaactcccattataaacatttccagaaatttatggggtacaggtgcaattttgttgcatgcatagatttcatactggagaagtcagagcttttaggctgtccatcacctaaatgacgtgtattgtactgaataagtaacttctcatcatccacccacctcccacaccctaacccttctcaatctccatcatctatcattccacactctacatttctgtgtacacattctttagcttccacttatgagtgagaacatgcaatatttgtctttctgtgtctggctggtttaagataatggcttccagttctgtccatattgctgcaaaggacatggtttcattcttttaatggttgaatagtattctattgcgtatatgtatcacattttctttttttttttttttttttgagacggagtctcgctctgtcgcccaggcggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcccggcccacattttctttatccactcatctgaagatggacacttagattgagtccacatctttgctatagtgcattcactctcattgttatagttgagaaaacaaaggtccttgccctttgccactaagccaatacatggcagagtcaggttgatttccaaacccacactcttatgatcatgcttctagtaactccagtgcagtttaagaggtatatcaaagatacagtagtgacagccaggcatagtggcaggcacctgtaatcccagctacttgggagacaggagaatcacttgcaccggggaggtggaggttgcagtgaaccaagatggtgccactgcactccagcctggtcaacgtagcgagactccatctcaaaataaataaacaactaaataaataaaagggatacaatagtgacataaaggaatgatcagctcattgtgtgtgtgtgtgtgtgtctggtggccatggagatattccagggcaccagacatggacaaaagtatgaagtgaagggctcatggtatatgctaaataaatgtttctattttattttcctttgcgcttctgagaaatttgctgtgctagggaatcttagtgggaggttccaaatgtctctaatgggtccttaaaagtaacacaggggactgagagttactttcaaaaagctagtattttaaaacaggttgtgcagatgaattcagacttttgtttgtttgtttgagacagtgtctcattctgttgctcaggctggagtgaggcagtacaattatagttcactgtagtcttgacctgctaggctcaagcaatcctcctacctcagtctctggagtagctgggactacaggcctccacacctgcataatttttttttttttttttttttttttttgtagagacagagtttcaccatatagcccaggctggtcttgaactcctggcctcaggcagtcctcctgcctcggcctctgaaagcattgggattacaggcatgagccactgtgcctggcccagacaggcccagacttctttaccatggatgagatctttgtcaactcagtgtggccatctcacgctgctttgtcaacaagttctttttttttttttttttttttttttttttaatgagacagggtcttactctgttaccaaggctgcagtgcagtggttcaatctcggctcactgcaacccctgcctcctgggttcaggcaattctcctgcctccgcctcctgagtagctgggattatgggtgcccactaccacacccggtggtacataataataatttttctatttttagtagagacagggttttgccatgttggccaggatggtctcgaactcctggcctcaagtgatccgccctacgtggccatccaaagtgctggaattacaagtgtgagccaccgcgcctggccacattctatcatttttatattggtttagtccatcctgtctttgattccactgccattgcttatttcagatcattgctgtttctcatggagacccttgatactcagagtgtggtccatggatcagagtctcaacatcacctgggaacatctaggaatcttagatacccacctcagactctctggattagaatgtgcattttaacacactgaaatttgacaagcactaataaattttttcactagagtcttccaatgatctcccgactctagtttggttttgttttttcagagatagggtctctctctctctctctctctctctctctctcacccagttgagagtgcagtggtgcactccatagctcactacagccttcagctcctgagctcaagtgatcctcttgcctcagccttctgaatagctaggattacacatgcatgccattacatgcagctacgtttctactttttgtagagacagggtctcactatgttttccaggctggtctcgaactcctggcctcaagagatcattccaccttggcctcccaaagtgctgagattagaggcatgaaccactgcgctgggcccctgcctctagtttttttgtttgtttgtttgttttgagacagagtctcactctatcacaaagtctagagtgcagtggcgcaatcttggctcactgcaaactctgcctccagggttcaagcaattctcctgcctcagcctcctaagtagctgttccaagcattttgagaggtggaggtgggcagatcgcttcagcccaggagttcaagaccagcctggacaacgtggcgaaacccatctccaccaaaaatacaaaaaattagctgggtgtggtggtgcacctcagtggtcccagctagacaagaggctgaggtagaaggatcacttgagcccaggggcggaggttgcagtgagccgagatcctgcaactgtgctccagcctgggtaacagagcgagaccgtgaacattaaataaaaatggattgtctaggggagagagaagttgagaccaaaatagttcaatgctagtagagagtaagggacagagtataggttaataaatttagatttacctaggtagtatcagccagatttgtaggtcaaagtacaaatttacggccgggcaccgtcccagcactttgggaaggtgaggcaggtggatcacttgaggtcaggacttcaagaccagcctggccaacatggtgaaaccctgtctctagtaaaaatacaaaacgaaattagccaggtgtggtggcgctgcctgtagtcccagctactagggattctgaggaaagagaattgcttgaacccaggaggtggaggttgcagtgagctgagatcatgccactgcactccagcctgggccacagagtgagactgtctcaaaaacaacaacaacaaaaacaaagtacaaatttactggtttcaatgactagctcaaacaaaggtgtcatcagctgtcataggaaatacacaagataggatctggaggaagatattaaatttgaagtgcttctgggatatctagtctagtggtgctgcccaacaaagagttgtatagacacatctggaaatataagttcgtaaacttttagcatgtctttactcactttactgtttagtttaggtgaacctttttccagagggtaactcccctgcatagatgatggtaaaaaactgtagagactaaggttggggttataaatacacagtaaatataggtagaatgcaaggaattttttttttttttttttttttttttttggagagacacgatctcaccaagttgcccagcctggccttgaactcctgggctcaagcaatcttcgtgccttgaccttccacagtgctgggattacaggtatggggtaccacctccggccagatgcaaggattttatttcctggatggagcagcattttggagcatccagaaatatcagccctgtatgcaaggggatgctgttgaatcaattccacatgaaatagacaaggcatactagcagttatgttaggatgttattatttgagccatacacagatcagggggcactttagaatttttcttctgcttactcagttcattcatacgttcaacaagcattggctgggtatctaccacgtgcctttcaatatttcagctctgatgatttgaaagtaaatagaacacatttctacttcatgggtatcctcatgtaaatatgtgatttataaatgagttgtattactcacgcacatttcttttcttttcttttctttctttttttttttttttttttttttgagacagagtctcactctgttgcccaggctgcagtggtgtgatctcggctcactgcaacctctgcctcccaggctcaagcgattctcaagcctcagcctcccaagtagctgagtagctgggattacaggcacacgccactacgccttgctaatttttgtatttttagtagagatgggatttcaccatgttggccaggctgatctcaaactcctggcctcaagtgatttacctgcctcggcctctcaaagtgctaggattacaggcataagccaccatacccagccctcacacacacttctggtgagtataacttggcatgacacttttgaaggatggcttgataatataaaatgcctttaaaaatgtgcatatcctttgattcagcaatttcacatcaaggaatttttcccaaaagaataagatatctacaaagctttaactgcaagactgctcctcatattttgctgataatctcgagaatttaggaataacctgtttgtccccagaaccaaggagattggttatataaattattctatagctagcaggaaaccagtggatgattttctttttaatttttttttttttttcagagacaggttcttgttctgtagcccaggctggagtgcagtggtgtggtgatcacagctcattgtaacctcgaactcctaagctcaagcgatcctcccacctcagcctcccaatggaggtttttaagcaggagagtggcattggatgtgtgtgtgtgtgtatctaattttagaagtcgtgtggagaatggttttcagtagggagaaaaaaaacccagaaaagatgttttttgccacagtgtaggtcagagatgatgcaaaattgagctaacttaggcagtaggaaggaggaggagaatcagatttgggagctatttccaaaatagagtcaataggatttgttgactgactgtggcagagagtgttgggatgttgcagaataaggtaccaaggatatactgagatttccaactcggatggagcaggtatgggggctgatatagtgaatctgactttgaatatgatcaggttgaggttataaatccctcttcatgggcactgccatggtggtttcttgaaacacctttgagaggtgatgtgggatgtggcgaagtgtttaggctttgagactggctggctgagtttgaatgctggttctgccatgtgttagcaagtaatttacttacccaaactctctgagctacagcccctgtctcacaggatactacagcatagaatgaagaaggataaatctggtacagtgcccagcacatagtaaccacgcaataaacatcagctttaaaaaaacagacaatgcgggctgggcgcagtggctcacgcctgttatcccagcactttgggaggccgaggcaggcggatcacaaagtcaagagatcgagactatcctggctaacttagtgaaaccccgtctctactaaaaatacaaaaattagctgggcatggtggtgcatgcctgtaatcccaactactggggaggctgaggcagaacaatcgcttgaatctgggaggcggagattccagtgagccgagataacgccactacactctgacctggcgacaaagcgagaaagcgagactccctctcaaacaaaaaacagtcaatgctgcctgtaatcccagtattttaggaggctgaggtgagcagattgggctgaggttgggaattcaagaccagcctggccaaaaggtgaaaccctatctctaccaataatacgaaaaattagccaggcgtggtggttcatgcctgtaatcccagctacttgggacaggcgtggtggttcatgcctgtaatcccagctacttgggaggctgaggcaggagaatcgtttgaacctgggaggcggaggttgcactgagccgagatcgcgccattgcactccagcctgggggacagattgagactccatcaaaaagagaaaagaaaaccacaaaaaaactcagacaattctataatagagggagaatacgcatgcaacccagggatttttctcagataccctacccattctcaaatagcatgtgctctaagctcctatggtaaaagcttcatgcccctgcaaaactcacacacctgatcccactcctcaagcacttcatggagaagcagcagctcccagctctataacagataggggatttcaggtcctaagtcttgagagcaaatatttcctcaacttcttttctctctctcaagcctcctttaagaggaatacatactatgctttctggaactctgttctaccttccaaacccatttatatcttttacgattttttttccccaagattgcggatattttctattttttttctggagacagtctcgctctgttgcccaggctggagttcagcggtgcgatctcagctcactgcaacctccacctcccgggaggaactgccagaccatcttccaaagaggttgcaacattgtatattcatggtatgagagatctaatttttctactcaatgtcattttaatggtgtggtgttttgttttgttttgttttgttttgttttgttttgtttgagacaggatttcactgccactcaggctggagggcagtgatccagtcatagctcactgcagcctcaacctcctgggttcaagtaagcctcccaccccagccccctgagctgctgggaccacaggcacatgccaccactcccggctaattttttaattatcacttgtatagatgggatctccctatgttgcccaagctggtcttgaactcctgggctcaagcaatccttttgcctcaatctcccaaagtgttagtgagaggtgaagcccgctgcatttcctgtatggagtggggacttggagaacttttctgtctagctaaaggtttgtaaacgcaccaatctgcactctgtaaaaactcaccagtcagcgctctgtgtctagctaaaggtttgtaaacgcaccaatctgcactctgtaaaaacgcaccaatcagcaggacatgggcagggacaaataagggaataaaagctggccacctccaaccagcagtggcaacctgcttgggtccccttcaacgctgcggacgctttgttctttcgctcttcacaataaatcttgctgctgctcagtctttgggtctgcaccacctttgtgagcaataacactcactgcgagggtctgcggcttcactcctgaagtcagcgagaccgtgaacccaccggaaggaaaaaactccagacacatctgaacatctgaagaaacaaagtccggacacaccatctttaagaactgtaacactcactgcgagggtccacagcttcattctttaagtcagagagaccaagaacccaccagaaggaatacattccagacacattaggattacaggtcaatgtcattttaataggtttttggttttgatttggagacttcatttggtaaattctcaaagagtcagcactcaaaatatcagctaacacgttgcttcaacccaagaaggatgatgatcatgatgatgatactaacttgtactgaggacctcctatgggctgccatactttatctcatttaatcataatagtcctctggggctgggtgtggtggttcatgcctataatcccaacactttgggaggcctagtcaggcggatcacctgaggtcaggagttccagaccagcctggccaaaatggtgaaacctcgtctctactaaaaatacaaaaattagccgggcctggtgatgtgcgcctataatcccagctactcaggaggctgagacaggagaatcacttgaacctgggaggtggaggttgcagtgagccaagatcacactactacactccagcctgggcaacagagtgagactccatgtcaaaagaagaagaagaatagtcctcaccactacactccagcctgggcaacagagtgagactccatgtcaaaagaataataataataataataataatagtcctcaccactacactccagcctgggcaacagagtgagactccacatcaaaataataataataataatagtcctcagaatagataataatgtcattagcatttgaaagaaagtgaagattaaagaaattaagggacacaacacacagagtcacacagccagcaggtggcagagtcagggctcaaactcagatcctctggatttcacggcccgcatttttgaaaaccatgcgattctcataagctcagtgtcatggacgtttgaaattctcaacatgctggatgaagtatcaaattaccaggatgagattgcattatttttcctttcaatcaagcaaaatgacagttataaaagtgtcttgcactggcccctgctgccttggctctttataatcacccaggatccctccaagtccttggcattcccagcaaagccgaggcactgagccaggacaagcagccagggctcgggggcggtggcgggggggtgagggggtgaaggggagggtgtgggggggtgttgctgcttaatacttccatgcagatggtgacttcagccagttactgaacttgaagcattatcaccctatgctaatgcaaacagacagggttctggggactgtggtggcagggatagtttgtcctctaggattgtggaattgtattacacacttttagaaatgaaatgtattcgtttttgaattctaaaacaatatgggctcaatatagatggttggaaaattcataaaattaaaaaaaaatctttcccaaatttcaactctagaaacaaccattgttaatattctcttgtatttactgctagtcattttatttttcataccttaaaaccattatttattgctgggcgtggtggctcacgcctgtaatcccagcactttgggaggctgaggtgggcggatcatgaggtcaggagatcaagaccatcctggctaacacggtgaaaccccgtctctactaaaaatgcaaaaaattagccgggcgtggtggcgggtgcccgtagacccagctactcgggaggctgaggcaggagaatggtgtgaacccgagaggcagagcttgcagtgagccaatatagcaccactgcactccagcctaggcgacagagcaagactctgtctcaaaaaaaaaacaaaccaccattatttatttatattttagagacagagactcactctgtagcccaggcaggagtgcagtggcacgatcatagctcactcactgcagtctcaacctcctgggctcaagcaatcctctcacctcaacctcccgagtagctgggactataggtgtatgccacaacagctggctaattttttttttttttttttggtagagacagggtcttgctgtattcctcaggctggtcttgaactcctggcctcaggcaatcctcctgcctcggcctcccaaagtgctgggattacaggtgtgagccactgcacctagcctgatttcttttctgattataaaagtaatacaggccgggcttggtggctcatgcctgtaatcccagcactttgggaggccaaggtgggcagatcacttgaggtcaagagtttgagacgagcctggccaacatggtgaaacctcatctctactaaaaatgcaaacattagctgggtgtggtggtgggcacctacactcccacctacttaggaggctgaagtgggaggattgcttgaacctggcaggtggaggttacaataagccgagatcaagatcgtgccactgtactctagggtgggcaacagagtgagactatctcaaataaataaaagtaatacgtatactttgtagaaacattggagaatacaaacaaaacatttattatcatgacatacataggtagtcactatcaatattttggtgtatgacattttagtgttttttcaccctggatgtgtatacatgtttgtatatacgtaaacaggtaaaattggaatcacagtagccgggtgtggtagcccatgcctgtaatcccagctctttgggaggcagaggcaagagaatcacctgaggccaggaggtcaagacccacctgggcaacatggcaaaaactacatctccgctaaaaatacaaaaattagttgggcaaggtggtgcatacccgtagtcccagctactaaggaggcctgggcgggaggactgcttgagcccgggaggtgagcagtgagccgacatcccaccacagcacgctagcctgggtgacagagcgagactctgtctcaaaaaaaaaaaaaaaaaggaatcacagtatttttaaatttctaccattatcattctataaaatatgattgagattacagtgtgcacttgatcttagccaaaagatccagaatgacagctcacactttatattacaatttgtattctacttttcctgatattttgattaaattgtgctatgttttccctatgacatttccctattacatttctttgtaaacatcattttaaataagtgtacagtgttacattgcaggcataccataagtttagccatttcccttttgtaagatactgacccttttctaattttttctacagtttacataaattgtaaaaaaaatatattgtgtgaatgtatttttagtaattcagatattccttcgggtagatttccatgagttgaatttttagatccaatagatgtattttttcttttttaaattataaaatattttaatgtagagataattacatgacaaagatccctaaatgcaccaaccgtcttttaagggatacacacccttttatttatatattatgtctgtaagattcatccattttgttggtagtaatttgtttgtttttttttttttttttttgtgagacagggtttcactctgtggcccaggctggagtgcagtggcatgatcacggctcactgcagcctgaacctcccacgctcaagtgatcctcctgcctcagcctcctgagtagctaagactacaggcacacaccacccatgcctggctaatttttgtattttttgtagagaagggattttgccatgttgcccaggctggtctcgaactcctgggctcaagcgatttgcccacctcagcctcctcaagtgctaggattacaggtgtgagccattgtgcctggccagtagtttggtctttttcgttgctgtgcagattcagttgtatgaatatagcataatttttgtccattctattgttgatagacatttgagttgttttcatttcttgtcattatgagtaaagctcttaacattggtggacacaagtatgtatttctcttagggatatatccaggaatagaattgctgccagacagaaaaatatatatgtatttgtagctttagagggtattgccagtctttttttatttctttcttttttattttgagacagtctcactctgtcgcccacgctggaatgcagtggcgcaatctcagttcactgcaatctctgcctcccgggttcaagcgattctcctgcctcagtctcctgagtagctgggattacgggcatgtgccatcacgcctggctaatttttgaatttttttagcacagacgaggttttgccatgttgggctggtcttgaacccctgacctcaggtgatccgcccacctcagcctcctaaagtgctaggattacaggcgtgagtcaccacgcccagccattatctctcattttctaaagtggtagtaccattttatactccgaacagcaataaattgtagttacattcttactaactgctaactcatttatttactagcatctggactaacatttggtattgtcagtctttttaattttagtcattctggtaagggtgtagtgcccaccagccatctccaacagattttaacatatatgcttcagatctcttttaagaaatataaatttaaatattcattagtgaatctagtaagggatgtgtgtgcgtgtgtatatatatatatattgtatatatacacacacatatacaagaaaataacatacatattatataaaataacgtatatatacacatactgtatatatacacacacaaactatatatatatatgtgtgtgtgtgtgtattttggagacagggtctcactctgtcatctaggttggagtagagtggtgtggtcttgcctcactgtagcctcgacctcccaggcccaagcagtcctcctacctcagcctcctgagtatctggaattataggtgtgtgccaccacacctggttaatgttttaatttttgtagagatggaaaactgctttgctgcccaggctggtctcgaactcctgagctcaaggattcctcccaccttagcctcccaaagtgctgggattataggcatgagccaccgcacctggccaaggtctgtatttttcttattgtactaaacttgcaacttttctgtagatttaaaaattttcaaaatactgtaaatagtttaaaaatatataaattttagatatagctgaaactaactacttaccctttcccagcctcctaaagtaattactatcctgaatgtaatgtttattgttttttttttttttttttgagacagcgtctcactgtcactgaggctggagtgcagtgtcatgatctcagttcactgcaacctccgtcccacgggttcaagtgattctcctgcctcaacctcctgagtagctggaattacaggtgtgcgccaccaggcccggctaatttttttttttttttttttttttgtatttttagtagagacggggtttcagcatgttggccaggctggtctcgaactcctgacctcagactaaccgcccgcctcagcctcccaaagtgctgggattacaggcgtgagccactgtgcctggcctggtacaactaattttaaaagcaggttgacactctagtccaactggcagatgtgcataccccatgccattgtaatttttccccctagaaaaactcctattcagtcgtacagggaaatgagtataaaaacatttgctgctgccatgtttgtaattgtggacaattgggaataatctttatacctcatcaatgaaaaaatagaccaattatggttcattcatgtagaatactatacagtagactatgaaccagagttacatgaatcagaattcgtatttctcaaaagcataatgtgggccgggcacggtggctcacgcctgtaatcctagcactttggcaggctgaggcaggtggatcacttgagcccaggaattcaagaccagcctgagcaacacagtgaaaacctgtctctatctttttaaaaggaagaaaagcatattgtggaacaacaacagaaaaaagcaacttgcagaattataaagtatgatatcatttgtataaattataagaaaatgttaaatagcgctattatatataatttgtagagttatacatatatacctgagaacaataaacattacattcatgcagccaggcacagtggctcattcctgtagtctcagcactttgggagaccaaggcgggcagatcacttgagctcaggagttcgagaccagcctggccaacatggtgaaaccacatctccattaaaaatacaaaaaattagctgggcatggtggcacgcctgtagtcgcagctactcaggagcttgaacccaggaggtggaggtttcagtgagccgagactatgccactgcactccagcctgggtgacagagagaaaaaaacagttgtaccaatttatactcccactagcattagataaaagttcaaattatgccaggcatggtgtctcacatctgtaaccccagcatttttggactctgtctcaaaaaaaaaatccacatcttttacaacacatgattgttagattttttagtttttgcctatcggatgatatattcttatttacattttcattttccttattactaagggggttgagcagcttctcacattaggccttcctcctctgcccacatgacatgactattcatattctttccctgtttcctactgggatatcattttctttttttcgtttcttttctttttttgagacggagttttcctcttgttgcccaggctggagtgcaatggcatgatctcggatgactgaaacctctgcctcccaggttcaagcgattctcctgcctcagcctcccgagtagctggaattacaggcctgcgccatcacagctggctaatttttgtattttcagtaaagatggggtttcaccatgttggccaggctagtctcaaactcctggcctcaagtgatccacccacctcggcctcccaaagtgctgggattacaggcatgagccatcgtgcccaggcactgccatggtgttttttgtttgtttgtttgtttgtttttaaagataaacctctggggtttctggaaagtaaagccccatgctccaaacagctctgctatacctgtgtgcaaaatattttcatctctctctctctctccccaaagtgcatgcaaacacatatggaactgacataggcatccactgtcgcacttcaaattaaacagacgcacacgacagatattctcacagaaaagcagtcagccaagcccagaacccatagatctaggtccacactcacgcctctgcatgctccccagaaagacggatgcatcgcccgcaggtagagacgggctcaccaatcccactcaaaacccgctgccggcttacagctcgcaagccgcccacagtgccagccccatgccaagcatcactaggggctctagaataggcaggggccttgttctcacttcctttgtgttgcttttattttagttgttttgtttgttgtttttcttagagttatcacctgcccctctgtctccctacccagcccccaagcctcccctccaagcctccactgcgcatgtgccgtgcatccctgccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaagtgagtactggggcggggggcggggggccggggacagctggggatccatgcgcctgcgcgggtggtcgcgggagcgcgaggaacgccagcagtggacccagggaagcgcccccgcagcggggctggcagctcagggggatacgcagctctgcgcagcgacgcgctctccccgcgaacaaaagggggggaccctccgggctgagcctcactgggagggttgggagatggccaggcagctaaggcaggagcctgggctcgacttaggagtcccggatccgtcagctcgcagctggtcctgtgaagtcgggtctctcccacagcccagggaggaggatcctctctccgcctgggatgcgccagggcgctggagacgcgggaccgtcctggaaagcgcccacgtccctggagaggggggagtgtctgctggttttccgcttgctttcctaccccctgcgtgaggtttcggagcgcacctgaaattcccagcttttcctccctcgccttccttgggtcggggtgggaggcttggggcggcaaaagggtcaaaaggcacacaccgttctcttttctctcttgactcagttaaagtctgcttgggcacaactctagaaggcagtttcgaaatagaccggctgtatttatttactggttctctctgcggtgtttggatgtcaacatttctaagtaaacgaaggattttgtttttcattaataggatacaatagttgaaactcctgccctcaaagtgtagaggcagcgtcaggggctccagggtcactggaggtccctgcaaacccgggggctccccaaagccgctgctctcacatggcttgcccaccaggctgggaaggagaggtccttctcagggacccggcagcttcctgcctcggctctgggtcactgctccgcgctctgccccagcacggatctctgagcgatgtagggctaaagtattgtgaatgtgatcttattctgtcctcacctggtggaaaattgtgtgtgcgcgctttctttctctatacctgtaattatggatttagaaaatcttcctagaagggctcaactgtgttctgattctgacgggttgaagttgaaatcacaatccaatgtcttagtggttcatgggctaggatggatgtcatagcactgccaacctctttccttttctttttttttctccctttttaaccttggtctttctttctagttcatcctttcaagacccaatgacttggtgctttggcataatatcagggcgtcagggctgagggtctctgtttctttctttaatttttaagtgcacatagtgggtgtccatatttatggaatacatgagatattttgatacaggcatacaatgtgtaataatcacatcagggtaaacggggtatccaaaacctcaagcatttatccttttttttgtgttacaaacaatccaattacactccttttttaaaaaagcccagctgtgtgactaattatactcttttagtttagcttttttttttttttttttgagacggagtttcgctcttgttgcccagactggagtgcaatgacacaatctcggctcactgcgacctccacttcctgggttcaagcgattctcctgcctcagcctccagagtagctgagattacaggtgctcgccaccatgcctggctaacttttgtatttttagtagagatggggtttcaccatgttgggcaggctggtcccgaactcctgacctcaggtgatcggcctgccctggcctcccaaagtgccgggattacaggtgtgaggcaccccacctgccctcttttagttatttttaaatgtacaataaattgttgactgtagtcatcgtgttgtgctatcagatactagatcttattcattctatctacctatatttttgtacccattaaccatctctgtgtccccccatcccaataccctccccagcctctggtaaccatcattctactctgtatctccatgagggtctcttgtttcttacaagctcaaaataatctcaacaatggctgccttttattgctagatgaccatgtgctgagaactctaaatgcatcatttcatttagtcccctcaacaacctcctgcagtactaagatttataaatttaaatcttgcctagatttaaaaaaacattttaaaataaaaattttaaaacaaaacattttaaaataaaaaatttaaatataaatttaaaatcttgcatagatttaaaaaaacaaaacaaaactgggacttgttaggtgatctgacagttaagtggcagaaccaggatttgaaccccggtctgttggaccccagagcctgcttttaacatgaaggtttattgctttcatggtttcagaaaacttcctaagtctattgagatagtcacagaacatgctcagtgattttataattatgtggcagccctgttgctctctgaagctcacagaggccttaaaaaaatgctgggtccacgcagaatggaagctgttcacaagagtgctgctttgaatcctcactctgtgccttgctggctatgtgactttaggagtattgctaagcctcactctgccttcattttctgaaaatagagattatgtctttattgtgtatactaaataagatgatacatatagtactcaaggttaagtgctcaatacgtattgttcacttccattcggttactgcacaacatttatagacagaacctgcttttactctttgcaaggaattatgtaaatattggtcaattcttcaataatgcccttgtagctttttatatcttaacattttatgagaaaaaatttgaaacatgcaggaaaattgcagcaagcacccaatttacagcagtttcaatcctgaaatttttgtacttctgggtcctatgctgcacactgttaaaagtcaggtataaggccaggcgcattggctcacgcctgcaatcccagcactttgggaggccgaggcgggcggatcacaaggtcaggagatcaagaccatcctggctaacacggtgaaaccccatctatactagaaatacaaaaaattagctgggtgtggcagtgggcgcctattgtcccagctgccggggaggctgacacaggagaatggcgtgaacctgggaggcggagcttgcagtgagccgagattgcaccactgcactccagcctgggtgacagagtgagactccctctcaaaaaaaaagagtctggtataaagtccttcttaccctctgtttcaaaccatcaaagactcagtcttgcttcctagtcaaaggcaagaggaacagctcctgatctgtacttgcgtggatcctcaaatctggtttttcttttcttttttgagatggagtctcactctgtcccccaggctggagtgcagtggcatgatctcagctcactgcaacctccgcctcccaggttcaagccattctcctgcctcagcctcccaagtagctgggactacaggcgcctgccaccacgctcaactaatttttgtagttttagtagagaggggttttcactatgttggccaggctggtcttgaactcctgaccttaggtgatccacccacctcagccttccaaagtgctgggattacaggcatgagccaccacacctggcgaaagctgaaattcttaaaacgtggatccagagtctaacttttgaaacttgaatctggcaagttttattttctagactatttttttttttttttgagacagggtcttgctctgtcgcccaggctggagtgcagtggcacaatcagctcactgcaacatctgcctcccaggttcaagcaattctcccgcctcagcctcccgagtagctgggattacaggcatgcaccaccacgtccggctaatttttgtatttttactagagatggggtttcaccatgttggccaggctggtctcgaactcctggcctcaagtgatctgccctccttggcctcccaaagggccgtgattacagatgtgagctaccatgcctgggcctgttttctagatgcgtgtttgcacgcagggggtgtttgattaaaccttttttggaacactctttcaactctcagggtatctatggatccattccataaagcctgggccctccatttatttattaagtgtgaaaattagtacttttgtttctatggcatgacaattgccaagccaatgttgtaacacatgaaatgctggagaaaagaagagtccccttaaaaagaagacatgctctgtttaacttccacacattttaaaatattttatgttaaacactgagtaggtgtaaattaaacagaattgaagaggggagggagactgcagaactggtcttttttagttaagattgtgttgactgctattttaaatttcaactatagtttttagataaaagatatgtaatgtgctatatcagagtagcaaagaaggaacgttttgaagttaggctgaatgagttcaaaccagcctcattcagctgtcacttggtagatttgtgaccctgggaaaattgctcaaggtctctgtgtgtcagttgcctcatctgtgaaatggggataattgtagtaatgcgcacttcggactcttggaagattagatgagataatgtatataatgcatttagcacagggcctcacatgctgaaagcgctcaatcaaggttgaatggttgtcataggaggacagaaggggattgccccagcaatatttgcagaggttatcccaaactcaccagttacagcttttcattgcttccatttcttagtaaattctggttaatgattctgtacatactgccttcctcatgggaacatgtggagaaaggcttctgcacccttacaaaccatctagtattttctcctttgagaaaggttcaaagtaattgctcccagccaccttcaacagcgtttttccactagcagggaggttttttccccgctcagctggaaaatgtatagtgacatttcagcgtggttagatatataaaaatactgctttcaaccaagtgtaattaattgagggagacatgcagacaaggtgccttttgaaaaagcgcagagcttttcagaaacacagttgtctctgttgtggccatttcttgatagatttgtatgtgtcttaaaggatgatcaagattttggacaggggaaatggaggagttggaggcgggagaggggaatgccaggagaggtaatagcatcaactggctgggtgtggtggctcatgcctgtaatcccagcactttgggaggctgaggtgggcggatcgcttgaggtcagcagttcgaggccagctgtcccaacatggtgaaaccctgtctgtactaaaaatacaaaaattagccaggcgtggtgatgggcgcctatagtcccagctactagggaggctgaggtgagagaattgcttgtactcaggaggcagaggttgcagtgagccgagattggacggctgcattccagcctgggtgacagagcaagacttaatctcaaaaaaaaaaaaaaaaaaaaaaaaaatcaacacagacatagtgctggaaataaatgctctatgagtaggagattggaatgaagtagagagctcaaactgcaatctttccataagcccgggggagatgactactatttaaaagttcaaagttgtgtactgactaacaagcagatcgtaaaactggccagcgtttcaggtttcataaacagtgtggaggctgaaataatgcaaattgctggcaatctatataatagattcttggggaaaggtttgaactatcttctgtttggttacatatgctcattttattattttattttggttttgcatcatttctttttttctgattctagaagtaatacatgtactttataaaaaatttgaattcatctgaaatatgaaaataaaaagtaaaaaacgaccatcatttgctccccagatcccatttattcactccataaataggtactgagtgccttacaagtgccaggaagtgttctaggggctgcaggtacagtcttgagatttctcgacaaagtccctgcccacataaagcttctgtttaggggaagttaagacctgggttgagagtgaaggcgtcaaatattacataagcaaacaagtaagatggtttaggtcatagtaaatgtttcatgggcattaatagggaaggggtacttttcatttggtgttcaggaagcgcttctctaaggaggtgacattttgctgtatcaatagcaggaatccaggcagtaaacgtaaaggccttgtgctagaggaagagacagaaggccagggtggctggaacccagtgagtcagggtgaagggcagatgaatcagagggaagccagactaggtagggccttttaggttgtgattaaaacaaacaaacaaaaagtctgaaatttattctcattgcaggagaaactgctaaaaaattttaatcaagggactaacatgaactgttatgttttttgaggttttttgtttttgagacagggtctcgcttgtcacccaggatagagtgctgtggtgagatctcggatcactgcagcttcaacctcctgggctcaatggattctcccgcctcagcctcctgagtagctggaactacaagttcgcatgcctctagagcccattaaaaaaaaaaaaaattaagacagagtctcgttctcttgcccaggctggagtgcagtggtgtgatcttggcttgctgcaacctctgcctcctgggtccgagcgattcttctgcctcccaagtagctgggattacaggtgcccaccaccatgcctggttaatttttgtatttttagtagagatggggtttttccatgttggtcaggctggtctcgaactcttgacctcaagtgatccacctgcctcagcctcccaaaatgctgggattacagccgtgagccacgatgcccagcagccctgttagtttgtgaatttttggtagagatggggttttgctgtgtttccaggctagtcttgaactcctgggctcaaaagcaatctgcctgtctcagcctcccaaagggctgggactacaggcaagagccactgcgcccagcctggtttttgtttttaaagggtcatgttgggtactagatggggaataagtccatagcggggcaagtgatgatcaatgcaagcagcatttgatatagtccgtgattccttcctaatcaattttattttggagaagtggtggcagtttccttgagtgtgaaaggtgtgacaagggccccatgggttgtcctctggaagatcaagcacctggttaagacttaggagagggaggccgggcacagtggctgaagcctgtaatcccagcactttgggagaccgaggcaggtggatcacctgaggtgaggagtttgagaccagcctgggcaacatggtgaaaccccacatctaccaaaaatacaaaaattagctgggcgtggtggcgcatgcctgtaatcctagctactcgggaggctgaggcgggagactcacttgaaccagggggcagagcttgcagtgagctgaggtcacaccattgcactccagcctgggcgacagagtgagacactgtctcaagaaaaaaaaaaaaaagaattaggagagggatagattctgcactgtctcttgacaggcaactatgtaagttattgcaaaactattatagcagtgatataaatattacaaatatgatagtatctagaatgtactttgaacaagcccaattatttacacagttgagtaatgtctgctcataactttgctcataacattatgttttatttttgcaagagtttcctcctgtgttaattgaagaaaaaattaatcatgcctattcttggactgattagttattaaacacatattaataataatatccattcaatgagttttagctatgaacttgagcttattaaattctcataacagccctatgacataaggagaattattattcccatttaaacatggggaaaccgaggtttcagggggttaagaaacttgctgaaaggcataaagctagaaggtggtagggctggagcctgattctaagccctctctgcctctggatgttcctatccactgtctgttattcttggttcagtgctgggtgctgtagagattagagatggaataagacagaatcccagccttcactcttaaaaggtttacagatttggagtgagagacacagccataaagaacaccacagggccgggcgtggttgctcacacttgtaatcccagcactttgggaggccgaggctggtggatcacttaacatcaggagttcaagaccagcctgagcaacatggtgaaaccccatctctaccaaaaatacaaaaattagccaggcatagtggcatgcatctgtaatcccagctactctggaggctgaggcaggaggatcacttgaaccggggaggcagaggttacagtgagctgagattgcaccactggactccagcctgagcgacagagcaagacctgagaccctgtctcaaaaaaaaacaccacaggctgggtgcggtggctctcatgtgtaatcccagcactttggtaggcccaggcagggaggattacttgagccccagagtttgagaccagcctgggcaatgtggcgaaaccctgtctctaccaaaaatacaaaaaattagctggacgtggtgctagctacttgggaggctgaggtgagagaatcgcttgagcctggggggcccggaagctgtggtgagccaagatggcaccactgtactccagcctgggcgacagtgaggccctatctcaaaaaacaaacaaacaaacaaaaacaaaaacaaaaaatccaccgcaacttataaagcagtataatgaaacacatgctaaatgaaaagtacaagtgtgggccaggcatggtggctcgagcctgtaatcccagcactttgggaggccaaggtgggaggatcacctgaggtcaggagttcgagaccagcctggccaacatggtgaaaccctgtctttactaaaaatacaaaaaattagccagatgtggtggtgcacacctgtgattccagctactcgggagcctgagacacgagaatcgcttgcaccctggaggtagaggttgcagagattgcaccactgcactctagcctgaacaacagagcgagactctgtctccaaaaacaaaaaaaaaagtgtgaaattaggaaagaaattggctgtgactggggagctgcaggccaacagcaaagaggggtgtttgcattgggcctgaaggctaaacagggtttcaaaagaggaagagtgtagagaaggggatttcaggtaagctgtctgccccaggcacagaggtgaatattccaaaggccagggtccaggcaccagctttgtttttttttttttttttttttttttttggctgtttctttccccttggcttaatggatcctgggactgcctggttcacttatatgaatgggcttgggggttggttggaagccagcacaggtaaaggccctcttttagtacttcactcacaagttcccccaaaagatagaatcaattcatttcttcactattcacttgttgtgggcgtctcctgtgcacttgttttagaggaacagagctagatgggtcctgaccccacccttaagaattccgtcctactgtggtccatttcttcctctgctgcttcctagcactgtgatcttggacaattggcctaacttccctaagcctcagtttcctcatctgtaaaatgggtatagtgatttctttaatcccctgagaaataaacagaataatgccaggaaagcatggtgacaaatacatgtcactaaatgttattgatggtagcagtgtgaaggctcagctctgttttgcagacgatatttattgagaaatgcctgccaggctgggtgggaggagctggcctcatagtatgagtacatggtggtcctgcatggaagagcagatggtttctagtttattggttataagtgtgggctttcgagagagcttttattttgaggcctggctctgccatgtcctggctctggactttgaatgagttatttcacctttttttcccccacctcaatcttttgctatctgtatctgttctcaataataaccatgaggaattatataaatctgaagaagtttctcaaagtcagtttttgagacagggtcttgctccattgcccatatgggagtgctgtggcacaatcacagctcttgcaagcctcaacctcctgcctaggcctcccgcctaggcctccgaagtagctggaactacaggtgcacaccaccacgtgtggctaatttttacaatttttttgtagaggtggggtcttggtatgttgcccaggctggtcttgaactcctggcctcaagcaatcctcctgtcttggcctcccgaagtgctgagattataggcatgagccaccacgcctggttatttcacctcttaagctttggtttctgcaactgtacaacagtgacagtaatagtatctacttaggatagctgagaattccttgagacacagattggaaatcattcaatacagaggtcagtacatgatacatgtttagtaaatgttaattattatattattggctttacagctatggcaacaggtacataaaaaggtaaacttgatttaataagggtgtgtgagtaagtagggggctggcagcagggtagctaatggagcaaagaggaggggcttagccaaccctggggcttctgaaaacttctggaagagctgagccttaataagaaagaatagaaggaaatacatatgtggaatcaccattaattgttaggaaaaaccaaattggaaccttactgagatatgtagccactggaaaggctaaaattaaaaggactgatcatactaagtgctggagaggatgtagatcaactggcaccctcatgccttgctggtaggaatgtcacatggggggaaatggcttggtcatttcttaaaaatttaaacatacaccaatcataggacccagacggtgcacttctgggtatttacccaacagaaatgagagcaagtgtctctacaaatatttgtacacaaatgttcatagcagcttttttaggaatagccccaaactggaaacaacccaaatatggtataatcatacaacagaatgcttctcagcagtaaaaaggaacagactaaagacacactatgtaaatggatcacaaaatcatcatgctgagtgaaagaagcaagcaagaaagaaaagagtacatactgtatgagtccgctgacatgaaattattttaaaaacttaaactattgtatacagacagaaagtaagcgagactctaactctacaaaaataaaaataaaaaagttagctgggcatagtggcccacgcttgtgatcccagctacttgggaggctgaggcagaatggcttgagcccaggagttcaagaccagcctgggcaacatagcaagtcctcatctctacaaaaaaataaaaaaataaactggctgagtgtgatgatgtgcacctgtagtcctagctacccgggggctgaggtgggagaatctcttgagcccaggagtttgaggctgcagtgagctatgactgcaccactgcactccagcatgggcaacaaagtgagaccttgtctctaaaaaaataaagaaaatgattataagaaataacatgcatgaagttcttcctatgagccactgtgtgcatgttttacatgcatcctccgctccttacaaaacgttctgtgagatgagacacaatatagccatctattgcatttattgttctatttacagaggagcaaactgaggcttacagaggttaagcaattggcccaatgtcactccactgataagtggtagggctgagatttgaacctagcacaggttgacttaattctgctaccttcctaatttcccaggattagttgaagctgccattgatatagatgcttaatgtcaactagacacatctctgtgtttcttagaactgattctgttctctggctcattaatttccttttccattacaaacatgcctcttgtaagcttgaggactacatctcaccacttcaaagtgccttcagtgtcaaactggagtggaagttgaagacgttcacaaaaatggaggagggagagcctttctgttttgaagacttgtagcttcacaaagaaaggctttctttgaatgatcaagaaggatttctaggtcaatataggggcatattactgtaacgtttggcagcaggagctctgcctgcatttgaatcctggctttaccacttcataatagttgcgtgatcttgggctagttacttaacctctctgaatttcagttttctcatctgtaaaatggggataataacaggatctgccccaaaggatgtattggtccgttttcacactgctataaagatactacctgagactgagactgggtgatttgaaaagaaaagagatttgattgactcacagttccacctggccgaagagtcctcaggaaacttaaaatcatggcggaaggcacaggagaagcaagcaccttcttcacaaggtggcaggagagagtgacagagggaagcaccagatacttatcaaacaaccagatctcgtgagaactcactcagtatcatgagaacagtatgggggaaaccgcccccatgatccaattacctcccaccaggtccctccctccacacatggggattacaattcagattacaattcaagatgagatttgggtggggacacagccaaaccgtatcaaaggctaattaagaagattcaatgaaataatacatgaaagcccttcacagagtctggtgctctcagtaaatggtggcgatcatgttaatagaagaggatgtgaagtgggaattgacctgatagtatctgaatagttggagagaaggaagagagagaagttaaatttaagtgggtgaacctcaaggaagaatggaggtgacgatgagcgtggagatttctggaggcgtgcatgagcttcgctgcattggaggagttgtgagataaaaaggatggttaagcaggaccactagactttggtggattaaaaaaggactggcaatatggggccattggaggacaagggatggagggaaagaagtagcatttatttatttatttatttttgagacagagtcttgctgttgtctcccaggctagagtgcagtggcgtgatcacggctcacttcaacctccacctcctgggttcaagcgattgtcctgcctcagcctcctgagtagccggaattacaggtacccgccaccatgcccagctaatttttgtacttttagtagagatggggtttcaccctgttggccaggctggtctcaaactcctgacctcaggtgatctgcctgccttggcctgccaacgcgctgggattacagacatgagccactgcgcctggccggaagtagcattttaggaaggcttgtctggcaatggtgaccaactggatgcaaagtcaggggccctggggataagaaggtcagctaggagggtttggaattatcccatgatgagggctgtatgtccaaatatccatggcagggctggagtctgcaggagcagtgggtttgaaagaaggggctgatcagaaatcttgaagggagaaacccatagtagttattatgtctcagaaggaaagaaggtcttctaagtgctctcaatgtgataggcaaggaaaaaccctgtcattagcctgaggtcttaaccagttaaaaatatcagcatccaggcgcagtggcttacgcctgtatttgcagcactttgggaggcccacgcgggtgggtcacttgagttcaggggttcaagaccagcctgggaaacgtggcgaaatcccatctaccaaaaatataaaaattagctgggcatggtggtgcaagcctgtaattccagctactcaggaggctgaggcatgagaatcgcttgaacctgggaggcagaggttgcagtgagctgacatcgcactactgcattcaagcctaggcgacagagcaagaatctgtctcaaaaaaaactgaaaaaacaaagagttgttcctgatgctgccgtgagattagcatcctcgccttctgctttgagggaaagatgtgagattttcagatcagatacaaagtaacaggaataggtaccatgaatgggaaccggcagccaagtgacagtgttgtgatgggtataggctgggctaggtactttacacaccttaaatttttgattcttagatgccagcataggtgaggtataacatttcagagtaagtcacgtctttctgaaacaacagaaacaaaaaaacgataaggccccgttaaataactggtccgtttagcactacctgcaatagcaaagatgtggaatcaacctaggtgcctattgacagtggattggataaagaaaatatggtacatatataccgtggaataccaccagctagcaaaaaaagtaaaactatggtctttgcagcaacatggatgcagctggaggccattatcctaagtgaactaatgcgtgttctcacttataagtagaagctaaacattgggtacaaatggacacaaaggtgggaacagcagacactggggactacaagagggaggaaggagggagggaagagttgaaacactacctgttaggtactttgctcattatctggctgatggtttcacccagaccccagatctcagcatcatgaaatacacccttgtaacaaacctgcacatgtacctccttagtctaaaataaaagttgaattttttttctttttctttaattttttttttttaagagagggagtctcgctctgtcgcccatgctggagtgcaatggtgtgatctcagctcaatgcaacctctgcctcccaggttcaagcgattctcctgcctcagcctgctgagtagctgggactacaggtgcacaccaacacacctggctaatttttgtatttttactagagacaagctttcaccatattggtcagactggtctcgaactcctgacttcaggtgatccacccatctcggcctcccaaagtgctgggattacaggcatgaaccactgcacccagcctactttatttttaatctccatctagtatttagactagagatgggcaaatttttcttttttgttttctttaaaatttttttttttttggtagagatggggtctcactatgttgcccaggctggtcttgaactcctggcctcaagtgatcttcctgccttgacctcccaaagtgctgggattacaggtgtgtgtcatcacacccagccctgatacactttttctgtacaaggatagatactattttagggtgtgcaggtcatatggcccctgttgcgaccactcagctctaccaccgtactccaaagctgtagcctaaagctgccatagacaggcacctaagtgaatggatgtggctatgttttgtttcagcttgattggtgagcactgaaatttgaattttatataactttcccatgtcataaaatattattattcttttgatgttttcccacagccatttgaaaatgtagaggtcatctcaaaaaagaaaaaaaaggaaaagaaaatgtagaagtcatccttagctcaagggccatagagaaactggcattggtctgggtttggtctgaaggctcatggatccctaccctagacaaataataggcatgtaaaaggtattcacatcacagctggctttttttttgaaacagagtcttgctctattgttcaggctggagttcagtggcatgatcttggctcactgcagcctccacctcctgggctcaagcaatcctcctgcctcagcctcccgagtagccgggattacaggcacaagccaccatgcctggctaattgttgtatttttagtagagatggggttttaccatgttgttgaggctgatctcgaactcctgggttcacaggattcatctgcctcagcctcccaaagtgctgggattacaggcatgacccaccacgcccggccatagctggctttttgcttgctgtgggaggagaaagttctggctgcttggcttcgatgctatgcttggctcttccaaccaccatttgtggctttttgctgccagagcttgtcatgctgctgcattgcccaagagaaaaagtttgtgaggttccacgttccatcatatcgatgatcattttagggttttcacacacaagagacaggattattgcaagcaacagcaatgaactttggaaaactcagaggttttccaagtgtgagatttaaagcctcatgcatgaaactttaaattagtttaagggggcgtaaccagcataaaaaaaatgaaatagaaggaaataggaaatagaaagctgcatctatgctgctaaagttaagtcttatttccgtgcaacctttcgtttgtttgttttgtttgttcgttttctgagacagagtctccctctctggagcgagtctcacccaggctggagtacagtggtgtgatctctgctactgcagtccctaccttccgtgttcaaacgattctcctgcctcagcctcttgagtagctgggaccacaggtgcatgccactatgcccagctaatttttagtagagatggggtttcactgtattgaccaagctggtctcaaactcctcacctcaagtgatccacccatctcagcctcccaaagtgctgagattacaggcatgagccaccatgcccggcctattttgtccaacgtttgttttacttatgcctatgtgtgtatgtacatactgggtcactcttagtatttcttttttttttttttttttttttttgagacaggagctcactctgttaccgaggccagagtgcagtggtgcaatcatggctcactgaagccttgaattcctgggcttaagcgattctcccacctcagtctcctgagaagctgggactacaggtgggtgtcaccacacccagctagctaactaatttttttttttttttttttttttgtagagacagggtcttactttagtgcccagactggtcttggactcctgggctcaagtgagcctcctgcctcagcctcccaaagtgctgggattagaggcatgagccactgcatctggctctctgagtatttcttactgtgatccacagtaagtaaacttatttaaataagtttgcaaagtacaggaacttaaggaaaaggaatgtatctggaaatccttccagaatttaaaacaaaaaatagctctaggcacagtggcttacgcctgaaatcctagcactttgggaggctgaggcgggaggattgctagaggcaagagtttgagaccagcctgggcaacacagggagatcccatctctacaaaacagttctaaaaattatccagtcatggggcgtgcacctgtagtcctagctacttgagaggctgaggcaggaggattgcttgaacccaggagtttgaggttacagtgagccatgattgggccactgcgctccagcctgggagacagagtgagaccctgtctcttaaaaaaaaaaaaagaaaagaaggaaggaagggagagagagggagggagggagagagagagagagagagagagaaagaaagaaaaagaaaaagctaaacagccagaccttagagagaagaggaaccttggtgactaggaatttccagatggcagaaaattccgggtactgtcatctggctgaatcagtcccactcttttgcatctctgagccactgtgcccaagattcaagtacctgggggagaacacagagaagatctctgcgttaaccagagtccatttctgttgcttgcaaatcatcccatctcctgtgtgtgcaaactcctaaaataagcacttttagaagaaacgctgactcgtacaaactttccctgtgtcctaaggcctcctgccagctttgcaactgctgctcgcgggcaagggaacctctccagtctcaggacaatggtggttgggagaagctaagctaaggtcaaagccaaacacagcgagaacttagcctaagtgtatcggaccagctaggatcaagacccaacccttgactaggaaggagggcatcttgaatgccagttccctaagacagcatttcacgggtgaggtgtattctcccatggcaagacattggaggtgctatcatgagagaaagaacaatggatgcttgcagaacagaacccgcagatgaccactaaggaatgacactggttttccttctctaataaaaataacaacaacaacaacaaaaatagctgggcgtggtggcaggtgcctgtaatcccagctactcgggaggctggggcaggagaatcacttgaatccgggagacggaggttgcagtgagctgagatcgcaccactgcacaactacctgggcaacagcacgagactctgtctcaaaaacaacaacaacaaagaaaaaaccaaaacaccgttgcttttattctgataataaaacagggttaatgctcgaaattttaaaactaaaaaaataccaaaagttataaaagagggcaaatgtcatttaaaggaatgctgcagcgaggtagagtctcacacctgtaatctgaggcagaaggcaggagcttgagcccaggagttcaaggccagcttggccaacacagcaagaccctgtctctacaaaaataaaaataattacctgggtgtggtggtgtacctctaattctattattagctacttgggaggccaaggcaggaggatcacttgactccaggagtatgaggctgcagtgagccaagactgtgccactgcactccagcctgggcaatagagtgagaccctgttctaaaactaaccggctgggcgaggtggctcacctgtaatcccagcattttgggaggccgaggcgggcagatcacttgaggtcaggagttcgagaccagcctggccaacgtggtgaaaccctgtctctactaaaaatacaaaaaaattagctaggtgtggtggcacgtgcctgtacacccagctacacgagaggctgaggctgaagaatcacttgaacctgggaggtggaggttgcaatgagtcgagatttcgccactgcactccagcttgggtgacagagctaactctgtctcaaaaataaaataaaataaagcaaaccaacagaatgccaccaacctccaataaccactgagagcatcccttcagatgtcccttcctcccttcccctttccttcctctcctcctcttcttcctgttctgagtcatgtttctcaaggagagacaagttgtactttgggatctggtctcttttctcacacatctctgctctctaggggggcacctccctccctatggatatcacagggagtttttttccttttagagtttgaatggaggaagacttcagacagaactgtacacagcacagagctgcagagaagtggaagattaagagaaaataatgttggacaaattagatgtagcttgtataatctggagctacagtcacgagaataggatgtaacataaagtctaatgtgattcagcaaacacacgttttcattacttttgtgcagatggctctgctaggtgacttggaagggaaggaaaccgaggcagtgttgcttccttcgaggaagacagagttgcttcctttccccccatccactggggacagaatttcaaagagattacagcacagaccagcctgtggcaaatgcatgagccaagtgtgatggggacacagaggcgattaaaatgcaatcattagggctggtcatggtggctcacgcctgtaatcccagcactttgggaggccaaggcgggtggatcacttgaggtcagcagttcgagaccagcctggccaacatggtgaaaccccatctctactaaaaatacaaaaattagccggtgtgatggcacatgcttttagtcacagctactcaggaggctgaggcaggagaatcgcttgaacccagaaggcggaggttgcagtgagccaagattgtgccactgcactccagcctggatgacagagtgagactcagtctaaaaaaaaaaaaaagattgctgttctatttatgctgtgaacattgctgaaagattgagcaggaaaaatggagatcaatgctcagtaagttccacctgaaagacctcctttgaacatagcaactgttcacttggtgaaatttggctatacaggtaatgaatactttgtgagaaatcacactctgtggtctccgagtagcattaacaatctcttgcaacagagaaagctgaaatgaagaggagaagtgtagaaaatgtcatctgagggcgcgcgtggtggctcatgcctgtaatcccagcactttagaaggcagaggcaggtgacctgaggtcaggagttcagcctggctaacatggcaaaaccgtctctactaaagatacagacattagccgggcgtggtggcgtgcacctataatcccagctactcaggaggctgaggcaggagaatcacttgaacccgggagatggaggttgcagtgagccgagatggcgcaactgcactccagcctgggcaacaaatggagactctgtctcaaaaaaaaaaaaaagaaaagaaaagaaaatgtcatacccaacagtgtgttgggtatgacaactactagtgtgtccagccatcctggtttgcctgggactatcctatttttagctctgaaaagtctttttaaaattttatttatttatttatttttgagatggagtctcgctctgttgcccaggctggagtgcagtggcatgatcttggctcactgcaagctccgcctcacgggttcacgccattttcctgcctcagcctcccaagcagatgggattacaggcatgtgccgccacacctggataattttgtatttttttagtagagacagggtttctccatgttggtcaggctggtctcaaactcccaacctcaggtgatccaccagcctcagcctcccaaagtgctgggattacaggcatgagccaccgcgcctggccatgttaactatatattaagatacgaaacagctttctttcaaggggtgcagctttaaaacagtctacagtagcaaggcatttaacctgtactcggaagccaggaaaccttggcctgacttgccactgtgttctttgaaaggtccgtcgttaatgtttgactattcttaatgacaatttgtggcttatcaggttgacgttttcctttcttttcaggcagctgagacttaagggagtgaagtaatttggtggtattcattgcaggggccacatagatactgtcagtacgcttttaaaaatctttttaaagtaatagatgctcattataaaaattcaaacaatacaaaagtgtagaaagtagaaagtactttctacttcaggaagaaaatttcccaccctcaaattgtcattccgtcacaagtttgatgtgtatcttctcagtgttttgttggacatatgttaacacatggattttaaaaaatgaattggatgatatgtgtactaatcagtcttctttttttattcaaactatatatcatgaccatctttctaagtcagtaatacagcattatcttttccttgttttttttttttttgagagaaagtctagttctgtcacccaggctggagtgcagtggtataatcatagctcactgcaacctctgcctcccaggttcaagtgattctcatgcctcagtcacaggagtagctgggactacaggcacatgccaccacacccagctactttttgtattttttagtagagactgggttttgccatgttatccaggctggtttcgaactactggcctcaagtgatctgcctgcctcagcctcccaaaatgctgggaagacactgcatcagccaaaaaaagtatcttgtgtttaatttggcctatgtcttccttttctgatcactgcataatttttcagtgtctggttataccttattttttcttaattaattctttattgatggacagctaggtgatttaacaatttgataaagaatgctgcaataaatatcttttgtcatttttgcacattgtccaattatttcctctatataaattcactttttttttgatgcggaatctcactctttcgcccaggttggagtgcaatggcgcaatctcggctcactacaacctccacctcctgggttcaagcaattctcgtgtctcagcctcccgagtacctgggattacaggcacgcgccactatgcctggctaatttttgtatttttagtagagacagggtttcaccatgttggccaggctggtttcgaactcctgacctcaagttatccacccaccttggcctcccaaaatgctgggattgtaggcatgaggcactgtgcccagcctcctctatacaaataattaaaagtagaattgctgagttaaaagctttcaactaggtttagaatgtggaagatacacaaatctgaattcactttatggggtgcatatttgagactaaattaaaactaattaacttgaggaagaaagaaaatatcgtaattcaaatgatactgtggaaaaagtagcagagtaggagttagaatactttggttctagagcttgttcaccttccagctaactggttgacctttgacaagcttcttaacctttttgcacgtctgactcttgcctccagttgtatctggtctcatgaatcttccaaataattgacagagtcattttctacaatgcgaatatgacctctgcttaagtccatcaggagctcaccattgcctttggggtgaagctaaaactcctagctaaccatgcagcagtctgtgtttgtagcttcctctccctccacgtgcccagccaggacctttgatccacctgttctcacctcctttcattgccttcaatgctcacagtttgctaagcctccagatgttggttcaggttgttccctccttctggaatatctggtcccttctctgaccagctgacttctactcattcttcaagaaatagcttggactttgtattagtccattctcacgctgctataaagaaatacccaagattgggtaatttataaaggaaagaggtttaattgactcacagttccgcatggctggggaggcctcaggaaactaataatcatggtggaagagaaagcaaacatatccttcttcacagggcagtagaagagaaagaacgagcaagaacagggaaaactgccttaattaaccatcaggtctctcgagaattcactcactatcacgagaacagcatagggaaaaccacctccatgatccaatcacttcccactaggtctctccctcaacacctggggattacaattcaagatgagatttgggtggggacacaaagcctaaccatatcagacttcttaccttctcagaagactttcctgacacctacaggttgaactgatgcctcttctcttggcttttgtgaaggcagcatattactttacacatcctctgtaaatagcacacactgtattacaacggctgactttcttatctgggtcacttcattcttttgagggcagaaaccgtgacctgttcatctttgaatttatagtatctaccacagtgtctgacacatacagatgtttgctgaatctttgtggaataaaacaattgatctataaaataagtgattggattcagtaatacaaaattgcagccaagtatggtggctcacacttgtaaccccagcactttgggaggctgaggtgggtggattacctgaactcaggagtttgagacgagcctgggcaacatggtgaaaccccatctctataaacaatatgaaaaaattagctgagtatggtggtgcacacctgtagttccagctacttggggggctgatgcaggaggattgtttgagcccagaaggtcaagactgcagtgagctgtgttggcaccactgcactccagcctgggcaacaaagtgagaccgtgtgtccaaaaaaaaaaaaaaaaagtagaagtttatgagaattaaaagttcaaggaaacctcagaactactaaggaaacatctcaaaataatacagtaaaaaaaacacaaacaaagccaggtgcggtggctcacgcctgtaatcccagcactttgggaggctgaggcgcgtggatcacgaggtcaggagtttgagaccagcctggccagcatagtgaaaccccatccctactaaaaatacaaaaaaattatccgggcgtggtggcgggcgcccataatcccagctactcgggagggtgaggcaaggagaattgcttgaacctgggaggtggaggttgcagtgagccaagatcgcgccactgcactccagcccaggtaacagtgtgagactctgtctcaagaaacaaacaaacaaacaaaacacacacacaaacaaacaaaggaattaaaatggcacactggaaaataacatgaaagaaagctattaaaaaggaacagactaacaaaaaagacatgaaggatataaaaaacaaatagcaaaatgtcaggtgtaaatccaaccacatcaataattacataaatgcaaatggattaaatactccaatcaacaggcaaagatcgtcagactggattaaaaaaaaaaaaacaccaggatccaactatgtattgtctataagagacacacttcagattcaaagacacaaataggttgaaaagaaaaggatggaaaaatgtatagcctgcaagcataagagagcaggagtggctatattaatatcagacagaagaaaatttaagacaaaaaatgttactagagacaaagagggacattttatagtgataaaaacaacaatacaacaattatatatgtgtccaataacaagagtagaagggaattgtagaatgaattatagaacctttacagtgtgaatattgtaacttacagtgtgtaaattacagtgtgttttcagaaccataccttggaacctctccagattctttaccttgtggcctcctgtccactccattctaaggtgttatcatactgaagtgcaccatagtggtggtcttgatggggaaaagaaatcacagtagcactaacaggaaacatcctgagggaagaggcactgtcatttttaggtgtagggaagatgtttaagagcccgttttaaacatctgagcttctggtctttggaattttgtcagcccagagacagtttcttttcttctcaattctcttttcctttaattggtcttcttcttgccatacctcattccttagtcatcctggtcttgatctcagaaatctcacattctcattgatttagcatggttttctactctagtgccagttctactgttggatggaaagaaccatcttctgatgtgacaggaagccttaattattaatttaaaattcccctacccttctccaacttctatggaagttaactcaggaattattggagtaggttgaagattctctgagtgggaggatgggtgagattcaaattagagaagtactatgaggactaaatgaccctacctaagaaagacagtttccaaactaaagttatgggagttgggtacgtaggtagggactcgggaaccatcttggctagagaagggtcagaggaaaaatacagaggaaattcatgggagagagtatcagggtggatatatacggaacagatgcatacttcaaggggacatttagacattttgctctgggatgagcaaaatcaccctctttttcatctcccaacaaaccatttaataaaaagtaagacattactcattatcggagcaggatctgttgatttcgttttttaatttttttaattcatttgtgtttgatgtgatgatgtgccaagaccagcctgaaggtggccaagggcaaaagcagaggttgttatttgcaggctacgttgacactaggtagtgaacttcacagctcaacacatccacacatattggctgaacgttaattagttctgcctagttacagggtttccaaaatggatgagacattctgcctcccctcaaggaatttgtgggctggtaaaggagacagacacagtaacagatcattatgtaatatgctaagtgctttatcagaggaaaaaagctgggtgcaggctgggcgcagtggctcacacctgtagtcccagcactttgagaggccaaggcaagcacctgaggtcaggagtttgagaccagcctggccaatatggtgaagcccattttctactaaaaatacaaaaaattaaccaggagtggtggcacatgccggtagtcccagctactcgggaggctgaggcaggaggatcgcttgaacccaggaggcagaggttgcagtgagccaagattgcaccagtgcactccagcctgggtgatagagcaagactctgtctcaaaaaaaaaaaaaaagaagctaggcgcatcaggggctttgagccttctgacccagcctgggaacagggagaagcacaattcaaggggacatttagacattttgctgtgggaggagcaaaatcactcctggcaggagcgacccccgggctcagttcaccaggtgaaaggaacaggcaaagtcacataagtacaaagcagtgtggtgcttcctgggaccaaaaagcaattcgttatcaataaaacatactttgcgttggttcccatcttaccgaaccttctttcctttcttctttcttccctgcttccttctcacacgccctccactcacctctcagaactcattctatgtgatctctacccaaagcacagtgctaagagcccggaataaaacgggcaaaaccaacctagccattgtcctcatagaattaatcatacaaataaaaatataattttaacctgtggcaagtgctcagacagaaaaaatccagttaggctgccagtaaaaatactagatgtggccggatgtggtagctcatgcctgtaatcccagcagtttgggaggacaaggcaggtggattgcttgaacccaggagtttgagaccagcctgggcaacacagcaaaccccatctctacaaaaatacaaaaacaaaacacaaaaattagccaggtgtggttgtgtgcacctgtagtaccagctacttgggaggttgaggcaggaggatcacctgagcccaggaggttaaggctatagtgagctgtgattgggccactgcactccagcctgggtaacaggaagaccctgtttcaccaaaacaacaacaacaacaacaacagcagcagcaacaacaaacaaaaaactcccccaaacaggtgcccagttaactttgaatgtcagataaacaacatatatgattttgcagtataagcatgtcccatgcaatatttgggacatacttatcctacacaaaaattgttttttctgtgaaattcaaagttaactggatgtcctgccttttttttttttttttttttttttttttttttgaggtggagcgtcgcactgttgctcaggctggagtgcaatggcgccatcttggctcactgcagcctccacctcccaggtttactagattctccagcctcagccccctgagaagctgggattacaggtgcccaccaccacgcctggctaatttttttgtatttttagtagggacagggtttcactatgttggccaggctggtcttgaagtcctgaccttgtgatccgcccgccttggcctcccaaagtgctgggattacaggtgtgagccaccacacctggcctgcatttttatttgtaaacctggcagccttaagtccaagatcccatgagctcacatgactaggggacctgagttaacctgggctgcagtgggagaaggtgattggagaaagcctgacatctgcagaacagggagctgcacctgggagaggaggccggagaggggagtgacctggagaagggaacagcctgaatgcgaacagaaattggccccaacagagcgttcaagagtctgagagaaggctcctggggcttgagcacagacatttagtttactgggatatggagagaggagaagcaattggaaaatgagtaaatatatcatgcttttaaggaggcatgctgtacaagtaaatgtcaggtacagtgactcaggttattgatttgaaagattagtcagtggagacatgtgctggacttactcagtccctctgttgtcaaggaagtccaacgccaccagcactagatccttcaacaatgcagagtcctcccgcaaatgaatctgactttgcctgtaaaccgcggagagtttcaaaaactggaaagcattacaggtggccagtttgtttccatttatataaagtgcagcaaaaatgatctgtcagagagagaacattgggataaatttcttttttttttttttcttctggagacaaggtcttgctgttgcccaggcaggagtgcagtggtgcgaccatggctccctgcagctttgaactcttcatcttaagggatcctctcacctcagcctcctgagtagctggggccacaggtgtgcactagtatgtctggccaattaaatcaattaaatatatatatattttgtagaggcggggatctcactatgttactcaggttggtcttgaactcttggtcccaggcaatcctcctgctttggcctcccaaagccctgggattgcaggcataagctacatcacctggcctgaaatacgcttgaaggcatcctttgaaccactgttatcacagaagtgtggtcaggttcagtgtggagagtgaatgagaagctgggcaggagcctgtgcgagttgggctttgtggagacacacagaaagatgccccccactttaaccaccttcccttgcctcgtcgtttgactgctgaggtcttactcacactctgagactgtagctttcacgtggcctcctctaatatattttcagtgtagccttaacaatgaatcgtagtaacttctcaccttacatgctccccaaaagatgtcactttgggagaacatattcaaggaaccctccccaatcctgacccccatccccaccccagctcctgctgctgttgacacaactgccttagctgtgaggctgtgccatccattggaacctgggactttccaatgttgggatgcctcagcatcatcaagcaaaattggggttctttttgtgtatgctttaaaaaaaaaaaaaaaacttgaagcataaaactattactggaaagtggtcctgatccagactgcaagagagggctctcggatcttgtgcaagaagaaatttggggcaactccatagagtaaagtgaaagtagtttattagagaagtaaagaatcaaggccgcgcacagtggctcatgcctgtaatctcagcagtttgggaggccgaggcgggcagatcacctgaggtcaggagttcgagaccagcctggccaacatggcaaaaccccatctctactaaaaatacaaaaattagccaggtgtggtggtgggcgactgtaatctcagctactcaggagactgaggcaggagaatcacctgaacctaggaggctgaggttgcagtgagctgagattggtccactgcacttcagtctgggcgacagagtgagacttcatcttaaaaaaaaaaaaaaaaaaaaggattccaaagaatgtcaggtatggtggctcatacctcccagctctttgggaggccaaggcgggaggattggttgaggccaggagttcaagactacactggccaacatagagagaccctgtctctaattttttaaaaaagaagaaactaaaaaaatggcttctctgtaggcagagcagtctcgagtgctgctggttgacaattcttgtggttatgtcttgatcgtatggtaaacaagaggtggattattcatgagttttccggaaatggcacagggaattcctgaaactgagaattcctcttccttttagactatattgggtaacttccagaagttgccatggcacttgtaaactgtcatagtgctggtgggagtgtcttttagcatgctaatgcatcataattagtgtataatgagcagtgaggatgaccagtggtcacttctgacaccatcttggattgggcaggttttggccagcttctttattgcaccctgttttatcagtggggtctttgtgacctgtatcttgtgacctcctgtctcatcctgggactaagaatgcctgacttcctggggttgcagccaagtaggtctcagccttattttacccttattcaagatggagtcactctggttcaaatgcctctgacaaagccagcatagatgaagacctaacacccttgagcaaatgaaagatctgtgtgatggaacagttgcgtgtcttgattggggtggttggttacctgaatctgtacatgtgataaaattgcacagaaccacacacacacatacacacacacaccaatgaattggatgtaaaactggtgaaatctgaataaggtcagttatgcaaaatgtcatcactggggaacattgggtgaaggttttttaggacctctctgacatacaaacggatataaatcagcaattctctccaaataaaaagctaaacaacaaaaccgaccccaaacactgacaccttgtatccatcatccaaatttggtcaatgctaagatatatatttttttttttttttttgagactgggtctcaatgtgtcacccaggctggagtgcagtggtatgatctcggcttactgcaaactctgcctcctgggttcaagcgattctcatgcctcagcctcccaagtagctgggattacaggcacccaccaccattccaggccaatttttgtatttttagtagagacagggtttcaccacgttggccaggctggtctcaaactcctgacctcaggtgatccgcctgccttggcctcccaaagtgctggtattacagctgtgacccaccgcacccagccctaagatctttgtattagtcctttttagaaaaataaaacaaaaccttaaagattcagctggagactcctactcagtcctttttctttccagaaatgacccttgtcatggaattaatatgtatttatcttttccacatttgcttttactgtattatgtgcatagtcataaacaatctgtgatatcctgttatacatttcctttggtagcttattttgccactaaacatgttttcaggatttatgcatgttgaaacatgtagatcaattcttttaattttttaactgctcaaagtatttctaataggtgaatataccacaaattcttcaaccaatcttccactgataataggttgttttccatttttcagtattaccagacattgctatcatggccatccaggtataaatgcctttttgggtcaagagtttctgcagggtttttatctagaattgaaagtgctaagcagacagtatgcacatactaaacttcagtaaacattgagaaattgctatccaactgtgactctataaatttatggctgtcccagcaggtggtaataatcaccatttccttatattttcaccagccaacctgatctttccagactgttaaaagtttgccaatctgatggatgtaaagtagtatttcattgttattttattattgtgttttcctgatttccaatgaggttagacatctcttcataggtttattagctggaatttcctcttctgtgaatcctgaggtcgtacccttttgccctttttttttctattgtgttgtcattgtcataggtattttttgtattttgttcccgattgttttgtatgtttgtgtattataaatttcagcttgtggcctgtcttttaaaaaaagactttttattttgagattattgtagtttgcgtgcagttgtaagaaataatacagagatctatgtatgcctttcacccattttaccccaatggtgacattttggacagctaaatacagtatcaaagacaggaaattgacattgatacaatccattcatcctattcagatttcaccagatttatgtgtgtgtctgtgtgtgtgtgtgtgtgtatttagttctatacaattttatcatatatttagatttgtgtgactatcaacaaagtcaagatacagaacagttccatcacaaaggttcctcctgctacttttgtatagttacagttaccttgccccattcaacccctagcaacaacaattagttttctatttccataattttgtcatttcaagaatattaaagaaatggaatcatgcagtatataacctttttgagattggctttttcactcaccgtaattctctcaagatccatccaagttgctgtgtgtatcagccattcattccttttcattgccaagtaatattccattgtatggatgtaccatggtttgttttacccattgaaggacatctggattatttccagttacaggctattatgcttaatgctgctatgaatactcttatgcaaatttttgtgtgaacataagttttcatttctctgagataaacgctcaggagtgcagttactgagttgcttcaaatgcatatttagccttataagaaattgccaaactattttctagagtggttgtaccatgttacattcccattggcagtgcacaagggattcagtttcttcccatcctcacctgcatttggtgttatcattattttttattttagctagtctgataggtgtgcagtgacatcttgtggttttaatttgcattttctttatatctaatgctgttgcacatctttttatgggcttatttgtatgtccatctgtataatctcttcagtgaaatgcctgttcatgtcctttgtccacttactaattggtttatttggggtttttctgctgttgacttttaagagttctttatgtattctaaatacaggtccttgttgggtatgtggtttgcaaatatttcctcctagtccgtagcttgttttttcactttcttgtcaatgaagagtcaaactctgtaaaatatttgaagatacttattctgagccaaatggaagtgaataatgacctgtgacacagccctcaggagatcctgagaacatatgctcaaggtggttgggccacagcttggttttaaacattttagggagatacaaggcatcaaccaatatatgtaagatgtacattgatttggtccagaaaggcaggacaactggaagcaggaactttcaagtcataggtggattcaaagattttctgactggcaattgattgaaggagttaagttattgtctacagactgagaatcaatagaaaggaatgtctgggttaagataaggggttgtggagaccaaggtttcattctgcagtcaaagcctctgtgtagcaggattcagagagaacagattgtaaatatttcttttctttttttttactttttcttttcttttctttctttctttcttcttcttttttttttttttttttttttttttttgaggcagggtctcagtctgtcaccaagtctggagtgcagtggcacgatcacagctcactacaaactttgtctccagggctcaagtgatcctcccacctcaaccttccaagtaactgggactataggtgtgcacctccccacctggctaatttttgtattttttgtagagatggggtttggctgtgttggacagactggtctcaaactcctggcctcaagtgatccacccacttgtcttcccaaagtgctgggattacaggcatgagccaccacacctgacctgattgtaaatgtttcaatcagacttaaagagtctgttctattaataattccaaaaggaaggcaggtataatgaggcatgtctggctctcccttccaatcatggtctgaatgactttttcaggttaactttgacatgcccttggctgagaggagggctccattcagatggttggggggccttagaattttgtttttggtttatactcttcacagactcttttgcagagcaaaggtttttaattttgatgaggtctaatttatcaattttcccttttatagattatgctttggtgtcaaatctgggaactctttgcccccctttaggttcttaagattttcccttgttttgttctgaaagtattatagttttacattttacactaagtctgtgaatcattttattttttgtgtaaagcatgataattaggtagagatttatttttttggcctgtggatatccaatttgtccagtattgtttgttgaaaaggcttgacttcctccaataaatcatcttcacacttttttttttttttttttttgagacagatccttgctgtgttgcccaggctggagtccggtggtgcagtcacagctcactgcaacctccacctcctgggttcaagtgattcttgtgtctcagctaagtagctgggactacaagtgcgtgccaccacacctggctaacttttgtatttttttagtagagacagggtttcaccatgctggccgggctggtcttgaactcctggactcaagcaatcctcccacctcagcatcccaaagtgctgggattacaggcatgagccactgcacccacccttcgcacctttgtgaaaaataatgtgggcacatttgtttggggctatttctggattctctgttctgttccctcaatctatatgtgtattcttccaccagtaacacagtaacacagtcttgttaaagtaagctgtaggtatatgtaatcatttgtgattccttccagcttattcatatttctcaaattattttagctcttacaggtcctatgcctttatatataaaatttagagtaatatcgtttatgtcttcaaaaattaccttgcaggggtattgataggaatagcattaaacctacaggtcattttgagtgtaactgatatctttactatgtggagtttgccaatccatgaacacaatatgtctcccgatttattgagatattcttaattctttcttcagaattctgtaaatttcagcatacatatcctctacatattttgataaatttatatttaggtatttcattttctttggagtaattataaatggtaatgtgtctttaattttggtttccacatgttaattattagtatatatagatgcagttcatatttgtctcttgacattggatcttgcaaactttctaaactcttgtattagctctaatagttttttggtaagttattggagatctacgtagacacttaagtcatctgcaaatagggacagttttatttcttccttcctaatttgtatgccttttatttctttttcttgttttattgcactggctagaacttcagtactatattgaatgacagtagtgagagcagacattcttggctttttcccaattttagggagaaaaaaatcaggttctcaccattaggatgttagctgtagttttgtgtagatacactttattaagttgagaatgttctcccttattcctactttctgagactttttgtactacatgagtgttggattttgtcaaatgctttttctgcatcaattgatacaattgtatgattttttatttttaccttgttaatatagtggatcacacattgattgattttcaaactagctttgcatacctggattgtcccacttagttgtggtgtataattcttttcatccatcattgggtttgatttgctagtatttttagtattttgttgaaaatttttgctctaagttcatgaggaatatattggtctgtagttttcctttgttgtactgtctctctctggttgtggtatgacggtaatacaagattcataaaatgagtgatggagtgttcctttttctttctttctttcttttttttttttagacagagtctttctctgtcgcaaggctggagtgcagtggcgcgatctcagctcactgcaacctccaactctcaggttcaagcgattcccctgcctcagactcccaggtagctgggattacaggcacatgccaccacgcctggctaattttttgtattttagtagagacggggtttcaccatgttggccaagatgatctcaatctcctgacctcatgatctgcccactttggcctcccaaagtgctgggattataggcatgagccaccgcacctggcctcttttttttttttttttttttttttttttggagagggagtcttgctttgtcactcaggctgcagtgcagtggtgcaatctcggctcactgcaacctctccctcccaggttcaagtgcttctcctgcctcagactcccgagaaactgggactacaggcgcctgctgccacgcccagctaattttttgtattttagtagagatggggtttcacgatgttgcccaagctagtcttgaactcctgacctcaagtcatcctcctgcctcggcctcccaaagtgctaggattacaggcgtcagccactgtgcctggccaagtgttaccttttctattttccacaaaagattgtgtaaaatatgtattaattctttaaagatttgatagaattcttcaatgaagaattgatagagattcattttttttggcctatggatgtccaatttgtccagcgttgtttgttaaaaaggaataatttgaaagctcacaaagagaaatatccaggcaatttctggagatttctcctggagatttctcttttgggagtttttaaattatgcactcattttccttaatggttttagaactatgcagattttctaattcgtcttggatgagtttggtagagtgttgtttttgaggaattggtccatttcattaagttgtcaagtttctgcgtaaaaagttgtttgcagtattcccttgttatctactcagtggctatagaatctgtagagattatcacctgtttcatttctgatattagtgctttgtgtcctctctctcactctctctctctgtctgtctctttttagagataggggtcttgctgcattacctaggtgagacttgacctcctgggctcaagagatcctcctgtctcagcctccaaagtagctggaactacaagcatgcaccaccacgcctggctaattttttgtagagatggggtcttgctatgttcccctggctggtctcgaacttctggactcaagcaattctcccacctcagcctcccaaagtgctaggattaaaggcatgagccactgcacccagccctctttcttcatataagcatttagtgctattaattttacactgagtacagtctctgtatcacatatgttttgatatgttgtattttcattttcatttggttctattctttaagttttgttttagaattcttctttgacctagagattatttagaagtatgttgtttaatttccaagtgtcaggagattttctgttatatttctgttattgatttctggttttgttccattatggtcagggaatataacacataattttaattcttttgaatttgttggggattgttttttggccggggtatggtctatcttggtaaatgctctgtgaacacttggaaaaaaatatgtattccactgttgttgggtgaagtgttcccaacttaaatatcaattaagttgaatgttatgcagttattctatatccttgctgattttctgtctagtaagtctaccagttgctcacagtgggatgttgaagtgatcaattgtaactgtagatttgtgtacttctcctttcggctttatgaatctttgtttcatgcatcttcagactctctgttgtttggtgcatacacaggattgctatgtcttcttgataggttgacccttttatcatgatgtaatgtctctctggtaattttctttgctttaaagtctactttatctggtattagtagagccatcctggcttttcttttgattaacatttgtgtatctttttctatcattttactttgaatctgcctatatcattatatttgaagtgagtttcttctagataacatattgctggataatgttttcatgttcattttgccaatctgtctttaaactgatatatttagaccatttacatttaaggcaattattaatgtgttaggatttaagtctgccattttattgtttgtttctcctgtttttccttctctgcttctcttttcctactttcctacaggttacttgacatattttaaggattccatctttttttttttttttttgacatggtctcgctctgttgcccaggctggagtgcagtggcatgatgacttggctcactgcaacctttactttccaggttcaagcagttctcatgcctcagcctcccaagtagctgagatcacaggcatgcgtcactatgcctagctaatttttgtattttcagtagagatgaggtttcgccatgttggccaggctggtctcaaactcctgacctcaggtcatccacctgcctcagcctcccgaagtgttgggattacaggcgtgagccactgaggccagccagattccatctttaaaaaaaattattattgatttttgtgggtacataagtacccaaataagataaaactaaagttccaagccttcttctgttatcattacctttctgtttggagaatttcctttagcctttttttttttttttgagttgtagctttgctcttgttgcccaggctggagtggagtgcagtggtgccacctcagctcactgcaacctcgacctcccaggttcaagtgcttctcatgtctcagcctcctgagtagctgggattatataggctcctgccaccatgcccagctaatttttgtatttttagtagcgatggggtttcattatgttggccaggctggtctcgaatgcccgacctcaggtgatccacccgcctcagcctcccaaagtgctgggattacaggtgtgagccaccgtgcctggcccctttagccattctttaagggcaggtttactaacaacaaattctcttagtgttttctcgcctgagaatgtctttgtttcctcttcattcctgacatctatttttgccagatatagaattcacaattcataattcttttcttttacttcttgaaaaatattgagtcacttccttctagttgccatggtttcaaaggagaacttgactgtcatttaaattgatgttccctttcaaataatgttttatggctgggtgcggtggctcacgcctgtaatcccagcactttgggaggccgaggcaggcggatcatgaggtcaggagatcgagaccatcctggctaacatggtgaaaccccgtctctactgaaaatacaaaaaaattagccgggcgtggtggcaggtgcctatagtcccagctcctcgggaggctgaggcaggagaatggcgtgaacccaggaggtggagcttgcagtgagcagagatcatgccactgcactccagcctcggtgacagagtgagactctgtctcaaaaaaaaaaaaaaaaaagttttatttctttctgaatccattcaagatttttcttttttttttgtcagagtttaaggacatgtcttggtatggatttctttagttttatcttatttgggattttctcagcttcttgaatccataggttatctttcttcaaatttgggaagttttcagctattgattcttcaaataatttttcagtaccatattctttcttttctccttctaggaatacaaattaatttttatttatttattttgagacagggtctcactctgttgcccagggtggagcgcagtggcacaatcatagcccactgcagcctcaacctcctgggctcaagtgatctgcctgcctcagcctcctgaattgagttgctagaactacaggcatgtgccaccacactctgctaaatttttttgtgtgtgtgtgctttttgtagagacagggtctcactatgttgctctgctgatcttgaactcctggcctcaaacgttcctcctgcctcagcctcctaaagcactgggatttcagtcatgagccactgtgcctggcctttctcttttttattcttattttttttgagatggagtcttgctctattgcccaggctggagtgcaatggtatgatctcagctcactgcaacctctgcctccggtgttcaagcgattctcctgcctcagcctccctagtagctgggatacaggcatgcaccaccacgtccagctaatttttgggttttaagtagagatggggtttcaacatgttggccaggctggtcttgaactcctgacctcaagtgatctacccgcttggcctcccaaagcactgggatttcaggtgtgagccaccgcacccagcctttctcttttctttttaagcaggtagccttcctgttgagctatagtatgaggggtggttgggatgtatattcactttcccccttggtgctggggccactttcctagaaaatatgaggaacaaacctgacagtgctgcattgcttcctggtagggggtgtacgtttagttccttactgcgctctactgctgctggggagtgagaaatgatgagttgactcgtaccactttgttgatgcagggtgagggcagaaacttagctccccaatgggtcccactgacaccagcaggtgggggagtgaggcaggagtacagactagccttgcacaaagtcagaggacagtccaaaagaccactctcacttctgacaccagctgcgagtttgggggtccccaaaactgtcctcaactttcatgctttgctagagggactcacagaactccctgaaagctgttgtactcacagttacagtttattacagggaaagagttcagattaaaatcaggcaagggaagaagcctggagggcagaatacaggtaagttctgaacacagagatgacagtggagtaatgggcagctttaattgtcctggcaataacatgtgacaaaatgaatggagtatgtcaaccagggaagctcactcaagccttggtgtcactgctagaccttcctgatacttgtttggtaaagaaatcagagtgccacctccttccactgggtgggggatggagaatcagctctcaatttgttcccacccatgctaccccagcaggggaatcagactgttaccacctgcttctgccacatgggagttggaaaatcaactttaatctcctgtcaatgatgtgtgaaaatacacacaaagtattgccaagcagggaagctctcccaagccttggtgtccagagtttttattggggctcagtcatgtagacctggttgactgcccacattgctgacctcattctccagcccctctgaaggtggagctgatgccatgtgacccaaagctcccatcctgaatcacatcacttgactttctgatgtggtctaaagcccccctgtgaacaaacacacttttattaagcaggacattccaaaggctgagagatgacctcccaggagctgaagtttaaattcattactgcatatcctactttgtacatgtcattcacttttttttttttttttttttgagatggagtctcactctgttgcccaagctggagtgcagtggcgtgatcttggcttattgcagcctccgcctcccgggttcaagtgattctcctgcctcagccttctgagtagctggggttactggcgcccaccaccatacccggctaatttttgtagtttcagtagagacagggtttcaccatgttggccaggctggtctcgaactccttacctcaggcaattcacccacctcagcctcccaaagtgctgggattacaggcgtgagcccctgtgcccagcccacatctcattcacttttattgctgccaggtgggtgtggaggttcagcttcacagtgagctttgttgacaccagtgtaggtggaaaatgcaggcctggctggccatgacttgtgccacttgtccaatcttggtgatgctgattgggatggagactccggctctgccgggctctgccaacaccagggtgagaaggaaagaagagtcatggtgagtagcctcaccttgcaccagctcattaagtctgctgaaggggaggggagagagacgggagacccatcaccagaccctgatgacatggctgtggcaggaaaatcagggtaccaccttcttccactgggtgggggatacaggatcagcttcccactcattcccatctatgtaccccagcaggggaatcagagcatcaccacctgcttctgccatgtggaagctacaagaccagatccccagttggccctgctgaaatgacagggaaggggttgcagtttttccatcagtctttggctggcagggcagatatggttaaaaaaaatttctctataatctcagcattttgagagtccaacgtgggaggattgcttgaggctagtagttcaagaccagcctaggcaactgtattagtctgttctcatgctgctatgaagaaatacctgagactgggtaattataaagaaaagaggttcagttgactcacccttccacatgtctggggaggcctcaggaaacttagaattgtgtgtggaaggcacctcttcatagggcggcaggagagagaatgagtgcaagcaggggaaatgccagacacttataaaaccatcagatctcatgagactcactcattatcacgagaacagcatgggggaaaccacctccatgattcagttacctccacctggtcccgcccttgacacgtggggattatgggaattacaattcaaggtgagatttgggtggggacacagagccaaaccatatcagcaacatagtgagacctcctgctctacaaaaaatacaataattagccagttgtgttgatgcacacctgtagtcccagctgctcaggaggttgaggcaagaggattacttgagcctgggaggttgaggctgcagtgagccatgatcgtgtcactccactccagcctaggcaacaaagtgagatcatggcttaaaaacaaaaatgaataaaaaatcctgttgctggttttctttcttttcttttgattcaggggaactggcttttcttagagcgtttttttttttctgtgcttggtagtggttccaggtcagaggcttttcctttactgtgtctgggatgttggggtatatggaagacaataagaaaactcaggctgctcactgccacgagtgcccaaagtcccaggatccagaggtagtatgtcttctccttttcacctttcagaatctccttatgcttgtctgctgtgttatgtctgtgagttatcagttgtaagagagaggacctgggaagaatgacactactgcatcttggccagaaccagaagtcctgtagcttgactttcactttgcttatgatactgtatttagttttgacttttaatgagtcaaatgcattgaccttttcctctaaggtttgtgtgtgtgtgtctgtgtgtgtgtctgtttaagaaatccttctcgacattcaagtcataaagatagctcagactttttctctagtttttaattttttttagatggagtctcactctgttgcccaggctggagtgcagtggcacaatctcggctcactgcagcctctgcctctcccgggttcaagcgattctcctgcctcagcctcccaagtagctgggatttacaggcacacaccaccatgcccagctaatttttgtatttttagtagagacagggtttcaccatgttggccaagctggtctcgaactcctgacctcaagtgatcctcccacctcagcctcccaaagtgttgggattacagatgtgagccaccacgcctggcctttttctctagttttaaagtgctttccccactcccatatttaggtatttagtctaattggaatttatttttgggtgtgacagtgattttcaaagcatgatccaaggaccctgggtgactgagactctgtcaggaggacgatgaggtcaaactattttcctaatgatgccaagatgtaatttttctttattgtgttgacattcccaatgacagtgccaaagcattggtgggtaacactttttgcaccttagcacaagaaggcagggcaccccactctactcatcttcatattcttcatggccatgtattcacagttaaacaaacatgcaccagtttcatttaagaatgttcttgatgaagcagtgagagttattattgttactgactcctgatcccaagtatgtctttgagctcttctggatgatggaatgggaaatacacgaaaagcacttcttctggattctgaagcacaatggttgtctcaaggaaaagcacttatgcagtggctggaactgaactagctgccttttgtcttttgttttttgtttgcgtagaacatcattgaaagaaatactgagaaactctgatttttcagccttgggtatttgtcagacattctctcaaaaatgagtaaataagcctgtcacttcaaggaaaacaactgacagtgtttgttgctggtgatcaaacttgagctttcaaataaacaattagaattctggaacacttgtatctgttaccatgggcttgatggtttccaatagaagactttttgatgtgattggtcgtaatgttaatgaatgtgattttggggatgaaatgtgtcaaatgtggaagatcagtgtaaatcagtggcctaatgttttgtaaatgaccaatacatgatattccaaaatcatacttgagcaaaagatctttcaaagagtaagatagaccaatgaattctcatgtaacagagtatgaattgatacagtttcagattccacattgcaagtaaaccttaaaaatgactacttcttgagtttgggtgtcatagaaaataagaatattcacaataatctgaaaaggctattaaactactcctgcctttgctaaccacacatttctgtgaggttagattttccttatatactccaaccaaaacaatatatattaaaacagaccgaacatagaagcagatataagaatctagccagacattgaaacgatttgcaaaaatttaaaacaatgtcactaaaaattttttgttttgaaaaatagaagattttaaaattaaataacatgttacctatgttaccatgtaatgaatttatagtgaatttaaaaaataaattattaaggccaggtgtggtggctgacacttgtaatcccagcattttgggaggctgaggtgggaggatcacttggacctgggagattgagaatgaagtgagccattatcatgccacgccactgcactcgagcttgagcaacagaatgagagcctgtctcaaaaatttttttctaaaatttctcagtttcaatttatcatatagttttcatatatatatataatatatatataatatatatttaaaaagctctttgggtcctccatatttttttaaatggccaggaaatgttgatctatggcatgaaatagagatctgattttattaatttttttttttggagatggagtctcactcagtcacccaggctggagtgcagtgacacgatctcggctcactgcaagctccacctcctgggttcatgccattctcctgcctcagcctcccaagtagctggactacaggcacccgccactatgcccggctaatttgttttgtattttttagtagagacggggattcaccgtgttagccaggatggtctcaatctcctgacctcgtgatccgcccgtctaggcctcccaaagtgctgggattacaggcgtgagccactgcacctggccaatctgattttattttcattttctcatgtgaataaccagtttctccagtagctgaagtagtctatcctatccctactaatttgtaatataacctcttgccattagtatgtttccatattcatttgattgtgtgcctagactctttttctattatatatatttatttgttcatccatatgccaattccactgtctttttttttttttttttttttttttgagacagagtctcactctgtcaccccggctggagtgcagtggcacgatctcggctcactgtaacctccgtctcccaggttcaagtgattcttcagcctcagcctcccaagtagctgggactacaggcatgcaccaccacaccgagctaatttttctatttttggtagagatgggttttcaccatgttggccaggatggtttcgatctcttgacgtcaagatccactgacatcggcctcccaaagtgctgggattacaagcatgagccactgtgcccggccaggaattacacttttagaaatttgtattatacagatatttgcaggaatgcatgaagatctgtataagagaatttcattagagcattgtgtctaataataaaaaattagaatcagtctaagagtccatccatagagaagtggctaaactatggtagaactttagagcaaaatattatgtagctatttggaaaagaatgcagaagatctaattgtatcatcatggaatggtcttcaagatattaagtagaaagtcaccaagtggaaaaacaagtcacagaatatgtagagcatgttcccatttctgctaaaaaaaaaataataatacaaaaactcagccgggcacagtggctcatgcctgtaatcccagcactttgggaggccgaggcgggtggatcacgaggtcaggggatcgagaccatcctggctaacacggtgaaaccccgtctctgctaaaaatacaaaaaaattagctgggtgtggtggtgggcacctgtagtcccagctactccggaggctgaggcaggagaatggcgtgaacccgggaggcggagcttgcagtgagccgagattgtgccactgcatgccaacctgggcgacagagtaagactccatctcaaaaaaaaaacccacccaggtgcatgcccaactactaccagcgatttgtcacctctgagaagaggagtgggattggaagagagatgtcaagggaactcttttctttcctttttaaaacctacttctagattgtctgcattttctataacaagaattaattaacatattgcttgtgtacttattttctttttcttttctttcttttttttttttgagatggagtctctctctgtccctcaggctggagtgcaataatagcatgatctcgggtcactgcaacctccacctcccaggttcaagcaactctcctacctcagcctcccaagtagctgggattacaggtgcctgccaccatgcccggcaaatttttgtatttttttttttagtagagacggggtttcactacgttgactagcctggtcttgaactcctgacctcaagtgatctgcccacctcagcctcccaaagtgctgggattacaggcatgagccaccgcgcctggcctgctgtgtaattctaaataatcatcaggaccatgaacctgaccatctgtgaaagacagagatgtttcctggcaggatagggtccactgccattgatattggcaaggtgcctgctgctccttagcctgctgtaggtaccagattgaccttgagtagaaccagccttgagagaagaggaaaggagagccaggccctaatcatagggatccccaggggtgtagatgatgttaaggcaacatcttctctgtgtctaagagaaaaagaatctgccctgagtatgaactgacttgtgtgctttgaggtcagtgtcctaaacaggaagccatgaggtgagcagagacacttccctgctgcctggggctgggagttgggaagtgagaaaacatcctagtggccaccagaaccatccagtgggtggctctgaatcctgcattgatttgttgggagactttggaggaggagcctggtgtggagggttgagcctggtgagttggaggcagcagctggttactttccatgcagagcagcttggagttgagtcactcgacaatccaagggcacctgtggaagcagccatgactcatgctaccttcagtttcacatctggaggaggaaatcactgacaaagcaaagcaaggcgacttctgggggctgccgtgtaggattctcccatgtttaaaaaagaaaaaaagattgtacaggatttaaacatagcatttattgcctgtgttcttagttataaaattaatacatgtacataataattgttgtagttagttattttattcagcatttatcctatgtcaggtactgatgcttcaagctttacatgcgttgtctcacttagtgtttctgaccattcagtgggggagatctgttattatacccattttacagatatggaaactgagtctatacacacacacacgcgcgtaaaacacatagaaaaaaatcacccacaattctacccgccaaagtcaaccaacatcctgatgcgtgtttttctagtaaccttttaatatttttcctgtgtagctaatatccaactattttactttcccatatcctgcctttttcactcagctctaaattatgatcctagtcccaaatcatcacatattcttcaataacttaactagtccatatggccaaacattgtatgtttccaatttttccactgttataaaggttgctgttgtgagttatcttagtgggctaaactccgattattcctctaggaagaacatggaatgatacattcttctaaagaaatgttctgtgtttctatgctcttccctctactaggaggcacttgaacggagtggttgagagttgtaaaaacctatttttatttatttatttatttttgagacagagtttctctctgaagcccaggctggagtgcaatggcatgatctcagctcactgcaacctctgcctcctgggttcaagtgattctcctgcctcagcctctcaagtagctggggttatagatgtccaccaccatacctggccaatttttgtagttttattagagatgaggtttccccatgttggccaggctggtctcgaactcttgacctcaggtgatccactcgcctcggcctcccaaagtgctaggattacaggcatgagccaccgtgcctggccagaaaaatctatgtttgagtcccagctctctgctgatctacaactatgtaaacttgggcaagttatgtcccctttctggcccttgcatacttacctataaaacaaggctaaagtaatatttactacctcaagggttgctgtgaggattaacgatgtaattactgtaggtagaggtatcttagtccatttcatgttgctgtaaaggaataccggaggttgggtaatttataaataaaagaggtttatttggctcatagttctgcaggttatacaagaaacatggtgccagcatctgattctggtgaggggcccaagaatcttacaatcactgtggaaggtgaaggggaacagacatcacatgtcaagagagaggaagagaaaagaggaagatgccagcttctttaacagccagatctcttgggaattaagggtgagaactcactcaatcctgcaaacatggcatgaagccattcacgagggatctgctcccatcatccaaacacctctcaacaggccccacttccaacactggggatcaaattttaacatgagatttggagggaacagatgttcagaccacatcaaaagggcttagcaccttgttattaggcctagaaagcatctcccccttctcctgcctcttgaccaccatatctagcttcagtgacactccttttgtgaaatctctgatatctgcgtggttaaaattatgctcttcccccaacctcttttttttttttgagaaagagtctcgctctgctgcccaggcaggagtgcagtggtgcaatctcaactcactgcaaacttcgcctcctgggttcaagcgattctcctgccttagcctcccaaatagctgggactacaggcacacaccgccacacccggctaatttttgtatttttagtagagacagggtttcaccatattggccaggctggtctcgagctcctgacctcaggtaatctgcccaccttggcctcccaaagtgctgagattacaggcgtgagccaccgcacctggcctctttccccttttttaaaaaaagaaggcgaaattcacataacatagcattcatcattttaaagtgtacccttcagtggctttatgtacattcacagtcttgtgcaaccatcacctctagatgccaaacattttcatcatcccacaaggaaaccacttacccattgaccccttatccacagtagtcactgtacttcaaggtttcccatatcccatatccagcgtggctggatccaagggatcaaatgccatcagtaggactcagtttttctgcatctacttgtgttggcttcactctcgggcagatgctttccatatggcaatcccagtggctctaagcttacattagccatcaggtagcaatcccaacagagagagatcgtttcattagaagtttcaatggaagtcatgggactgagtattattgcctcaacttggataatttgcccatggctgaactgattaccatggtgggggagaggggaagaggtggcggtagaatattctgattggccaggttctgggtcgtatgttcattcctccaaattgcattcagaaaatgggtgctggatggggcaaaaaatcaggtgtcattcaaagttcactaggcttagggagctgggctcagaggccagaggcctgatcttgatcttgtcatcacttagcaaatctcctggccattcaggccttcacacttcctgtctgtaaatgggtttatcaccactcattcaagtcctaattattaccagcgctgagaaaccaatactttctttttccatctcgcttgtgtaatttcttcggagaagcatttggatggtctctgaaccatttttaccctgagaaatgggacttaggaaattatgcagccacattttatatccattctggtcatttcagtaattggttctgagacactatttccccgagcaccatcccaagtataaactactatttccatctgtgttactggaggaaactggggaaagacatttgtgggttttttcccccccaggccaaaaaaaaaaagcaaacaaacaacaacaagaaaaactaaagtagagcccaaaaccaatttgttggttcccagcttggcttaggcaccattctaagcatattccactagtccctccatctccaaactagtcattcttgggagctgacctacttagtgcacagcaaaggaaataaacagaaatccagcaagtccatcatttgagaggcccatgctgatgactcagagaatatataaaatggcaggttggccaggtgtagtggctcatgcctgtaatcctagcactttgggagactgaggtgggtggatcacctgaggtcaggagttcaagaccaggctggccaacatggtgaaaccttgtctctactaaaaatacaaaaattagccaggtgtggtggcacaatcgctggaacttgggaggcagagactgcagtgagccgagatcgtgccactatactccagcctgggcaacagagcaagactccatctcaaaaaaaaaaaaaaaaagccaggttgttttgctcttaatcgggttacgtttgaggattcttttggttctaggtgaccaaaacccactgggttcagccaaaagtggatattgttgaaggattctagggtgtctcacagaacacagggccatggttccactggaattcaggaaggggatagagtccattgtgaatcaaggaggtccctcccaccacctctacctcttgactgtttttctccatgtctcctctattcttctatctcatgggagagtgacagaagtcaggttgagactggaatcttaatctcagcaccaaaagctcagggaaggagcctattggtccagcttgggccagatgttgacacctgatccaatcaaatatggagaggggatgtgagttccattgtatcaacatgatcgtgttagtggtccagaaatacttctgagggaaaaaaaggtgtatgttacacagtgatatcaattaaattctaaactatagtgaaatattattgtcatttccacctcttttaaataaatctgagatggtctaacccctagcatagttcagtttctgggtctagattactggggtttgaatcctggccccaatatttgctgtgtgatcttaggcaaattacttaacctgtctctgtgccttcgttttgtcatctacaaaatgggtataataatattacttacctgacagcatggttggagccattaaatgtgttaatgtaagtaaaatgctcagaactctgcctggcaaatagtaaagatttaacaaatagctattattattactgtaaagttcatttcattatgacagattgtttttcagattattcaaaatatagaagatgtttaaaagggaatttctatgataatgggaaaatagggctgaataaccattactaagattgaatatatcattgctattgcccttgaattctataatttgaattcatattatttgaattctagacggtacttttgatttataaccttaaaagctttagtaagggtttcttctaaacagccttatataaaataatagcaattcttgccatcttacctagcaggaaaaaccaattgttttatcaagtttgccagcataagattgaaatttaaagcctttaatatcttagtttataaaagacaagttacagaatgtctctttcctggatgtcttagaattacagtatcttttagggcaggagtctgtgaacctttgcttaaaggactcatggtaaatatttttgtctttgagggccatattgttaaaggaaaggggtcccgatccagaccccaagagaggattcttagatattgtgcaagaaagaactcaaggcgaatccatagagtaaaatgaaagcaagtttatttattaagtttcttaagttattaagaaagtaaagaaataaaagaatggctactccacagccagaacagcagcttggactgctcaactcataatgcttaacagttttttctaaattatatgctaaacaaggggcgaattattcatgagttttctgggaaagaggtgggcaattcccacagctgagggttcctccacttttaagactatataaggtaactgacattgccatggcatttgtaaacagtcctggcgctggtgggcgggtcttttagcatggtaatgcattataattagtgtggaatgagtagtgaggatgaccagagatcatgtgcgttgccctcttggttttggtggcttttggccagcttctttaccgcaacctgttttatcggtcaggtctttgtgacctgtatcttgtgccgtcctcctagctcatcctgtgacttagaatgcctaacctcctgggaatgcagcccaataggtctccgcctcattttacccagcccctattcaagatggtgttgttctggttcaaacgcttctgacagtatggtctctgtcccagctactcagccctgctgtaacacaaaagcagtcatcaacagtacctaaacaaatgggcatggatgtgttctaataaagctttatttatagatgctgaaatctgaattttttgcagttttcatttgattccacgctgaccccttgccccccgtccaaatattcacaaatgtaaaagccattcttgtctcacaggctgcacaaaaagaagtgatgggctggagatggccttggggccatatttttcataccctgctttaggagacagtgcattagcattctgacagcaggcaggggaggtacaagatgactgtctactgcctcttgggttctaacaccccagatgcatgttgaccccctgctgcttctcatcatgcgtttctcttaaaagatacatagtatttgtggggctgggcgcggtggcccacatctgtaatcccagcactttgggaggccgaggcgggtggatcacgaggtcaggagagcaagaccgtcctggctaacacagtgaaaccccatctctactaaaaaaaaaaaaaaaatacaaaaattagctgggcgtggtggtgggtgtctgtggtcccaggtaccccggaggctgaggcaggagaatggcgtgaaccgagatcgcgccactgcactccagcctgggcaacagagcgagactccgtctcaaaaaaaaaaaaaacaaagatatatagtatttgtgtgactttcttggttttgtgcaacagaaaactcaacccaaactgcatatgcaaaaaaaaaaaaaaaaaaaaaggaatgtactaaccggggtttctacactctaggggtggttgaggcaggagtccaaagtctatctgtttatccctcagcttttatcccctccatgagggctttgttcttaggattcagggtttcttttcccccaggggggttcacagcaaagttctgggtctgactacttctggtgtgtatctgatcctatatctatctgaatctgaacgggaagggaacacagtgagcaccttaggccacacctgggtagggtaagccccattaaatttgcaagtcctgggagcggtggtgccagttggttccccaaaggaaacaggtcctattacctaagaaaggtgaatggatactgggaggcaaatcaacaaatgtccattgcacatgaggacatcacactgtgacatttagaatctaaatgctctgaacaaaatgtataggggaccttccaggaacgggaaattgctgttcctaccccctctttttggagaaattgctgttcctcccattggcaaaattcccctcgcaggttccagcttctttctcttagaacagaccttctggtttggcaagcccagtcccacatcgaggtttagttctggacttctgtgcagggtcatggcactcgcttgattgaaattttgtttggggaagcaatgacctgaagagcttacagcctgggtcaaccactcaccactctcaggaaaagcagacagagccaaactttctagctgggctcaaaatagctattttctgacgtgggtcctccatgactcatggtggagttttccaggctcgaggggactgttgacatttactctgctcctcccacgccacagagtctaactttttctatcttcccccaaacataactcattacctccagtttatcccatgtacacttctttttcaccccagttttcttttattttcagcgatccattccagatccaatatctttttttttgagatggagtcttgctctgtcgcccaggctgcagtgcagtggctcgatctcggctggctgcaagctacgcctcccgggttcacgccattctcctgcctcagccttccgagtagctgggactacaggcgcccgccctcatccggctaattttttgtattttttgtagagacggagtttcaccgtatgagccaggatcctctcgatctcctgaccacatgatctgcccacctcggcctccccaagtgctgggattacaggtgtaagccacctgcacccagccctccagatccaatatctttttcctccatcctttgccaaaccaggacttcagcttctggttactggtgcccacttcaagagatgccaggcagggaactctcaggacacataccaggcctgcactggcatatgtattttttggagacaggatctctgtcactcaaaatagagtgcagtggcgtgatcatggcccactgcagcctttaactcctaggctcaagtgatcctcctgcctcaaccttctgagtagctgggaccactggcatatgccaccacacctagctaatttttcaaaattttgtagagatggggtcttgctatgttgcccaggctgatcttcaactcttggtctcaagcaaccctcctgcctcaacctcccatagttttgggattacaggcatgagccactgcacccagcctcggactgctactttagaccccactttcttgtccaggtgtgatcctgggtgcgtgtgcccagagacgccctggctacctgggattcatccatcaaacacctggtcattcagccaattctgtgcgaacagcaccttcccggctgtcccaccctctgcaaagatctgtgatgctggaaagttgtgtgtggctaagtcggaagaagtgaagttcatctgcataagtgcagtagtgtatttattgatttttattcttattttttatttttatttatttatttgagacagggtcttgctctgtcacccaggctgtggtgcagtggcatgatctcagctcactgtaacctccaccgccttctgggcttgagcaatcctcccacctcagcctcccgagtagctgggaccagaggcacacccaccatgcccggctattttggtttttgtattttttgtagagatgaggtcttgatatattgcccaggctggtctcgaactcctgagctcaagtaatcttcccgcctcggcctcccaaagtgttgggattacaggcgtgagccaccacgcccagtccagtagtgcatttactgatagcacttactgcagctattttcttttattgcatttactgcattcctgctatgtcccaggctttgcacacattagtaggcgttcgatcctttaacaattctttgaggcagtagcaggtcttcctatttctatacttgctcccttagtagatcacactctcatgggaaacacagtgacttttttttttctttctttctttttttcagacagagtttccctcttgttgcccagtctggagtgcaatggtgagatcttggctcactgcctcagcctcccaagtagctgggattacctgccaccacgcccagcctgattgtattttttaaaattaaaattgaaataccatcaataggttgaccactaggactaaaatccaaacttttcagtgtggcctataggccgggcatcatggggccacttcctgtctctccatcttggaacaccccttcccttcctcattttgctccacccacatctgccttttctctttcttttagagacaggatctcactgtgttgtcacctctcacagcttctgcactcgtggatcctctatctgaagcattcttccccctccgtcttcccaggccagcttctgctggtcattcagtgtcagctcaaatgccactttctcatagaggtcttctgtgaccccgctatctggaggagtccccgggatcaatcactgtctacccccgtaatggcattttactctcttcctagccctgtccacctaaatgatgttgtttgtttatcttttggcttgctgtctgtcttcatcaggaggatggatgtttcatttctgcatgcctagctcctagaatattgcctggtgtgtggcgggcatgttgaataaacaaagagcccccaaatgacataggaggccatgccatgtgccccagtccctgcagaggagcgaccatccaccagcagaccctgtgtctttgaaaggaattccagagagagtaaaaatcagtgcctatgaaaagtatcccaactggctgcaccattgcctagcttttgtgctcagtgtttttggttttgttttttcgacatcattggcttttaaagccaggtcaacctttggacttgaaccctcaggttttgcatctcccgctgcactgctgggcagtcgacccttcccaaaccaccagttctagctgagacacacacgaggttctggatttttgctccaccagcaggtgatcctcttcatcttccattgcaggcatctttttctttaattataaaaataacaccatactccactctcaaggaagcactcataactccctaccctataagtgtgggctgtgtatagtgacttccttccaaagaggaagtgaaaggagaaactttacaatggagaaacctggcagacactccctcagccaggggctcaaggtcagcatcaacagtgccaactcatcttgatgggatgtaccacggatgtgaagtgatgagaatggtggccgggcaccatggctcacacctgtattcccagcactttgggaggctgaggcgggtggattacctgaggtcaggggtttgagaccagcttcaccaacatggcgaaaccttgtctctactaaaaatacaaaaactagccaggcatggtggcacacacctgtagtcccagctactcgggaggctaaggcaggagaatcgcttgaacccaggaggcggaggttgcagtgagctgagatcatgccactgcactccagcctgagtgacaatatgagattccatctcaaaaaaaaagaaaaaaaagaagaaagtgatgagaatggtgacttacctctgcagtcttctctccaaactcacaacttgtctcaccatcagaaaaactcaaaattaaagggtattccactacaaaatacctgtgcagtaccccttaaaactgtcaagggcaggctgggctcatgcctgtaatcccagcactttgggaggctgaggtgggcagatcacctgagttcaggagttcaagaccagcctgaccaacatggagaaaccccgtctccactaaaaatacaaaattagccaggcgtggtggtgcatgcctgtactgccccctactcgggaggctgaggcaggagaatcgcttgaacccaggaggcggaggttgcagtgagctgagatcatgctactgcacctgagaaactgtcacagtgtagaagagtctaagaagacacaaggactgaatgtcatgcactgtcctcgatgggatcctggaatggaaaaagaacattggcggaaaaacaaggaaatctgaacagagtatgcattttaatctttttttaaatcccctaaggatttccagtactgatgctttgcctttgtgcttgagatccctgtttagagccacatctcccttctggtgtggattttcagtccgacatgaatgcttccagatttgcttccttccttcttctgccatgatctgactctccctctgacttcacattgaactggacccgttcacgcctgcacacatcctgtttttcccctggctgctcttccctgcgtcccccctccgcagaccaccctcattcagatgaggatatatcccaccctatttcttgggcttacctttctgaatgaaaataatgttcctggtgcaatttatctctcctgtcaaatttccagcctgcagggaattaaatgaggcacatgattttcaggctaagcagtttttaaaaactgaaatattactttagacaggcccaatttattttcctctggattctcatcattttaaccccgccaagcacatggttttaagcagctccatctgctcctctaaccatccttgcgtgacctgggcccttgactgacttctgaattggtttgtaaattggaagaattagggagtcggttaagatgcatgaatcatagctcaggatagatttataattgtctgttttcatgaactcattctgagattgcagggatgggggatatttcagaacaaatggaccttgagtaacagaatgaacctacagaagtgccgaaaaagatttgttgtttatgcaattttaaccgggcaattgttgttattataggtttatcaatttccacaattttaattccacagccctaatgatttgctttgaattaggaagtatatactttattctctcatatggtcccaaagggccttagaaagcaatcggagcccttctgcttgtcattggaagaaatatgacagcatggtttggtgattcattgaaggtcactttgaagtgttggggagaggacactgagtaatgtaaaatgacattacaatttgttaaataatttgccggaactcttgtgtcatctctttcaaagtctcaccctggaaataacacacacgtaattcaaatgcaatctttctggaagtcccacctgggaactgcagtcccaatctgtggcaaagtcttgtgaatatccttaatgtgataaaactttgccttagacggagtttgctttttggaataaccaaagtcattctgggccaaggtgtttgaataaagtggttgatcaaatgaaatttaatgtaaagttattttaactgcttttcttgagtaacgcataaactgatttgaaagcaacaaagaatttgtttattactacctctccttattccagaaaggacttaatgatcttattggagccttaaaaaagttttaaaaggctcaagaaatgttggtaaatttccttttttttatcttttttttttttttttttttttttgagaaggagtcttgctctgttgcccaggctggagtgcagtggctcgatctcagctcactgcaatctctgcctcccgggtttaagtgattcttgtgcctcagcctccagagtagctgggattacaggcatgcgccaccacccctggctaatttttgtatttttagtaaaggtggggtttcaccacgttggccaagctggtctcgaactcctgacctcaagtgatccgcctacctcggccttccaaagtgctgggattacaggtgtgagccatcacgcccggcctaatttacttttattattattattattattgttgttgtttgagacggagtttcgctctgttgcctgttgccaggctggagtgcagtggcgtgatctccacctcctgggttcaagcgattctcctgcctcagcctcccaagtagctgggactgtaggcgtgcaccaccatgcccagctaagttttttgttttttgttttttgagacagagtctcgctctgtcacccaggctggagtgcagtggcatgatcttggctcactacaagctccgcctcccgggttcacaccattctcctgcctcagcctcccaagtagctgggactacaggcatctgccaccacgcctggctaattttttgtattttttagtagaggtggggtttcaccatgttagccaggatggtttcaatctcctgacctcgtgatctgcccacctcggcctcccgaagtgctgggattacaggcgtgagccaccgcgcctggcctacttttattatcttaatatcactcttctcatttctcttctctaagcctaatattagtatttgtggacattgcaggtgggacacaagacctttggtgcttctcatcttccaagagggcacagaatgggatggtgtatgaggtgggatattcccagccaagggagttctgggagggaggtgaagttggggcaaagaattcccatgggctaatgtcctctgtgcttccccaaccctagttccagctgatgtggaattctgagtttggctgctttttcttttgttgatggtggtgatggtggtggtggcaatgatgatgatagtgatgttgatggtggtggtggtggtgatagtggtgatggtgatgatgaaaggggtggtaatgatggtggtgatggtgatgatgacagtgatcgtgatgatggtgatggtgatggtggggatagtaatgatggtgataatggtgatagtgataatggtgacgatgacagtgatgtgctagtgatggtgataatgacagtgatggtggtgatagtgatagtggtgatggtgatggtaaagataatggtgatagtggtgatgattatgatagtgatagtgattatggtgaggatagagacagtgattgtgataactgacattcaccaagtcctcactgtccttatgatgtaccaggcaccacattaagagccttatatacgatctgtcattcaatcctcactgcatccaagggtaccctctattattatccccagttaacaggtaatgaagactgaggattgggaaagttacataactcacttaccagccacacaactagctattatgaaatgaacaaatattacaagctaaggattaatagacccactttacaagggaaatttttttttttttttgagacagtcttgctctgtcacccagcctggagtgcagtggtgcgatcttggctcactacaagctccgcctcccgggttcacgccattctcctgcctcagcctcccgagtagctgggactacaggcgcccgccaccacgcccggctaattttttttatttttagtagagacggggtttcaccatgttagccaggatggtcttgatctcctgacctcgtgatctgcccgcctcggcctcccaaagtgctgggattacaggcatgagccactgtgccaggcccacaagggaaattttttaaagtggaaactcagagaatttaaataacttgtccaggggcacaaagccaggcaggggcagagccaggcaggggcagagccagcctttcaccattcaccattgctggctttgaacatgaagcaaggggccataagccaaggaatgtaggtggccaaggaatgtagaagctagaaaaggcaaggaaactcattcttccttagagccccaagaaggacaggcaatcctgctgacactgttaccaaaacaccaggggattcgtctaggtcctgctgctcactgcacagaaggccgacactgagacaacaattattgctaaggaaggaggctttactcaggtgttgcagccaaggagccagtaactcagtctcacatccatctccctgaccaactaaaatcaagggtttatacagcagggaagagatgtaacaatgtgtaacaaaacaggaacttgggacgggcaaggaagcaatcccgatgaatgaggggtctggcatctcattgtctggatgctgtaatctggtgagtttcagttctttgatacttatttgagaggcaaggaattccctcctgaggaaggaactcagataaaacaaactttaagtttcaagagttaagaccagaaaggtcaatttctatgtttatcaagaaagaaaaaaactgtctatgggactacttgtgttggtttcaacaccctgattttcacgtccgttgggcctctgtcctccagaactataataaatgtgtgttgttttaagccactaagtttgtgtttatttgtaactgagacacagattggcatttttttccactgtcacccctcttgccttgtatcatcagttgttagtatttgttttagctggggaggcagctggagcatgaagtcaacaggaacaatgatgatctgcagggaggaaagccctaggatggcgggataatccccattgtgccccctcatcattagccacagtacttggctggcatttgagcagagtggttatcacagcagcgttcactctcctgcccccgggttcctgttcttccctctcttcaagagcactcaatgcatatctctccaaaccagtgcttctccacctttaatgtgagtgataatagctaacattcagcacactgtgctcaatgtgtgaatcccctcacttaacctccataccaacccttgagatagatgttatcattatccttcccatttcaggaaactgaggcatagagtgtttaatgaagaatcacctgcttgaagggcagcttgctgggtctcctccagggagattttgattcagtaggtccaggagaagcccaggtagatggattttttttttttaatcacacctaggtaagtctcatacctgtgccctgggagcacaataaaaaaactctgggtttaggctgtgtgcagtggctcatgcttgtaatcccatcagcttgggggtctgagatgggaggatcgcttgaggccggtttaagatcagcctgggtgacatggtgagactccgtctctacaaaattaaaaggacgtgatggtgcacacctgtagtcccacctattcaggaggctgaagtgggaggattgcttgagcccagaagcttgaggatgcagtgaggtatgatcacaccactgaactccagacttggtaatagagtgagaccttgtttcagataaaaagaggaaaggaaagaaaggaaaaaagaaaggaaaggggcaaaaggaaatgggaagggaagggaagggagaaaggaaggaaggaaaaaagaaagagaaaggaagaaagaggaaggaaggaagggaagatggaactaaggaaggaagaaaggaggaaagaaagaaaaaggaaggaaaagagagaaaggaaagaaggagaaagactctgagtctaaacccgtggttttcaacaaagggtgattttgtcccccaggggatacttgccagtgtctgaggacattttgggttggggagaggatgctactggcagccagtgggcagaggccagggatgctgctgcacagcctacagtgtttagcacagcccccagcacaaagaagcgtccaactccaaatgtcaaagcactcacaggctatggagcagcagtgagatgaagctcttgctctagccttggctcctgcactcagaatgagtcttcagatgttctcagattacacttccagaggattaggctggaatttgtctttcttgtgaaagaaactctttgtctcaagtgttgggtcctcccaggattcctccccaaatgggctatcttagtttctcctctactcctcaatctcacctcttcaccttcatccttatttcctatttcactgcaaaagtcaagggcccagcctggccaacatggtgaaactctgtctctaccaaaaatacaaaagttagtcaggcgaagtggcaggcacctgtaatcccagctacttgggaggctgaggcaggagaatcacttgaacccgggaggtggaggttgcagtgagccgagatcacaccactgcactccagcctgggagacagaatgagactccatctaaaaaaataaaaataaaaaacaaaaaaaaaaagtcaacggcatcaaatgctctcctctgctccctttgtcatttctttgtacttggacctcttagatcttggacttctatgaggtcacagaggaagagcatgtttccagaaagaaattcctacaatcagccagttctgcataatcttgtggttcacgagaggggaaggaccacagcttctccttgagtccacctgggaagggcatctgtggacaccttctctctgcctccctttccttcctcccagttccttcctagagggatggtgtttgatttctgaggccctggacatttcttccagctcatcattcaggttgttcagagcatttggaagacgagcttttctcttgccaacactgaccgcctcttgcgggaagatgtcgcagcattattatttaataacccgtgtctttcttcagctcatcaaagaccttccagctccagataaggagtcggggtagggagtaaggaaacaaagggatgagggtacaggaaaatcccagctgccccttatcacacaatcaatatattcaatcaatatagttaatagcaatgtgccaatgtcagtttcttggtaaagttaacaaatagtggaaattgagtgaggggggtagaggggaattctgttggctctttgcaacttatcactgcccatctccagttttctggtgcctttgctcagatgctgctgtggagtcccctccacagagatacctgtgtccttctccccaccttcctggctcccaacagactacactgcctgagagagctgaagtcaggcattcattctgcaggggattctgggtcacagctgagccagtcctattaggatttagggggcagccgacctgtggggcctgcaccgcacacactccttctaagggtttcctcacagtccctgctgaaggggagggtctcgtgtgacctgtggctccacccaggttgaacgtgctgaggccctgaccaaaggcagggccacccataggctgccaggggctggaggtgggacgagagggtccatcagaagtcctttcatgagagcagttaagagggaagcagaagagtcctgaaatggagaaacacctcagggagacagaatctttgaggaaggggaaggtatcagggagaaaagaaagaaggagatgaatggagggtcccaggatggtgaacaatgacttgggacttgggagcacttgaaatgtggccattccaaattgagatctgttcttcctttatttagttttgagacggagtctcactctgtcacccaaactgtagtgcagtggcgcagtctcggctcactgcaacctccatcccccaggttcacgtgatccttgtgcctcagcctcccaagtagctgggatgacaggcacgtgccaccagacgtggctattttctgtatttttagtagagatggggtttcaccatgttgtccaggctggtgtcgatctcctgacctcaagtgatccacctgcctcggcctcccaaagtgctgggattacaggcgtgagccaccgtgcctggcctgaattgagatctatttaaagggtaaaatatacatactggacttaagacttccatactccctccaaaaaggatataaaacatctcattcgtatctttaatatattgattacattttgaactgataatcctttagatctattggattaaataaaatatgttagtgaaattaatctcgcccatttctttttatctttttttttatttttaagagacagggtctcgttgctatgttgcctaggttggacttaaactcctgggctcaagtgatccccctgcctcagcctccagagtagctgagactacaggcatgtgcctccgcacccagctctttttacttttttttttttttttttttttttgagatggagtccgttctgtcacccaggctggagtgcagtgactcgatcttggctcactgcaacctccgcctcccaggttcaagcgattctcctgcctcaaccttctgagtagctacgattatagtcacctgccaccatgcccagttaattttttttgtttgttgttcttgttgttcttgttgagacagagtctccctctgttgcccaggctggagtgcagtggcacgatctcggctcactgcaacctccgcctccccagttcaagcaattctcctgcctcagcgtcctgaatagctgggattacaggcacacaccaccacacctggctaatttttgtatttttaggaagacgggctttcgccatgttggccaggctggtcttgaactcctgacctcaggtgatccaccgcctcggactcccaaaatgctaggattacaggcgtgagtgagccaccgtgctctgccacggctaatttttatatttttagtagagatggggtttcaccatgttggccaggctggtcttgagctcctgaccttaagtgatatgcccaccacccttggcctctcaaagtgctgggattacaggcatgtgcctccacacccagccttttttattttttagaatgtggttcctggaatgttcaaaattacatatgtggctagtgttctatttcaattggaccgcactgatctatacattctctcttttatgacccccgatttacagataaggaaactgagtctcaaagaggttagggcatttgccgaggtcggccgttagaaagatgccggaccatctactcatgtctgcttgacgccaatgcctgcgtcttcacgtgctgttggtgcgtcctcctgaattacttttgtgtcctttgacacgtcagatgtggctggggaaacagaaactcgcagaagttaaaaaaatgtgcttgaggtgccactggagaataacaatcatagccaggatgtgaagcctgtcagtttcctcagccgcaaattcttccatgtggggcgacctcacagagacgggatgtatgggacggcggagtgcaaagaaaggtatgatcgctcttgggggcccagtggcatcctctccacgaggcaggctgggagaaatcgagcagccaggagcttctgggttaaaagcagtgacttcatctctttgggaaacggtgactcattaaaagcaacgggcggcttcccattacattcacgttatagcaagaaggcgaggcacttggtgcatcccgtaataggatgcttgggggttggaatgagcttctttcctacatgaatgattgatgacaacgaagtctagagtgccaccaggagcctttgaaatgcattcagatattggctccctggtcatggggcgcagatctattcccttgggattcaagactctcttttgggtcaatagcagcaactggcttcttgacaaaaggctggagggggccccctctagattctcttctcagggcaggcatgggtctgttggagctgcggggctgtggtctcacctagaggggccaagagatggtccccatgaccatgagtctgtgttcttcaaatttgatggtggctccaattttattttctccccagtgttagtctggcttctttcagggaaaggcactgtgatggcaggaataatgctactgaccactctttgtgatgtctaggcactacaccaagcacatgttgtatacagttggtcctctgtatctgtgggttccgcatccttagattcaaccaattatggatggaaaatattcaggaaaaaaatccacaaattaccaagaagcaaaactttgagtattatgctgaatctgtgtaaatgaagtgatgtgtaggcatcctattagggattataagtaatctagagatgacttaaagtctacaggaggatgtgtggggcttctatgcaaatatttcaccctgttatatccgggtcttgaacatccaaggatttttttttttttgagacggagtctcgctctgttgcccaggctggagtgcagtggcgcgatctcggctcactgcaaactccgcctcccgggttcacgccattcttctgcctcagcctcctgagtagctgggactacaggcgcctgccaccacgcccggctattttttttttttttttttgtatttgtatttgtagtagagacggcgtttcaccgtgttatccaggatggtctcgatctcctgacctcgtgatccatccacctcggcctcccaaagtgctgggattacaggcatgagccaccgcgcccggccaacatccaaggattttggtgtccaaagggaggcctggaaccaatcccacacggatactgagggacaagtatatcatcccatttcatccctacagcagcaacttcatgaggcaggagttattagtcccattttacagaagaggaaactgagacttagggagatcaagtaatttgcccaggtcgcacaattagtgatagagccagggcttgaagcgacgtctgtcttaagccaatgacccctgcagattattagagcaactgttctccacaacagtgtaagcctcttgctagaagctcaggtccacaagggcagagatttttgtctgttttgctcattgctccttccccattgcttagagcagggtctgccacgaagcaggttctcaatgcatagttattaaatgtatataagagcaaacatatgttacagagaactttctgtatgcttgtcacttacatgaatcacctgtgagatgggtatgcttgttccccaatgttgcagatgaagaaactgaggtgcccagagtcactgatgcatggctcaagcgtgagagctggactctgaaacccaaaagcccatgcccagaaccactcccctctcttgccctcttcaagggctggcctggctccccatggtgcctgcacacgccaaccccttttcttttctctcttcttaattttaaatctattttgcaaatgtaacatctgaccattggtaaattgctaaaatttcaatgaatatagttaataacaatgcaccaatgtcaacttcttggtaatgttaacaatagtggaaatttaatgaggagtagaggggaattctttatgctctttgcaactcttcttaaattttttttttttttttattaaagatagtgtctcactctgtcacctaggctggagtgcagtggcaccatcatagatcactgaagccctcaaactcctggacccaagcgatcctcccacctcagcctcccaagtagctgggaccacagctgtgtgccaccacatctggctaatgtttacattttatttttgtagagatggggtcttgctctgttgcccaggctggtcttaaactcatggcttcaagtgatcctcttccctcagccttccaaagctccgggattacagacatgagccaccacatccagccacattttctagaaatataaaagtattaaaaaaaaaaagtatatttaaaaacccaaacaagagaaaaggacatattaggtgaaagttgattctcccccaacactgactccccctacctgagtccctcatgtccttccctaaatgcagcggctgtgacccaagtatattccaatgactgaaatgaatagcacccccacccccagcccttcatttaattgcctttgttatatgagctgggttgaaataatcgctcaaaatggctgattcctctttgagtaggacttaacccatggctgagaattgtccttctagcttgagttctcactgaagtttgaatgagaaccgtttgttgagggaccctgggaaccacatcttgccaagtcattttacatcctatccaacacaggtatgaggctgaccaaaacgtcgtttaagacctttccaacgcaaaggactggaattctattctacaacaggggatgggataggtacccccagtggtactttcatgcttgtaccatcaaacagcaatgaatttcccttcaggaaagctacgcattttctccccaattatcaacctttttgattacctaaaggagaaagccacaatttggtgctagctttgtctttaatgcccctagtacttgctgattcaccttgttaagaaagaaaattcaagcttcattctgaaccttaagcaggctatagtatttagcaagaatttaacagtattgctttgtttcctcaggtttattttcatggctattttctaattatgccaagtaagagtcatttattgtctgtggatgtcatgggacatttccgttagggagtttgagtaaaaaaagtcaatgtcggccaagcgcagtggctcacgcctgtaatcccagcactttgggaggccgaggtgggtgggtcatgaggtcaggagatcgagaccatcctggctaacatggtgaaacccgtctctactaaaagtacaaaaaattaggctggtgtggtggtgggcgcctgtagtcccagctacttgggaggctgaggcaggagaatggcgtgaattcaggaggcagagcttgcagtgagccaagatcacgccactgcactccagcctgggtgacagagcgagacgccgtttcaaaaaaaaaaaaaaaaaagtgaatgtcatgacatactgagtggtatatgacagagtacagaatatgtagctggggtaaattctatgcagtgttgagagttttggaaacactgttttgtagctcttttgaccttagagcatgggcattgggatcagatagatctgggtttgagtttcatttctaccactcattatagcactgccccaattgccccttagaactgatgtttacggtgttttgttttgtttgaataaacacaaaaatttaccttcctaatcttttgtttttcttttttcttttatttttgagacggagtcttgctctgtcacccaggctggagtgccgcggtgcgatctctgctcactacaagctccgcctcccaggttcacaccattctcctgcctcagcctcccaagtagctgggactacaggtgcccgccaccacgcccggctaattttttgtatttttagtagagacagggtttcaccgtgttagccaagatggtctctatctgaccttgtgatccacctgcctcagcctcccaaagtgctgggattacaggcgtgagccactgtgcccagccccctcctaatcttaaaattttagaaagttacattcattttacctgagttcctttctcaagaaactgacctctcggccttccagatagtattaaggaattgaaatttaccagatcactatatgtggacaatgagatgccagactcctcaaccatcacgattgcctaaccaaccacctgcatcctgttgaccagattctcttccttaccccttcctaataatttcccagaaaaaaaaaaaaagaatagggatgtatcacaatgtaacacatggttgcgtttcttccttgctacctctaattttagtgggttgaggagatggatttgagtctctttccatctcctcagctgcagcacccaattaaagccttctctggcaatactcattgcctcagtgattggctttctgtgcagcgagtagcaggatctagacagaacccttgatgttgctgcaacaattgagtgagtgagtttgaccaatcacttatgacctctctaagcctcattttattaatctagaaagagaggttgatatgagctagatcatggctccggtaaacacccaaaatgagcaagctctggggccagtactaggcacgtaaagttataaagcagaagtaaaggcagaggttgtgcagggcaccctgagcttaaattcctaccatgacccctgattggaaaagatgggctaggaaaggtatctctctggtccccagcagtttaaccctccaagcttgtatttaaactagaagtttttagatcaccagccctcatcctctatcacctccaccactcctgtccctgggtagccttactttttgttttgttttgagatcagtgattaaacctgctggtgcataccagggctgcccgggtgctcagctcttgtttgctggtgccaccgctcaggaagcatgcatctccctggggtggcatttggggatgggaagatggatttagctgcctcttcccccagaagtgactcagctcctggaagctcaatgacagcagtggcagttggagccctggggacgtctgtgccttcatgctttgctgtctccacacagcaagcaagctcttgcttggaagtgtgcgtgagagacttgttgtctctagccagcttgaaatgctcctcccgtttcttcccgtgatttgtcctcctcgtggagacattccttggcagctgtcggatgcctgccttctagttggaaaatgtgatcaagaaaggaacagtctagcaggctaatttctatcacacaagttcagactggaaagaagctgactgtgtgtgatattcatttattcaggtcctgtatcagcatttttcactctgatctgaagacctccttcattaaggtccctggacacaacaccccaacccaggtttatcctaatccttggaggtggaggcagggaattgtttcttaaacaacctccctagatattcaccttgcccactgatgtctgggaataactactccctctgtgtctaaagcaatacagtctactcagttttgttatgatgatgatggtacttacgtagggaggtagttcttacatgaatatggttgattacaacaagagctttggagtaagagagatcttgttttaaatctcacctccatcacttactccctttcctgagcctcgacttccccatctatgaaatgggataacagcactgaccacccagggctgttttgagaatcagataaggtaatgcacaggtgctggcatgtgataaatgctcgataaatgttagttattatcgttactgggtaaacctggctttcctaacttttaaactggagagattacagtataccacccagggaaggggttggccaactttttctataaagagccaggtagtgaatatttgaggcttcgtgggccagggagtctctgtggcaactactcagtttttgcaatgcaaaagcagccataaatgacatgtaaatgaatgagcgtgatcagtgtccagaacaactctacttacaacatcaagcatggggctgcgcttggtcccctggccatagggtatcaacccctggcctaaggtattgtgcagactaaatgagatgagattcattcctgtaatcccagcgctttgggaggctgagatgggcagatcacttgagctcaggagttgggagaccagcctgggcaacatggcaaaaccccatctctacaaatagtacaaaaaaagtcactgggtgtggtggagtgaacctgtaatttcagctactcgggaggctgaagtgagaggattgcttgagcccgggaggttgaggctgcagtgagccaagatcatgccactgcaatccagcctggaagacagagcgagaccctgccccaccaaaaaaaaaaaaaaaaaaaaaagatgaggtttacaatgagcccaacacagtgcctgatgcagagacagctcatggcaagaaaggattctaacgatttgtatctgattcaagctttaggcttcgttcctttctcttggggaagaaaaacatccttgagcaagacttttcaacataggtctttgttccattctttgccccaaatccaagctaagcacctggagcctggcaccaccgcctccatcctcccccggggatggaggtaaaatgccagttcctgggatgtgattaattctcttcgtcccacgcctcgccccagggtgtgttgccgttttcagcatctgtcccatggaaatcaggttgcccatctgaactgtgatgagaaaaacaaggatactcatatcgtggggtggttaactacgcactttcgcaggcacaaatgcattcagccctcaccaggaggctggattacgtggttaaggtcacgtggttgtggagtggaaggggggtggggggggagagagagagcacaagctgggtttgaatactatctctgcaatgatctggctgtgtgatgttgaacaagtcactttccttctctaagcctcagagtcatctcagtaaaatagagattaaatgagataatacacagaaagcctccagcacaggtaactattgaattcttgtacagaggaggaaagtgacgcaaagacataaagggactcattcgaggtcttgcggctgatgactagtgtcaaatgaggatttctgacactgcccccgcctagctgttttttgccagaccccacttcccccatgcacttccctcaccccctggtgactcccgctgggacccctgctgcttccagccaaggctgtgctctgtgtgcaggatctcaagcccctggagagagtgacattgttgtcaggaagcttgcaaggctgtggccattcattcttgtgggtttgtggcctcctgaagttcatgtgcatcttaaaacatcagaatgtgaccttatttggaaataaggtctttgcaggggtaattcagatcaggatccagatgagctcacattggattagggtgggccctaaatctaatgagacagaaaagaagacacacagagccacccggaggaagaacctgtgaaaacagaggcagaggttgaagtgatgctattacatccagtggcaaaaaccgtaattacttttgcaccaacctaatactacaaaccaaggagccagcaggggctgcaagggccaagaaaagatccatccctagagcctctggagagcgcgtgaccctgccaacaccttggtttccgacttctggcttcccgaactccaagagattaaattccttttgttttaagcctccccactggccatgaattgttatggcaccacgcttgactctgagataggaatgaatggggggtgtcggacttagaacagctgcctggaccagaggcagctgtgagggtcaaaaagcatgaatttgaagccagacctggactcagctctttcccttgccagcgctgagcctttgtttctttgcgaaaatgagaacctactgaacttgctggcttatggcgaggattaaaagaggtgatgggcagagcaggtgcggcggtcataacgagggcaattgcaagcatatattaaacgtgacgtgccggggtaattcatccctcacatctgttttgggtggtgggctcccttacagaggagaaacagagctgctgagaggttaaccaactccccaaggccacacagccagggaggggcagaactggaactcaaacccaggccatctgatctggtaaggctggtcttctagcttggtagcatcacagcacacagtagcactcagtattaattatctttttttttttagacgtagtctcactctgtccctcaggctgtagtgtagtggtatgatctcggctcactgcagcctctgcctcccaggttcatgtggttctcgtgcctcagtctcccaagcagctgggattacaggcacctgccagcatgccaggctaagttttgtatttttagtagagactggatttcaccgtgttggtcacactggtctcgaactcctgacctcaggtgatccgcccgcttcggcctctcaaagtgctgggattacaggcgtgagccaccgtgcccagccaatattaatatttcgatcctattcctccctccttccctcctttctcaagcctgtcctcactgcttcaatcccaggagccaccacagcatggtgtcagggacagtagtaggacccgaaattggattccaggggccttgaagcataaccagatggccccaggagatctttaggcagcacatcacatgagacatttcctacaaatcctctgcaaacagacatcgctccctctccccaagccacagcctgaggtggctcctctgacctctctccttcctgcttctctttgacactccctcctctccctccactgtgtctcccttttcacccttccctggcagaggctcggccaggtggccagataatcttcgggacccgccatctttagaaggcaaggaggaggtgattgtgaatctctccaatttcatgtttttcccattcacccacctccactctcttcctcccacttatacagttgttcagtgaccccctctccaacccaatagcagattctgcactatttatgttctgcacttatctatttcatgaagtattgttgctccctgaaaatataaaagaagcacacattgctctgagatgctgaactcaaagaggagaaaatcttcaataggctgatgactgacaggtcaaatattttcctctccccatataattgcttggccttttccattgcctttgttactgtttctcttgaaaactgggagttgtcaggccaggcacggtggctcgcgcctgtaatcccagcactttgggaagccaaggctggcagattacctgaggtcaggagttcaaaaccagcctggccaaaatggcgaaaccctgtctctactaaaaatacaaaaaattagccaggcgtggtgacatgcgcctgtagatccacatacttgggaggctgaggcaggagaattgctggagcctgggaggcagaggttgcaatgagcagagattgcatcaccacgctccagcctgggcaacagagcaagacttgctctcaaaaaaaaaaaaaaaaaaaaaaaaaagggggaattgtctcagagagaatgaagagaggccattcatttcaatgtgagaatcaactccagagaattaccttctttctgtctctttagcaaaataaggtgttttgattggtggaggggaagcagataattttggcacatggaacggacacatcacggggtaggtaatggaaaggaactccaatttactgagaatccaacgtctgctgaacaactcagggccgggagagtcccacaggtggacaaatgcatcaggtggactcctagaagagggcgctgttctatctagagatccaagcaggtagggactgacttcagggaagcctgcaaatcacagcgccctaaaccctgtgcacgtgtgcaagggccagggccccaggacatagaaggcagttggacaggtagaaacaggacaactttctctgggcacagtgactcacacctgtaagtaatcccagcattttgggaggctgaggcaggaggattgcttgaggccagaagttccagaccagtctgggccacatagcgagacctcatctctacaaaaagaaaaaagaagacctggtgtggtggctcacacctgtaatcccagcattatgggaggccaaggcaggctgatcacttgaggtcaggagttcaagaccagcctggccaacatggtgaaaccccaactctactaaaaatacaaaaattagctgggcatggtggcacgagcctgtaacccaagctactcaggaggctgaggcaggagaactgcttgaatccgggaggcggaggttgcagtgagccgatattgtgccactgcactccagcctgggcaacagagggatactccgtctcaaaaaaaaaaaagagaaaaaggaaaaagagaacaactttccaaatcatgggtataaggtataccaactttcattattccttgagtataaggaaaaagacagacgcccttgtagaactgaggtgtggggtgggctccatcttgggggcgggtgtggaaggaattagcagatacagatgatgtgatggtgtctcagggtacgccaaaaacatctcctgccccgagtctcccccactaccgatcaaaggccttgaatagcacatcacttatatctcagccattcaccctagaaacatagcccgaaggaaccctgtagatgtgtgcgaagttttcactttgagaacgttcttcactggaacattcttacggtgaaaataattcttacatttttttcctcatgattacagtggggaaaaaataggaaacaacctacatgtctgtggattgcttaagtgcttcgtgatacagccacaaatagaaaaccgccccgccttccatgctgctgccgaggaagaccatccaaggacaggcaggagcgctcaaggcatgttgctaggtgaaaagaacacataacgaaatagtgaggtcctaactttatattagaaaaataagacctacatcacagtggatatatgtatatgcatataatagtataaatatacattcacacgcatatatattaacattttaactgctaacattttagtggactttttcagtctttataaagtgtgtctgcccaggcgcggtggctcatgcctataatcctagcactttgggaggctgaggcgggtgggtcatgaggtcaggagttcaagatcagcctggccaacatggtgaaaccccatctcaacgaaaaatacaaaaattagccgggtgtcgtggcataaacttgttatcccagctacttgggagactgacgcaggagaatcactcgaacccgggaggtgaaggttgcattgagccaagatcgtgccactgcactccagcctgggcaacagggcgagactccgtctcaaaaaagaaaaaaaagtgtgtctgtgtatattacacatattatatatataaaaaaccacatatattcatatatgtatatacacacacatatttatatatccgtatgtatgctcacgcttgtaatcccagcacttcaggaggccaagttgggaggatcgcctgaggccaggagtttgagaccaaccttggcaacatagtgacacccccatctctacaaaaaaataaaaattaaaaagttacctaggtgggcctgtagttccagctacttgggagactgaggcggaagggtcccttgagcccagggttcgaggcggcagtgagctatgattgcaccactgcaccccagcttggatgacagagtgaggcctagtctccaaaacaaatgaaaaaatacttaacactacttggtagtagtattactataagataattatgataaaactttcttctgcctagagtcggctggtcttagaggcttagaccacagggcaaagtggtcgtggtcagggggagcagaggcttagaatctgggaccaggcaggagctgacaaggccttaatcaggcttttgtgagcccacttgtgagcctccactagccatcataacaaagttcccagccaggcgtggtggcctcacgactgtaatcccagcactttgggaggttgaggcgggcggatcacttgacgtcagcctggccaacatggtgaaaccccatcactactaaaaatacaaaaattagccgggcctggtggtgtgcacttgtaatcccagctacttataaggctgaggtgggagaatcgcctgaacctcagaggcagaggttgcagtgagctgagattgagatcacaccactgcattgcagcctgggcaacagagcaggactgtgtctcaaaaaacaaaaacaaggccgggtgcagtggctcacgcctgtaatcccagcactttgggaggccgaggcgggtagatcacaaggtcaggagatcgagaccatcctggctaacatggtaaaccccgtctctactaaaaaatatacaacaaattagccaggcgaggtgtcgggcacctgtagtcccagctactcgggaggctgaggcaggagaatggcgtgaacctgggagatggagcttgcagtgagccgagatcgcttcaccgcactccagcctgggcgacagagccagactccgtctaaaaacaaaacaaaacaaagcaaacgaagtaaattactttggaaaacacattttctggttcccaaagggtgtgctcacgaatacacatttgtggcacaggctgaagtctgtcctcaaggtgtatgatggtcgcagagcaaggctgtgccctggaaccatgtcagggtctgtcccatggtgcagccttggggtcctgatggttgtatttcctgtctcctgcacagatcagctggacatcatctccatggcggagacaaccatgatgccagaggagattgagctggagatggcaaaaattcagcgtctccgggaagtcttggtccgccgggagtctgagctcaggttcatgtgagtgttttggggatgtggccaaggaaagaagtgtgtggaggagagaggaaaacctaatatttgttgatcgtctactgtgtgccaggcactgagataaaggcattatgcacgtttttaaaagcctcatttgattctcaccaccacccagggaagtggatattgtcatctcctgttttaagcaagaccctgaagttggaattgaattcaggccaatctgactccaaaacctttgttctttctgtatcacccacggggaagaaagagggaagggaatgcagaggctgtaccctgtgctggtgtctttcacgagcgcacactctgctctcagataggcctgagttttttttaagcctgtcagcttgggcaggttacttggactctctgaatttcagttccctcatttctaaaatggggaaaaataacaagatggggtctctagcaacatcagagtcacatgggttgaacgttcattatctacagagcacagcattcctgaagagttgcaggtagtctttcaagacaaactctcatttaaaaagttgggctctgagtgtgtggtggtgcacacctgtggtcccagctactcaggaggctgaggtgggaggactgcttgagtcctggagttcaaggctgcagtgagctatgatcgcatcaccacactccatcttgggtgacagagagaggcactgtctctaaaaagcacaaattaaggccaggtgcagtggctcacacctgtaatcacagcactttgggaggctgaggcgggatgatcgcttgagcccaggagttcaagaccagacagggcaatgtagccagaccctgtctctacaaaaaataaaattagctgtgtgtggctgtgtgtgcctttgtcccagctactcaggaggatgaggtggggggatcggtttagcccaggggttcaagactgcagtgaactatgatcataccattgcactccaacctgggagacacagtgagagcctgtcgctaaaagaaaaaaattaaaaatacaaaaaatataaaaacatcaaattaaaatgaaaaagtttttttaaaaattgggcttttgccgacaaacagtgaaaggttacaagcaaaaccaaaccaaaccagaggttaagaggcaacctggctggaaaattccctgcgctgcctgtcagctcacccacccacccaccctccactggaagcagcaggaacatcaaatcttttaggcaggctaggcccctcccctattctttcactgatttttcacaacaccaagaggctgagtctgtgatcatcccattttgcagatgaggagactgaggcttgaagaaatgaaacagcctgcccaaggcctcccagctagtaaatggggagttagggttcagactcagctctttctgcttttaaaacacctcttctttataaatttttagttacttatttagataaagggtcttgctctgtcgtccagggtggaatgcagtgaggccgtcatagctcactgcagcctcgaactcctgaaagcccatactctcactgggacgttatatgaccttccctctcgccacataaaatgaactgcagtattcacagctgtcatttatccagccctttgcatgtgcaagaccgtgagctaaatgcttcccatgcataattccttttcacagacatctctgaggaaggttctagaacatttccacttcatggctaagaaatatcttcccttttgtctggaaataagctaaaatgatacgtgagcattcagaaacaatcctttcctccctgtgttttaaaaggaagacagagaggccaggtgtggtggctcacatctataatcctagcactttgagaggcggaggtaggtagatcacttgaggccaggagtttgagaccagcctggccaacagggcaaaaacccgtctctagtaaaaatacaaaaaatttagccacgtgtggtggcgtgcgcctataatcccagctacttgggaggctgaggcacaagaatcatttgaacctgggaggcggaggctacagcgagctgagattataccatttcactccagtctgggcaacagagagaaactatcccaaaataataataaaataaaaggaagacagagaacatgagtcttgcttttaagtaatcaagatcaagatccctttgtttaaaaaaaaaactacaaaaatacaaaaaatttaaaaatacaaatacaaattaaaaattttaaaaatatatatttatttttatttacctaatggtgctgctgcaggaacaatggttaccactgtgcacttactgacctttactgtgtgcgcgtgtgtgtggatatttgtgtggatgtgtgtggatgtgtgtggatgtggatgtgtggatgtgtgtgggggtgttcgtatgtgggtgtctggatgtgtgtgtatatgtgtattgtggatgtgtgtgtgtggatgtgtgtgggtgtgtggatgtgtgtgtgtggatctgtgtgtgtgtatgtgtgtgtgaggatgtgtgtgtgcatgtgtgggtgtgtgtgtggatgtgggtgtgtatgtgtgcgtgtggatgtgtgtgcatgtgtggatgtgtgtgtgggtgtggatgtgtgcgtgtgtggatgtgggtatggatgtatggatatgtgtgtgtgtatggatgtgcacatgcctgtcacttagcccaggcttaaggacaagaataactagcatttcttaagaggcagctctgcagtaagctcttgacttgtgatctcattgaatgtcctcatctagcccatgaatctgaccacttagggacaaatgtcaacagtagaccctaggataaatcaaattatctaaaggatacagaaggacctgagtgttgttaggacatagatcagggattctgtgacattttccaggggagggacccccttccaggcccccagatgtcttgctggaatggagtcctacagacagtattggatggtgatgacgctccccaaccaggctcagccttgtatggtgtgtagcttgcccagtggtgcacctgcctcatcaatctcagagatagacggtggacactaaggcaaccaggacaaaggacacagtatgctcagatctgcacaaagtcctcatccatcatcctcagccctccaggccaacaggctttgagccaaggccctgcttgaattcactttcttggctgttcctcagagatggtttttcccgaagctgtggggcttatcctgtgagtgtgtcctgttcttatctccattttggatgggaagtaatgggaggttacaaaatttgcctgatgctgcattagctaataagtagccaagctaggatgcagtctgactccagaatgtttattaagtgaatcagggaaggagggaagggagtgggagagaagggagggggagagggaggggagaggcggacaggggaagggagggaagggaggaaagaaaaggaggaaggaaggaagctttgagtataaactaccaagataattccttcaagtttataaactccatgagggcagagaccttatccaatttcctcacaacgtcttcccagcatttggaacaatgcctggcactgagtgtcatgaatatttgtcaaatgtgcaataaattattctttctcactccatccttaccccaacaatcctcttacacacacacacacacacacacacacacacacacgtgagacactcttggcacagagtaggagagaaaaaaatttcagaccctactgatcattttcaggctcaggcgaggaagctttaagtgacaggaatgtgacagccctgggctgaaagactcccggtggccgtagtgtaatagccgcggtgagatttgttttgtcacacctgctgcgaagtaatcaccttaatgcccatcagctgctgcagagaccatgtgagtcagcccctatttcatggttgagaatgtgtctcacttccaatgcttctcgcagcattaactcttttatttttatttcttgtgacagagtctcgctctgtcgcccaggctggagtgcagtggtgcgatctcggctcactgcaacctccgtctcctgggttcaagcgattcttgtgcctcggccttccaagtagctgagactacaggtgcccaccaccatgcccagctaatttttgtatttttagtagagacaaggtttcaccatgttggccaggctggtcttgaactcctggcctcaagtgatctgccctccttggcctccttgggattacaggtgtgagccactgcacccagcctgcattgactcttttaagcatgagtccgggggggactgcctgccccagccccaaagctctggcaccctcacatttagattatttcatgggcttcctttttctcagctgatttaacttgtcctttcccccaagatccacagcccctgcctgttcttcctcttttcctgccacgacagtgaggaagaagaggagggagatttccctactcccagggaatggtgagaactcgggagatgtgggatcagaggtcatcatcctggctctctgacgtccttggtctgtgaccttggacacatgagggagcacacagagttgctgtttcccgcgggcactgatatgccaccctgagtgctacgtcccctgcatgcattcaccccttaattttagcttcttgagtcctcgcaagaaccccaatagagtaagttctatctcttttattttatgaatgaggaaattgaggtcggagaggcaaagtgacttgttcgaggtcaccagctaggataaagtagtaccaggatttgaacccaaggtgtctgtctcgtgggggcagagcccttaaccttaagctgttctgttatctttattctcaatgccaggaccccttttctctttgccttactcttttacaacgcaaggacaaacccccgattagatgcccccagtcccacacttggtcttgtcttgttctgcaatgttgaattgtgtgtggtggaacttggacagattttactaagtcaggctttggacttttctgtaccattgaaactgacccaatagtcccatcatagatgttctttttttttttttttttttttgagacaagagtctcgatctgccacccaggctggagtgcagtggggcacgatctggactcactacaagctccacctcccgggttcacgccattctcctgcctcagcctcccgagtagctgggactacaggcgcccgccaccacgcctggctaacttttttttgtattttttagtagagacggggtttcaccgtgttagccaggatggtctcgatctcctgacctcgtgatcctcccgccttggcctcccaaagtgctgggattacaggcatgagccactgcacccggcccatagatactcttttggataaatacagaagttgacctttctgatcttaaagcttgaagccctcatttgtcttatctgagttatttcctcaggaagggacccccaggcctctcaaaaaatatcaaagaactgaaactcaccagattaccacatccagagatgagataccagacccctcattcatcatgattgcttccttgctcctcccgagttcctgttttcttcatgattgcttccttgctcctcccgagttcctgttttcttatacattgttacatttcttccctgctatgtaaactcctagttttagttggtcagggagatggatttgagactgagctcccatctccttggctgcagcacgcaattaaaatcttccttggcaatactcatcttgtcagtgatgggctttctatgcggcgagcagcaggacctagaccaaacccctggtgtttcagtatcaccatttctctgcacataaactgtttatttcagagaccaaaatgatgagctccaatgcagacagtcaaagtttgtgaagtcagtctgctgggaatgtgctgtagaaaaagaacccggttcccgtaataactcttaaggcccacaacagttggcatttacagaccccttattgtggacctaggcttgtgctaagccctttacacacatgctcacataacccacatcaaatgcttactaacagaaagatgcatcaggaaccaccccaacccaggacacccacttgccctgaatcaggcccaggaggtcaagttcacagaccagccataagtgagctcccagcaggcaggtgtgaactctgagtgtgctcctcactctgaatttccagtgtgtgttcccttgctgacttccctttgcttgacccctggtttccaatgtgcaaaatggcatttagagatctctttcttgaggcttggcaattttatcaactttactggaacagggcagtaacacaaaactgcctccggaaaacaggcagcaaacatctggcagataatgcttgaaacgcctgtgttttctcacttcttgaccctatgttccacccacctcctagtacctcccactgctaccccatctccctacccatcctgcccccatcttactgcaggcaagaactctcagaggctgtcaacaacctcagactcattttctcgccttccttccagcactgaatcacatcattagtttttaataattcttcttgcagcccctctggctcgcttcagcttttccacatctagtctaccaacccgctcctgctgtttatctgggtttcagataattaagtatctttggcctccacatggggcaggggtgtggttatcttccttttacacccgcttgctggattttcataaaaagggatagcatgccctgccactcagcttgctctgggcaaaagcaggttttaatcagccagagacagaactgcagcaggcagggaaggtaggcgtgcgaaggacatatttcaagagcacagcctttgagttccaatatttccagagcctgggcttgaaatccagtaacttcgttttattaagaggtaccaagtgtggtaaagaggacaggccctgggaacctggcagagattcaaaatggggtaatagtgcatgcattgtgttgaaaaccacacacacacacacacacacacggaaagtgtgtgcattgtagatagcagttcttttaaaacattttctatgctggctagttttctagtgttttattgttttgattcatataatcctcactatcaccatccaggcagaaaatatcacatagcctttattttatagatgaggaaactgaggcactgagaggtcaagtctcttgcccatggttgtacagtttccatgaaatagcattctaagtccagatgaaatgggaaaagttcccttgtccccctcgcagggtgtgtgatgtcggagtggctcgcttcttcagtgccccgctgctcaaacctctaggggaccatagagatgggccagttgtcgggatctgatcccacggcagtgtctaggggtggatgtttacaactcctgaagcttcagtgtgtgtgtgttacatggtgctcttttagttttgctatctataggcggcttgtgttaactagctcaattagaccctctacgttgtcccaaggacagagggctttctgtatcctgggttcttgccttggtgcaccagaagaatcggatcacacctggacttggagaatgagagcaaggttttattgagtggaggtagctctcagcagatgggggaagccagaaggggatggagtgggaaggtttccccctggagtcaggccgcccagcagcctgggcactcctccgactgcccaggccaaactccactttgttccgccagtagatggcctgccagcatctgtcatgtgctcttctgccagcgtgttcctcttgacgtcttcttgacatccagacgcttgtgtcttctttgccgatctgcagctcttgacgtccagcagcttgtgtgtcacctgctagggtcttggggtttttatagatacaggatgggggcatggcaggccagggtggtcttgggaaatgcaacatttgggcaggaaaacaaaaatgcctgtcctcacctaggactgtgggcacaggcgtgggggtggagcccttaccagggaccacaccctcctctacccagcacttcccttccttccttctgtagcatttaaagcgaccatgcccttcccttcctatcacctctcttgcatatcacagagtccatggtctcagtcatcaagctgtggggtctctcaactagctttgaattctacttcttaccaactgtgtggcctggagcaaatactttgtcctgtttcagcctcggcttccccatcagtacaagggggacagtgatatctccctgcagcatcatagcaagggatgaaaacagacacaggtatgaaattgggtggcccttcctaggtagtaagcaattcaaaattcccttctttcctttcattgttaacattgtgcttcgtgggagagtagggcatcagggctgcttatggttgtctccagagaattcccagaaaatattcctctccccaagagaagatgggattcactgtggtttccttgagatcctcttgggaggtgccaactctcttgagagtggctctcaaccattaagtgcaactctaccctggggccttgattttattatgatgattatttaagatttttttataaacctgcattttttcccctttaatgagctgataattctgaagtctgttaggaagagcttcaagccaagggcaaaatgaagcatgtgcgtttatgtaacttgacacatttcagccacattcaggagctctgcgtcactttagttgcacacagggttttaaatagcatcttccaggaacaggtcaccattgccggggccactgtacatatcggatgggaagagatgcccttaattgcagaagatctaagaagcagtttgtcttggacaaaatatacaagaagttggggtgtaggggagggaaaggaaggaagaagaaacggagagactaaagggaggagagaggagggagaatttctaagctagacttctgaatggaaggaccctcctcctgaatttctaaatgtactgggaggtggggaggaaggtgggaatctgtgttgattgaatggagaaatacatgttagtctgggcgcagtggctcatacctgtaatcccagcactttgggaggctgaggcaggtggatcacctgaaatcaggagttccagaccagcctggccaacatggcaaaaccccatctctactaaaaatacaaaaaaattagctaggcatggtggtgtgcacctgaaatcccagctactcgagaggcttgaggcacaagagttgctttaacctgggaggcagaggtttccatgagccaagattgtgccactgcattccagcctgggtgacagaatgagactctgtgtcaaagaaaataaataaatcaaataaatgttctgtacttgacaagctcttgctgctacgagttgcctttcatggtcagaacaagtttcgagaaggaaaatactctctagaagttccgtcttcctagaactgtattacattctgctcagaggaccacctctgaaccacctagactccattgggttgggagggagattaccatgtaagaccctggtgattatcaattttatgcatcaacttgagtgggccacagggttcccagatgtttggccaaagattcttcgatgtatgtgtctgcaagagcattggtggatgaaattaacatttgaattggtaaactgagtaaagcagactgccctccctaatgtagaggtgggtgggccccgtccaatcagttgaaggcctgactacaacagaaagggtgagtaggagggaactcctgctgcctgattgcttgggctgggacatgggtcttttccggcctttgaacgcaaactgaaacatcagctcttcttgggtcttgagcctgccagcctttggactggaacttaacaccgtcagctctcctgggtctccagctgccacctatagatcttgggacttcttggcctccaaaatcccatgagccaattccttatcataaatctttttccaggccaggtgcagtggttcacgcctgtaattccagcactttgggaggccaaggtgggcagatcatttgaggtcaggagttttgagaccagcctggccaatgtggtgaatccctgcctctactaaaaatacaaaaattagccggctgtggtggcgtgtgctttcagtcccagctactcggaaagtcgaggcaggagaatcgcttgaacttgggaggtggaggttgcagtgagccaagattatgccagtgcactccagcctgggcaacagagtgagatcccatctcagaaaaaaaaaaaagaaaaaagaaaagaataaagaaaaaacaaataaaataaatctcttcagtagtattggttctgtttctctggagaaccctgactgatagagccctttttattctcagaaattttcatttggatagtttatcaggttagcaaagacctagcaagttggataaaatgaaaatatagggaaattggccttatctctttggaaaacagttcattgttacctagtaaagatgaacaggtgattataacctgcagttttgctcctgggtctacccctggttagccagtagcttcatgtggctatttcagtttaaattaattaaaattaaatagcatgtaaaattcagtctctcggtagcctgagccatatttcaagcactcattagtaaataatggctagtggctaccctattggaaagcatacatttgtataggacatttctattgttgtagaacattctattcaccagcactgccctagagaaactacacatgagcatcaggaggcatgttccagaatgttcataactgcctcgtttgtggtctagctgtaccacagaatactatacagcagtgaaaaatgaatgagcaacaggtatgaacatgaaagcatctcaaaaacaagatgttgagcaacaggtttatataaagtgtataaaagtaaaaaatataggccgggcgtggtggctcacgcctctaatcccagcactttgggaggctgaggtgggtggatcacaagttcaggagattgagaccatcctggctaacacggcgaaaccccgtttctactaaaaatacaaaaattagctgggtgtggtggtgtatgcctgtagtcccagctagtcgggaggctgaggcaggagaatcgcttgaacccaggaggtggaggttgcagtgagctgagatcccgccactgcactccagcctgggcaacagagcgagactgcatctcaaaaaaaaaaaaaaaaaaaaactaaaaaatataattgttccgggcttcatatatgggtggtaaatgataaaaataaaaagcattaccacaagtttgtgatagtgcctacctctgagggaatgagaaaaatatgagggaatggggcacacggggccgtctaaaagtcacacacagatttttacttaagtaggatgttgggaaaataactgctttattattccataaaaataatataataataattctatgaagtatgaaataatagtaaataataataaaatataataaatcatattttattatattttattattattatagtatattttatataaattttactataaaaataaaacattttatgcacacttatatgtagtttgcacacacacttctattttttaaattgtggcaaaatatatataatatttactatctgaaaccatttctaagagtacagttctatgtcattaagaacattcatactgtgtgtaaccatcaccatccctccccagaatttttttcatcttcccaaactgaaactctgtaccattcaacactcactccccattttccctttcccctggctcctggtaaccagcattctgctttctgtctctgattttgatgactctacatacttcataaaacaggaatcaggccaggcgctgtggctcacgcctgtaatcccagcactttgggaggccaaggtgggtggatcgcctgagctcaggagttcgagaccaccctgggcaacatggtgaaactctgtctctactaaaataccaaaaattagccaggcgtggtggcgcacacctgtagtcccagctactcaggaggctgagggatgaaaatcacttgatacctggaggcagaggttgcagtgagctgaggttgtgccactgcactctagctcaggctacagagtgagaatccgtctcaaaaaataaaataaaaaaaaaagaagtggaatcacacggtatttttctttttggacacacatttctaaggggaaaatgctgagaaagacaggcaggggaaggtacagtatctgatatctccacttaaatgtctcaaagatacctgtaactcaatctgtccaagtcaaactcatgatccccccatctagtcccaatacccaccagccctagctcagcaaatggtcaagcatcaccatctatccatggaaatctcaaattccaaaattagacatcattcttgacccctcccaaccctccacctcatatattcagttcatcatcaactggtgtttgttttacctcctaaaataatgctcagctgtccatctttctccatctccatggccaccacccaggttcacatgcccatctctgtcctgcagccagagggattttctcaccatgtgaatctgattataactctcagatttaaacactgtcttagtccgttcctgttgctgtaacaaaattccttagactgggtaatttataaatagaaatttaattctcacagttctggagtctggctgggaagtccaagatgaagatgccagcagattccatacttagaagggctcattctctgcttccaagatggcgccttgcttctgtgatctccagagaggaagggcaccgtcttctcacaagcagaatggacagaagggcaaaaaggactgaacttgctctctcgagcacttttgttagtgcactgatcccacctcctaatggccctcaccccttaatactattgcattggaaattaagtttcaacatgaattttgaagagtcataaacatttacaccatagcaaacaccttccagaatttgttagcatgataaagcccatgagatcttgctggatctgctcacacctcttctccaacttcttttcttcatccattcctcacccccagctccctcccttacacacacacaccactcccttgggcctccttttagtctccacctccccaccccccgatacacacaccaggtcccctcctgccgtgggggcctttttgtttgtgatgttccctctgcctggatccctctcctcccacccccctctccttccctggtgctatgatctgaatgtttgtatcacccctaaatacatatgtcgacatctaattcccaatgtaataatatcaagaggtggggctttcaggaggtgattaggtcatgagggcagatcctcatggatgggattcgtgcccatgtaaaagaggcccagggtagcttgtttctccctttcactgtgtgaggacacagtgagaactcactatctatgaggaagaggtcctcaccagacactgaatctgctgacaccttgatcttggactttccagcctcttttaccatgaaaaataagtgtttgtttgtttgtttgtttgtttgtttgacggagtctagctctgtcgcccaggctggagtgcagtggtgcgatcttggctcactgcaagctctgcctcccaggttcacgccattctcctgcctcagcctcccgagtagctgggactacaggcgcccaccaccacgcccggctaacttttttgtatttattggtagagacagggtttcaccgtgttagccaggatggtcttgatctcctgacctcgtgatccgcctgcctcggcctcccaacgtgctgggattacaggcgtgagccaccgcgcccggcggtgtttgttgtttataagccacctaggctaagaaagggagaatggcagcccaaatggactaaggcacctgataaactctgtcccctcgaggactgagatctagggcatttctggagggacaccttcccagcacttccccagtccctgtcccattaccatccctgcaatcctttccttagaagccttttgtaaatttgtgttcattggtgtgagtgtatgttcaatatctgactctcctcctagatgctgacctccatgaggacagaggctgagctattttcactcccaaaaatgttgacggtacccagcacacagccaaactcagcgtaggcactctgagtgaagattgattgaatgaattaatgagggctcatcttcctgcttctcccacggtcacataatctcaagggttcccttccatgtggcaggtctgggtggtgagaactgcctggctctctgatggttagggtgaacagtgggtccattcataggaaggaacagagtgataatgcagctaagtgcgttattttcctgtggctactgtaacaaacagctgcaaatgtgttaaaacaacacacatttcttttatcttacagttctggaggctggaagtctgaaatcgatttcactgagctgaaatcaggtgttggcagagccgtgctttctggaggctctagaggagaagcctcttcctcattcattccagcttctagaaccgtactctttgcatttcttggcttgtgtttccctcctccatctccgaagccagcagcatggcatagtccagtccctctcgattgaggtcatcctgtcgcctttgctcttctgtgtcaaatccctctgtttttctcttaaatgtatgcctagcattccattattggaacactaagcatgtgggagttatttatatgctacttctcaaggctatcaccaggtctgatttctcaaattcaaaaaattgcaacctcaggcataaatgggtaggggcacttgtgatgacattgagggcccacctggataacccaggatgatctccccatctcaggaccccttaatttaatcacatctgcaaatttcctttttaaaaatatatatttttcagagacgaagtcttgctctgttgtccaggctggagtgcagtgacacggtcatagctcattgcttcctttaattcctgggctcaaacaatcttactgcctcagcctcccaagaagctgggaccacaggcacgtgccaccacacatagctaatttttgaattttgtagagatggtgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgtaagtttcctgaggccttccaagctatgtggaactgtgagtcaattaaacctcttttcttctttctttttttttttttttttttttgagacggagtctcgcactgtcactgggctggattgcagtggctcaatcttggctcactacaaccaccacctcccgggttcaagcaattattcgcctcagcctcccaagtaactgggattacaggcacccgctgccatgcccagctaatttttttttgtatttttagtagagacggggtttcactgtgttggccaggctggtctcaaactcctgacctcgtgatccgcccacctcagcctcccaaagtgttgggattacaggtgtgagccatcacgcccagccttaaacctcttttctttacaagttactccttctcgggtatttcttcatagcagcatgagaatggactaatacagttgggatctcatcaccttgcccaggctggtcttgaactcctaggttcaagtgatcctcccgcctaggcctcctaaagtcctaggattagaagcatgagccaccatgcctggcccaaaatcccttttgccgtgtaaggtaacagattcataggttcattaggacatggatatcttcagggaccattcttcagtctaccatattgagtgaccacagcaattcatataagggccaagcccagagcaggagccacagtgtggcagcaacaatgacagagacggccctggtgaggctggggaaaggggaagatgacacactacatggggcaccctcatagcttcatcctgtgccgggttctcatcatttttttgaaatctcccaaaaaagaagcttcttagaaagacagggcaatagataccagtaaattgcatgtaccgtggcctggcgattaagggtttttccattccctttgcttatttctggaaagctgctgatgtgagtggcagcagagattgagaagggcttgtccctatcacgtgatggtctgaattgaataggataatgcttggctgagcctccttcccacattttccttcaaataaaataccaaccctttcttgacagttctaggacaggatgcccaaagagaaatgggagggaataaaactgcaagtgacttagcagagctgccttggtgttttgggtctacacaaccagattcccgagcacccccttaaggcaatatcctgacttacatatttcatgttatgtaattggctgctattcattgagccatcagttacttagatcttgttgtctcctggaattccagtctactgtgtctgtcctcagtcccctaaactcctcggggatctcaagttatattagatcaatccaagacattcctggttgggttctgccaaacgtggtaggatccctgttttgtttttttgttttttttgtttttttttgagacaaagtctcactctgtcacctgggctggaatgcagtggcttgatcttggctcactgcaacctctgcctcctgggttcaagcgattctcctgcctcagcctccctagtagctgggattacaggcacccgccactgctcccagctaatttgtatttttagtagagaccgggtttcaccatattggccgggctggtcttgaactcctgacctcgtgattcgcctgcctcggcctcccaaagtgctgggattacaggcttgagccactatgcccggccttttttttttctttttctttttttttttttttttttgagacggagtctcgctctgtcgcccaggctggagtgcagtggcacgatctcggctcactgcaagctctgcctcccaggttcacgccattcgcctgcctcagcctcccaagtagctgggactataggcacctgccaccatgcccggctaattttttgtattttcagtagagacagggtttcactgtgttagccaggatggtctcaatctcctgacctcgtgatctgcccgcctcggcctcccaaagtgttgggattacaggcgtgagccaccgcgcctggccagatccctgttttttcattactagatatcctggtcttggatggggttgctttctgataaatagacctcgtgcctggtaagtgtgtttacttgctccggattaaattacacctagatttacattctacctctgccatttataggctgtgcaatcttgcacaaatatcttaccttctctgagcctcggtggcctcatctgttaaatagccatgcatccagtatctcgcagggtggtcatgaggagtaaaagagatcaagcatattaagtgctcagtccagtgcctgctaccacgtaagtgctcattaaatgttactttcctttaccaccaggaagaaattgagtttggaaatggatagatacaggcataagtgtagacactggtttctttgtttggaagaggagacacaagagaagggggagattagagggtggaatgatgatcttttccatgtcaaggttgttgaaacgacgagagaagtctcaaggggcacctaagatttgtctcaaaatatctgaaggatattacgtggaagaggaagttcgtttctttctttttttttttttttcctgagatagagtctattgtgttgcccaggctggagtgcagtggttcaatcttggttcactgcaacctctgcctcccaggttcaaacaatcctcctgcgtcagccttctgagtagctgggaccaagtagcagcctcaggtgtaggggggcttgagcctctcctcactcctctctgattggtccaaatttgctcagtctgggccaatcagagtctttctcctgggatgcagagagattagcccaggtggatgatgagggagtggcaaaccgaagtctatgcataagcagagaaagccagtctttgaagggaaagaggacagagcgtctgcctcaagaataacaagagagacagtgtcctttgaaagcagagaaggaactcagccatgacattcccattgcagtccagatgaactgggtagtccataagatgttgcaccttgttcaaccctgcgcatcctttctccagacccttggagaaatacctcccaccccgtgttgccaccgcctagggaaatccaaaatccagctgtacaatgtctgtacatttccaggggcttccatcctcaagtcttctctgctcctaggcttggttccttgagtcctgtacctccatccaactgaatatgaaactcagatgcttcactggtttccataacaacagaataaaacaatgccctatcctactcccacaggtcatttgaggagcaatacaatgaggatcacaaaaagggtgtcattgatctcttcacagcagacagcttaaaaaccatgaccagtgacaatcgtctcctggctcaccatgtaactgtccctccagccccagaggactagccccagccacagccctgcaaagaccttgattttttttttaattgcaaaaaaaaaaaaaaaaaaaaaaaaaaaaagaaaaggccaggcgcggtggctcacgtctgtaatcctagcactttgggaggccaaggcgaaaccctgtctctactaagaaatacagaaattagctgggtgtggaggtacatgcctgtaatcccagctattagggaggctgaggctggagaatcccttgaacccgggaggaagacgttgcagtgagccgagattgtgccactacactccagcctgggcaagagagtgagactctgtcttaaaaaaaaagtcaatgttccagtaaagggcatcgtggtatccatatggccataactaggagaactagaaatccacatttgacattcctggttaacaagatctttttcaccaccctgtgccataaggcagtggggtggtttcctttttcttggccttttccacacacggggtccagtttcatcacctctttttctcttctcctttatctcagctccctccattccaaggaagacacttacttctcctgtcttatccacagcagctttgccctcttctaagaagccacggcaccaatttatgctgagctcttgcaagtaccaccccaggtgtttgtcaagccataattccaagcaaaaaccattatctccccaagatacatatgggtaccatctgtcaagatgctagcatttcccttcattttcttacacctttactaaactatatttttctcaagtgagcttgagtggatttctgttccttctagtctgtgctgcaatattctattaaaaatttaggctgaatgcagtggctcacacctgtaatccctgcactttgagaggcttaggtgggaggatcgcttgagcctagaagttcaagaccagcttgggcaacatagcaagaccccatctctacaaaaaaactaaataattagctgggcatagtggtgcatgcctgtagcttcagctattctagaggctgaggtgggaggattgcttgagcccaggagtctaaggctggagtgagctatgcttgtgccactgcactccagtctgggcaacagagtgagactctgtctcaaaaagaagaaagagggccaggtgcggtggctcacgcctgtaatcccagcactttgagaggccaaggtgggtggatcatgaggtcaagagatggagaccatcctggccaacatggtgaaaccccatctctactaaaaatacaaaaaaaaattaggtgactacagtggtgtgtccctgtagacccagctgctcaggaggctgaggcaggagaatcacttgaacccagaaggcggaggttgcagtgagctgagatcgtgccacagtactccagcctggcgacagagcaagactccatctcaaaaaaaaaaaaaaaggaaagaaaagaaaaaagaaagcttagctataccgagaactttatttcccatatcccattttgtattagtccattttcacactggaaaaaaaaaataccaaagattgagtaatttataaaatagagaggtttaattgactcacagtttcgcatggctggggaggcctcaggaaacttacaatcatggcagaaggggaagcaggcaccttcttcacaaggcagcaggagggaataagagccagcaggggaaatgccagacacttataaagccctcagatctcatgagaactcaccctttatcacgagaacagcatggaggaaactgccgccatgatccaatcacttccctccctcgacacgtggggattacaatttgcagtgagattttggtggggacacagagccaaaccatatccttttccctgtagggttgtgggttaaaagtaggcagaagaggatggtgcgggagatttgggaagtggaaggaaggtgacatcagtgtttactctttgaaggctgtccagatgagacaaggaggtgatctgacagaggggccacagaggttccagcttgtcctcaccctcccctgtgtcccttgcagcttgtcttcctgaccgctgggcctgctgaccaacagcagcccccccgcctctggatgcttggcagacgaggcagcagccccctagggacccctctacctgtttcccctctgccactccatcttaacagctggacgcatctgactctcatatcagctgtcggtgacttctctcatcctctccacccttcccagaccgccatctccccagctccctggacaattgtagaaggtctaattcctataacgcatcccttgccccagagcacgtagtgaccctgcttccccgattgagcactgactaatatccctcaacagcctttacagaagtagccagaagttggaggcaatgtgtccatcttgcaccaggccaacatccccccatgcttccgcgtctcagccttgactgcctattgcaatcacatggagaactttaaagaaaatgctggggcctggtcttacagccagagtcttgtctagttgttccaaggcatagcctggtcattgagagtcttagaagcaggtaggctgatgccccctcacctcccacggcacagacatcccctcacctcttcgctggctgaaatagaagaaccctagtgtccatcagctgcttatagatgactcatcttcttaatcctttcttgacgaaaacttgcttcagatgttaataaaaagtacaaaatctgccctatgttagtttgactccttggcacagcagtgggagcctctctctctcccctgtagcctaggatcgtgatcagaatcataatgaaatgtgtgtttgtggtctcccgtggcgtcagataattccgatgccatctgttgtcttcatcatcacatccgttattgaagtccgttgattatgcctttgattgaacctggggctatatttatcaagaaaattataagcacaggctttctgacagtgtccaaccaaacagaatttgtcatcattcaatgactattgctttccatttgttcctgttttggacttctaaaaaccaacacagggtctccttttatttttatttttttaaagaaatcaagtgagctggccaagagcagagcagaagatagatttttcttattcttaattttttttttttttgagacagcatctcgctctgttgcccaggctggagtgcagtggcacaatcttggctcactgcaaccttgtctcccaagttcaagcgattctcctgcctcagcctccccagtagcggggattacaggtgcccgccaccatgcctggctaatttttgtatttttagtagaggcggggtttcaccatgttggccaggctggtctcgaactcctgtcctcaaatgatccacccacctcggcctcccaaagtgctgggattacaggcatgagccaccatgcccggccgagaaatatatatgtatttttaagagacgggctttcactctgttgcccaggctggagtgcagtgatgaatcatggcttactgcagccttgaactcctgggctccagtgatcttcctgcctcagccccttgagtagtggggactataggcacatgccaccatgcctggccaattttttaatttttttgtagagatggggtcttgctgtgttgcccaggctgttatcaaactcctggcctcaagtgattctcctgcctcagtctcccaaaatgatgggattacaggcatgagccaccgtgcgtggctgaaaattcttaaatgtctgccacctatgaaagcattttggagctatagtttgacccaagacgaaaactgctcatttagataatgaagtttaatttacctttgaaagcaacactttgggaaatgcctgaataaactgacatcttgagtcgataggaggcttccccacgtggagtttggtgagctataccaggtcattaaaaagcccttagatgggccggatgcgttggctcatgcctggaatcccagccctttgggagcccaaggtgggtggatcacttaggtcaggagttccaaaccagcctggccaacatggtgaaacaccatctcttactaaaaatacaaaaattaactgggcatggtggtgtgcacctgtaatcccagctacttgggaggctgaggcaccaggatcacttgaacctgagaggcggagattgcagtgagccgagatgtgccagtgcactccagcctgggtgacagagcaagactctgtctcaaagaaaaaaaaaaaaggctcttagattggaagtcagtgctctcattcccccttgaagatggtgactgtttgctactgttccatgtcttcaatgctcatgctgctgcttagacctgttagaactgaccttgagttattccagaggaaaattccagcggatcctagaacaatcagagtattctggactgaagcatagtccagaatcgctctggtgattaaattcggaaagcttgcccagggcatcattaaccgcctggaggagtgagccctctcaccatctgttgtctgccatcactatttggtttttctctttggtctcatttagagccaagttgagaaatttccagttcctctccacttgctgcccgacacagttaaccagaaacacaatgtggtgaaggggcccatgttgtagctaaaacagccctagacttggaggcaggagcctgggttgatatcttggctgtttgactttatagcagcgatccccaacctctttggcaccaaggactggtttcatggaagacaatttttccatggaccagggatggggtgggggcatggttttgagatgattcaagtgcattacatttactgtgcactttatttctatcattattactttgtaatctataatgaaataattatacaactcaccataatgtggaatcagtgggagccctgagcttgttttcctgcaacaagatggtcccatctgtgggcgatgggagagagtggcagatcatcaggcattagattcctataaggagcgtgcaacctagatccctcacatgcacagttcacaatagggtttgcactcctatgagaatctaatgcagccgctgatctgacaggagggggagctcagccggtactgtgagcatggggagtggccgtaaatgcagatgaagcttcactcactcacccgccactcacctcctgctgtgcggcctggctcctaacaggccaaggacctgtactggtggtggctcaggggttgggaacccctgctttatcagacttagttggtccagtttttcccaaagttgggtacgctctgggatgattttaggcagcatttaggaaaacattaattaagaattttttttcggccaggcatggtagctcatgcctataatctcagcactttgggaggcctaggtgggaggatcatgaggtcaagagatcaagaccagcctagccaacatggtggaaacccagcctttactaaaaatacaaaaattagctgggcgtggtggtgcacacctgtagtcccagctacttggaaggctgaggcaggagaatctcttgaacccgggaggtggaggttgcagtgagccgagatcgtaccactgcactccagcctggtgacagagcaagattccgtctcaaaaaaaaaaaaagaaaaagaaaaagaatttattttcaggcaaggcctagtggctcatgcttgtaatcctagcattttggaaggccaaagtggaggatcacttgagcctaggagtttgagtccagcctgggcaacatgacgaaactccgtctttacaaaaaattagcccagtgtgctggagtgcacctgtagtacccccagctacccaggaggctgaggcgggaggattgctggaacccaggctgcagtgagctgatatcacgccactgcactccaacttggacgacagagtgagaccctgctgaaaaaaatatatataattttcatgtcttttaggaacaatattaggtttgcatttatggtgatgtaaaaaagagaatcaacataaagaaaagtattaaatagacaataaaagagaacacgcctgtaatcccagcactttgggaggctgaggtggggagatcacttgaggccaggagttcaagaccagcctgtctaacatggcaaaaccccgtctctactaaaaatacaaaaattagcggctctcggtggcatgcacctataatccaagctactcaggaggctgaagcatgagaatcacttgaacctgagaggtggaggttgcagtgagctgagattgtgccactgcactccagcctgggtgacagagtgagaccctgtctcaaataataataataatagagagggcttgaggcatagcaactgttgccatggtaacgtgcaagtgactgatgttcaggaaacactggctttgctaccctgagccacacttttccttcttgcctgcaaggcgataaggatgttgcacctggtggctggtgtgaggaggtcaggcgcagcaagaggcagcacacgtagcagttacagtcacagactttgcctgcgccagggtctgtgtcccagcggagatgcttaccggctgtgtggtcttgagcaaattgctcgacttctctgttactctgtgtggtgttttctgacgccacttctgacaccaaatgtgttttttctgataccaaatacgtgccatttttctacactaagtctctgattcttggatgccaactgggtgcccaagcaattcaattcagctatcacactatgtcctggagttagcatcaggtcctgcaagttaaaagaccccatcccaccagactgcccctatctcagatgccagtcgcaagtccggagccacccacccttctgcctggccaattacaaacttgggggttcccacgaccacctcctcgggtttgatagtttgctggaatgactcacagagctcaggaaagcccttcacttatgtttactggtttattacaaaggacagaactcaggaatagccaaatggaagagagatgcattgggcaaggtgtggagagggagccgtgcagagcttccatgatgccctctctgggtgcactgccctcccagcacaccagtgtgtccaccaacctagaggctccctggatctcactgttcaagagcttttataattcagtcgccagcctcctcctcttcctggcaggtcagcgagtgggactggaagttgcccgccgaattgttttttttttttttttttttttgagacagggtctcactctgtcacccaggctggagtgcagtggtgagatcatagctcactacagccttgacctcctaggagtgagcctcctgcttcagcctcacaagtagctgagactacacaggtgggtgccaacatgcctggctaatttttaattttttttttttttttttttgagacagagtcttgctctgtcacccaggctggagtgcagtggcgcgatcttggctcactgcaagctccgcctcccaggttcatgccattctcctgcctcagcctcccgagtagctgggcctacaggcgcctgccaccatgcctggctaatttttttgtatttttggtagaggtggggtttcaccatgttagccaggatggtctcgatctcctgacctcatgatccgcccgcctcggcctcccaaagtgctgggattacaggcttgagccaccatacccggcctaaattttttttttttttttttttggtagagatggagtcttgctatgttgtgcaggctggtctcaaactcctgagctcaagtgatcctcctggctcagccacctgagtagctgggattacaggcatgagcctctgcatccggcagtgcccccgaccacctgtctttttttttttttttttgagacggagtctcactctatagcctaggctggagtgcagtggcatgattgcggctcactgcaacctccgcctcccaggttcaagcaattatcctgcctcagcctcccaagtagcttggactacaggcacgtgccatcacacccagctaatttttgtatttttagtagagacgggggtttcaccatattggccaggctggtctcgaactcctgacctcgtgatctgccggcctggacctcccaaagtgctgtgattacaggcgtgagccaccgtgccctgcccacccctctcccctgtctttatcacacatttgctcttctggtgacgaggccccaacctgaagccatctctctagggaactcagcctgagtgccctcattagcatacactcagatgtagtacaatggggattgctatggataacaaaagacagtcctatcgctcaggaaactccaggggctttaggagctctgtgctgggaaccagggatgaagaccaaatagatattttattaaccacactagtggcttaatgaattacctcctagggattttttttttttttttttttttttggtcaggagcagatgagataagatacataaaaaagatattacaatacctaaccacataataactgttcagtaaatgttagcagtgaaatgggggagctcccctgtcccctttgcaggacttgtgacaggggtgtggctcgcttacttggctgccactgcatcaaaccccttgcaggagggggagcatgcaggtgagcagattggggctggggtgagtgcttttgggctctggtcccatggcagcgtctagggatgtgttacaattaatactcttttagcagttgctgtacgcagatgactaagtgttaaccagttcagtggagattcagggtgatagccttttacaccctgccctcttggtacctgggttcttgtctggtgtccaggaagaatcaggtcacatggacttgaaggatggtgaatacaaattttttattaagtagtggaagtggctctcagtggaaggggagctggaaaggggatggagtgggaaggtaatcttcccctggagttcagccatcctcagatgatctcctctctgactgtccccagccaaactcctctcgatgttcagacacttcttctcttctctccttctctgccacgccactctggtgctattctgattgtggagcctggggtttggggttcttaagggcataggatgggggcagggtggtccagagcggttttggaaaaggcaacatttgggtgtgaaaacaggaatgcctgttctcatttagggctgcaggtccaggcttgagggtggagccctcacctgggaccctgtccttctgccgcctgtccgtatcagcaggatgctactgctgctgctgatacctggggaattgccaggtgtgaggtgggcattagaaaaatttcaggctgggcacagtggctcaatcctataatcccagcactttgggaggtcgaagcaggaggactccttgagcctaggggtttgagaccagcctgggcaacatcacaagaactcctctctacaaaaaattttgaaatgagctgggcatggtagtgtgtacccataatcccagctactcaggaggctgaggtgggaagattgcttaaacctgagaggtcaaggctgcagtgagctatgattataccactgcatgccagcctggaccacagagcaagaccctgtctctaaaacacaattaaaacaaaaatttcagttgaatatgttcctaagaagccacaaaagagtcttttgttatgattcttaaatgaaaattaactaaaaattggaaataaggaagaatgtcttttccatgtcatactgaggcactgcttaatgacctgcccacggatgattaattatcttggagagagtacatgtatctgactttgttatttattatttgattagagcactgacatagtgaaattacacgttaacttgtagatttctgtccagtagaaaaaagacgacattaaaggttatggttttattgcccttatagcatgttaaccagatttctctcgaatttagcaatcttatgctaaggttttcattaaagatgctgatgagtccactttttaaatgcccttggagcgagctttaccattttactggttccctcattaatgggttaaataaattttttgacaagtgttcattccacatttgtatgagtcacattttaaattttgaaaatatacttcagcatgatcttaataatgccaagtcccagagagttctctgtgcccataatttagttcactgggcacattcccagagcacgttcagtatgcaaagcatcatggtgggccccgcagggaagactaaaatgggtaggactggtccctatagttgcagatttagtaattacttatgggcagaaaagaagtatataaattacttcctacactgtgagaaagagaaaagctgcccctggcagccgggagctggcttgacactcacagcttggccaaagtgttctcctgttgaatgtaaacaattttgcagattgccggcatcagacaaggccatcctgagaccgtgatagatcaagacaaaataacactactcctgaaggcagataaagacatgaacattgtcccagccacaaaaatcacccaatagccccatttcctagctcatatgagtgactgctagttctccatcaatcacagtttcagtcttactctgttcttctccctttaaaggaaagaattaggaagacactctatcagagaattacctccacttcctgacaacatccaatccagagtaaatgctcacttcctttaaactgtcccccaaagcacctaacacaagcccaaattttcttttcttttctttttctttttttttgagacggagtctcgctctatcacccaggctggagtgcagtggtgcaatctcggctcactgcaacctctgccccccgggttcaagcaattctcccgcctcagcctcccgagtagctgggattataggcacccgccaccacgcctgactaacttttgtatttttagtagagacggggtttcaccatgttggccaggctggtctcgaactcctgacctcaagtgatccacctgcctcggcctcccaaagtgctaggattacaggtgtgagccaccacacctggccccaaattttctaataagtgctttctaacaccctcttactgatatctgcccacagctgattaggtgcaagctagcccagtaccaatcgatagaagacagtacagactcactaaagtgatatatgatggagaaaattgtccccatccagacttcccttagagagaagacccggtgtggttggtgggaacactctgacgcttcttttggttagggttgttggccacaagcaacagaaatcaactctgcctgactcaaccaaaaaatgggattgtagaaggctatgagtggggatgggggctcaggagtcggaaggacaggcttggaaatgagtatggatcaagaaagccccagagactggccacaggaccaatctggccaggaagccgccattgctggacagcacaagtctaatccctccatccttttatctctgtcatttgctctgtggtcaaagtcttggacatgagcttctgattggctgagtctgaggaagtgggggtgctcccttgttgaacttctctaataatgactgacacagtgaatgctttccctaaaactagggtttggaggttgagcagccaaaaattccaacttttttccattacaggagggagacacaaccccacccaagaccatgtgtaagtaacaataggtagtctgtaaacagccttccatggccaggaatggtggccaaagaaggtcttctttgacagaggtcaaagaagagggtgggggccaggcacaggggctcacgcctgtaatcccaacaatttgggaagccgagatgggaggattgctttgaggccagaagtttgagaccagactgggcaacatggtggaaccccctctctataaaaaatataaaaattagccaagcatgctagggcacgcctgtatttccagccactcaggaggctgaggcaggaggatgtcttgagcctgggagattgaggctgtggtgagccatgatcaagcaactgcactccagcctacatgacagagcaagaccctgtttccctgtcacaaacaaacaaacaacaaacaaaaacacatacacataaaccccgtcgttctaagcaaagtgagtcctgctatctgcaggattttgatttttttccaagagcattatgctgaactggtatcagaattaaattgcttggaacaattgttcctggatcaaactgagggttgggctgcttattctagtgacccaataacgagatgcaaataaactgggaaaggagggagtttctatttctgttaccagttacagggaaaaagcctggaaaataccaccagaccaactcaaaattacaaagtttcccagagcttacataccttctaaactatatgtccacgtgtaagtgtgcgttcacctaaagacctaaataatcagcttcttctagtctaactaaggtctgagtcctgaagaccttcctctgaagcctcagtaaatttacttaatctaaatgggtccagttgctggggtgattacccttatcttgtctcctgctaaatcatggaggtttggggacttccttcacactcccaataaacttgtttgtggaggcctggggagtttcttcacacccccaataaaacttgtttaatcctaaacgtgtcctgttaagaattgcctcgttatctcgtcatgtttcaaggcccaggaaaggcctgagcaaaactgttggaggatttctgttacattccagcctttgtataagggcactggctcttttagctttttttttttttttttgagacagagtctcgctctgtcgcccaggctggagtgcagtggtgcgatctctgctcactacaacctctgcctcctaggttcaagcgattctcctgcctcagcttccgagtagctgggattacaggcatgcgccaccatgcccagctaatttttgtattttttgtagagacatgatttcactatgttggccaggctggtcttaaactcctgacatcaggtgattcacccgcctctgccttctaaagtgctgggattgtacaggcatgagccaccatgcccagtaggctccttcagctttgtttttttcttcttcttttttttttttttagtgacagagttttgctcttgtcgcccaggctggagtgcaatggcaggatctcggctcactgcaacctccgcctcccaggttcaagcgattctcctgctgcagcctcccaaagtagctaggattacaggtgcctgccaccacgcccagctaattttttttgtatttttaggtgagacggggtttcaccatgttggccaggctggtcttgaactcctgaacaaggtgatgcatccgccttgggctcccaaagtgctgggattacaggcatgagtcactgcctgcccagccactttcagcttttaatgtttaacttaaccacacagtccctgctgaaatagctgtcatggaggcctgcgttagtgagacctgacctgccacacaatgaaggagatgttcttcattgagataatgtgggtgtccgaatcaggatccacaggtcagtgtcccagctccaccattgactagctgtgtgattccgatggagccacttaacctctctgagctgtgggatcttcctgtataaaagagacaaccacgtagtgcccacctcaaacagtggttatcaggattgagatgatctgtgtaaagcatttagtgcctatgaagcacttcttagtgtataaagcacttagggtgtaaaaggtgcatggtaaattctgtttgtcgcccgggctggagcgcagtggcatgatcttggttcactgcaacttctgcctcccaagttcaagtgattctcctgcctcagcctcccgagtagctgggattacagctgtgcaccaccatgcctggctaatttttgtatttttagtagagacgggatttcaccaggttggccaggctggtcttgaacccctgatctcaagtgatctgctggtcttggcctttcaaagtgctgggattacaggtgtaagccactgcacccgccctgtgcgtggtgaattccgagtaaatggtagccaaaatcattgtcatcatcatcgccacaggtaaccttttccccaaataatactcagcttctcttctaagtaaacgttgaatgaatactttagagtgttgaagaagcacccctaaatctgcccacttgttgattctagccagtgatgttaaatttttaggaatctggagaaccagttgttcaactgtgggtagctcaaaatctgcagcagtgggagtatttacaccgtggaaattggcaaatgattcacagcaaggcttctacctccctcccctgcttccagccagttaaacattccccagcacatcactcattctagtcctagcctgccctactttggggcatccaacagagattacttgcgttttctttgtggtttatcaagccccagggtctcgcttgcctacaaaggagaccactaatcactagcatgctgaataaacatgaagttgacttaaacattaatttacttattatcaaaagcttatctgcttctgctggtgcaatgactctgatgggaattgccagtggtgatggtagataggtgatggcttcagagaagtgtgctctgtgctttggcaggagcagggctaagctgagacagtggtcctagtggcccagtccatgggctaagcaggaatgggtgggaagagggcaggggaggcttccccggggcctgcagattgtgttcttaagagttttttccttcagtccttagaagctcagctgaaaggaatgactgcggccggatgtggtggttcatgcctgtaatcccagcacttagggaggccgaggtgggcagatcacctgaggtcaggagtttgagaccagcctggccaaactggtaaaaccccaactctactaaaaatacaaaaattagctgagcatggtggctggtgcctgtaatcccagctacttgggaggctgagccagaggaattgcttgaacccaggaggtggaggttgcagtaagcccagatcaagatcacaccactgcattccagcctgggcaacagagcaagcaagattctatctcaaaaaaaaaaaaaaaaaaaatggagtgattgctttaaaattcttaaacagggccgggtgcggtggctcacgcctgtaatcccagcactttgggaggcagaggcaggcggatcactaggtcaagagatggagtccatcctggccaacgtggtgaaaccctgtctctactaaaaatacaaatattagctgggcgtggtggcgggcgcctgtagtcccagctactcaggaggctgaggcaggagaattccttgaacccaggaggcggaggttgcagtgagctgagatcacgccactgcactccatcctggcgacagagtgagacattgtctaaaaaaaaaaaaaaaaattcctaaacaggaggggcttagggccagccagttggtcacatgaaacaatcaggggacttaccttagagctgccttcgcagtagggagtccatggtttttagtgagatttgtgtcgtacaaattaattaaaattgcatagtttctatcaagtttttttcttacactttccacaaaattgggaaaaatgtctatttcccatttctttatttcattttctcttattgcttctatcctacctgatatttcccatttcaaaagcacgtttttttttttgagatgcagtcttgctctgtcgcccaggctggagtgcagtggtgccatctcggctcactgcaagctccacctcccgggttcacgccatgctcctgcctcagcttcccgagtagctgggactacaagcacctaccaccattttttgtgttttttagtagagacagggtttcactgtgttagccaggatggtctctatctcctgacctcgtgatccaccccgcctcggcctcccgaagtgctgggattacaggtgtgagccaccgcgcccggcccaaaagcactttttaaatgttgaggtggtttgaaggctaatggaaattacgaggtgggactgaaaccattccctgccatccctaagaaagcccactccttggaactgccactggtgaaagtctcactctgtcacccaggccagagtgcagtggcacaatctcagctcactgcaacctctgcctcccaggttcaagcgatcctcccacctcagccccgcaagttgctgggactacaggtgcccaccaccatgcctggctaatttttttttttttttttaagtagagacggggtttcaccgtattgcccaggctgatctcaaactcctgagctcaagtgatctgcctgcctcagcctcccaaagtgctgggattacaggcatgagccaccgcgcccggcctgaaagcattttagaaggctcctgactgaaagaacgggataaagtaagggggtatgggaacagaagatgacagcctggtatatctgggtgacatgcgtaggcagtctgttgtagtggcaattgtcagggctctggagttagactgtcttctttcaaatcttgcaagctgtctgatctcgggcgatttacttaacctctctgagagttctgtaaagtggagaataagaataccaccctacagatgatgaggattcaatgagattgggctggatacaaatcagcttttgttggcatcagcttgagaggagggatggacttgggagtggagagggtggatttgggggagaggacgccacacagtggcaggaactcgcagcaggtgactgagagtggaaggcacaagagagcccagatgctgagccagctcagaatagaaacggtattgatagcagaatgcaaagcagtatcactcgaatgacggatgtttaattggatttctccagggctgactcaccgcctttgatagatgcgattgccctcgtggtgtctatcatgagacttgaaatttttccacctgcacctgcagtctttaggccttgtttcaacaaaatgcagtactgtgtgtaccctccatgcctgccagccttccttccttccttgtgtatttactgcaatgtatcagggacggggtggtgtgctagaaccatgaaggaaaaaggcaaagtcccttaaaggaggtgcagtctgttgaggcagaaacacaaatgcctagatggttctggaatgcctagatgtcaatgggataacaagggggctatggctgcaggaaggaagaggacctgatgtagctgagggcatcaggaagattccagaaggagaagggattagtgaagctgcagagcacttagtttgagacaaagatttctgagctgagggaggagttgggcaaaggcttgagtgcaggagttcaagagaactccttggggccaggctttacacagggatgcacatgggctgtgtaccagtctgttctgacactgctgtaaagatactacccgagactgggtcatttataaaggaaagaagtttaattgactcacagttctgcatggctggggaggcctcaggaaacttgcagtcatggcagacggcgaagggaaagcaagcacgtcttacgtggcggcaggagagagacagcacaagagaaaatgagtgtaggaagtgccacatttaaaaccagcagctctcttgaactcctgcactcaagcgatcctcctgcctcggcctcccttagttctgggataacaggcaggagctgctgtgcccacctggagcttaatctctgttcacatctttaattattctgggccagcttagccaaaggccttaggggtagggttagggacaccaagggccagtcttctatccacttcacagctcgctgggccctccaagggaaggactatgtgtctcattctaggcactggtaagagtctgggggaaaaaaaatcaaaaataacaagtggacgcggtggctcacacctgtaatcccagcactttgggaggccgaggtgggtggatcacttgaggtcaggagttcaagaccagcctcgtcaacatggtgaaaccccgtctctactgaaaatacaaaaattagcagggtatggtggtgtgcccctgtaatcccagctactcaggaggctgaggcacgaggattgcttgaacctgggaggcagaggttgcagtgagctgagattgcaccactgcactccggcctgggcgacagaacgagactccatctcaaaaaaaaaaagaagaagaagaagaagaaatgaactcacaacacttactgtctccttcaaaggagtgaaggatgtgcagagggctaagtgcggtcccagaaactgccaggtagcatcagtgagcaggtgcaggaaatctgttggccaaccttgcatgcactgggcacggcccagttccctgccagagcccagagaagaaaacaagctctggtctcagtcgaagcagtggggtgggaagagccctgctgtctcgccacatggccttggtagctggcctatgtctcaatgtctcttgaaagtgaaaatagatcaggagggctgacacgtagtaggcgctcaagaactgttttctggatgagtcagtgaattggtgaacagcattcacctctctgggcattgatttcttcattcatgtaaggtgagagctcttctagctgcagaaatttctttagagccaggcacagtggctcacccctgttatctcagtactttgggaggccaaggcaggagaatggcttcagcccaggagtttgagaccagcctgagcaacatagtgagacccccatctctaccagacattttttttgagatggagtctcactctgttgcccaggctggagttcagtggtacgatctcagctcactgaaacctccatctcccaggttcaagcaattctcctgcctcggcttcccgagtaactgggatcacaggcatgcaccaccatgcccggctagtttttgtatttttagtagagatggagtttcgccatgttggctaggctggtcttgaactcgtgacctgaattgatccacctgcctcggcctcccgaagtgctgtgactacaggcatgagccaccgtgcctggcccaaaacgtttttttaaaattaccaaggcgtggtggcatgcgcctgtagtcccaactacttggaaggctgaggcaggaggattgctctagccaggaggtcaaggctgcagtgagctatgattacactcctgtaagttcagcaaaatatttctgtaaagggccaagtactaaacaccttaggctctacagagtgtacagtctctgtcgtgattactcacctctgccactgtcgggaaaaacagccacagacaatgctgaaatgaatggacatgacttcgttccaatagcatgttattcacagatgctgaactttgaatttcatataattttcatttatcagaaaatgttatgattttgattttccccaagtatttaaaaatgaaaattaaactattcttagttcgtgagttgtaccaaaacaggcagtgggccagattttgactgtgggctatagtttgccaaccccagctaaagattgaggagcaaacgcatcttccaggaattccttggatcgtcttagacagaaggtcaaagggagagtgcactctctccttggtgtggaaatactgatcaccatgtcttccaaactgggtttcatagacacatctccatgccatgctctcactctagaacctaagatggctcccatgttaaggttctttacaacgcagacacatatgtccctgatatgtcctaattgggcagactcttcattgtcacctaccctggcataccacacccattcctaatatttgtctcagctcccccttctctctgagtgcctggaatcttttcctgacccctccaagttgtgccctcccctgtaagttgcatctcgatttgagcagccttctcccagactatcctgatctctgtcttccttgaactccagtcactggctggagctttcacagtcccagtcgagagcatgggctcagatcagactgcccgagttcaagttcctaccacttactctgtgacgttgaacaagttctttatcctgtctaagagataataataatagtccttacctcatagagttgctgcaagagttcactgagatgatttgtgtaaaatgcttaatccagagcctgacaccaatcatatgaaagcattcaataagtactagcaattatacttctgtattgtttgatgtttttatagtgagaccatatttatgtaatatttgtataattttttaaatagaccaagctgggtgtggtggtatatgcctgtgttcccagctacttgggaggctgaagcaggaggatcccttaagcccaggagttcaagtccagcctgggcaatatagtaagaccctgcctctaaaaaagaaaaaaaaaaggaccaagtattcttttttttttctttttttttttagatggtgtctcgctctgtcgcccatgctgcagtgcagtggcatgatctcagcgcactgcaagctccacctcccaggttcacgccattctcctgcctcagcctcccaagtagctgggactacaggtgcccgccaccacgcccggctgattttttgtattttcagtagagacagggtttcaccgtgttagccaggatggtctcgatctcctgaccttgtgatccgcccgcctcggcctcccaaagtgctgggattacagacttgagccaccgtgcccggccaggagcaagtattcttttaggtctaaaacaaaggtaactaagcaatactggtgtttgtttgttttgagacagggtctcactctgtcaaggcagacagctggaaacccacgtcaagaaaattgactattttcaaaagtcaatccttgcctcccaggttggagtacagtggtgtgatcatggctcacccaggagctcaacctcctgggctgaagtgatcctcctacctcagcctctctggtagctggaaccacaggtacacaccaccaggcatagctaatttttttattgtgtagagacagagtctcgctatgttgcctaggctaatctcgaactcctggactctatcgatcctcccatctcagcctcaaagtactgggattacaggcatgagccactgtgcctggccataatttttttatatcatacatacagaaaagagcagtattagtagttgttattgtaagaaaaatgaaaactaaggcagtctagaaagcccttggaagagagaagaataaactgcgcttgaggaagttgacatttgggaacagagtgggaacaagggtcttgaagaaggtgacatttgtttgggaacgagtgtctgactgcaatcaaaggaaaggccagtgtgacaggtggatgtaaatccacagtccattaaaatggccacagagagaaaacagacatattggccttccagggtgcaacatgagggcattcccttcctatgtacactggcaggcacctctccggtcccttggtccccagcaagatgctgagaaattgctgaggccaggggctccctggacacttatcaacacttatccttacccagggatagcgtttaagctcatgaatcctacgaaagctgaaccaatgcacatgtttatcatcttggaaccatttgatttgaggaaattgtaatagcacatgctggccaggcgcggtggctcatgcctgtaatcccagcactttgggaagctgaggcgggtggatcacctgaggtcaggagttcgagaccagcctggccaacatagtgaaatcccctctctaccaaaatacaaaaatttgctgggcatggtggcaagtgcctgttatctcagctacttgggaggctgaggcaggagaatcgcctgaacctgggaggtgaggttgcagtgagccaagatcccgccattgcactacagcctggacgacaagagcgaaactccatctcaaaaaaaaaaaaaatagcatgtgatagtgagatacacattttgcacagaaatgttggctgagatagtccaggagagtctctgtgagctgactttttacctagggtggaggagtggatggaagtggctgttcctacacacccacactgcctgtgcaaaaccgtgggctgcctgcaccacacacacaagcctgtttgattctcatacaaccccaagacaaaggtgtaatcccttttcaacagtgacagcactgaggctgagagcagcaaagtaggtcatagccagtcaatgggggtactgagatctgcattgagatctggctgtgtctaaagcgggttgtatcctctctgtgcttgcagaatggggctcgagggctcatctaaacccctcatcttatttatttatttttatttatttatttatttattgagacggagtctcgctctgttgccaggctggagtgcagtggtgcaatctcggctcactgcaacctccacctcccaggttcaagtgattctcctgcctcagcctcctgagtagctaggactacaagcacgtgccaccacgcccagctaatttttgtatttttagtagagacagggtttcaccatgttggccaggctggtctcgatttcttgacctcgtgatccgccctcctcggcctcccaaagtgctgggattacaggcgtgagccaccgcgcccggcccagacatgacatctttttctcacctgtcttaagatacctgcagcctctgtaacttatttttaaaaggagacaataaagactatttttaaaagtcaatccttgcctctgaaaacctacctctgcctttgtcgtggtctctgctgggtttccattaggctgcaactcaagctgctgatgcctccatttcatgtcgttttcacaaacattttgtaaagcagcagctctattattccagcagggcctgatcacctctccgcacccaacgctgataaaaatgacccgctttcccctatcgtcccagcgtgaaagaccaagatgctgaatgacacgggttggctttcttttccttccgaacattaatcaggttcttgaagataacatctctctctggaacgagccggcagcagcagagtttgatttccaggttcagccctaatggtacagagacctggactaatgtggcttattcaaagttccagccatgcttctaaagcatggcttattcgaacttccagctatgcttttaaagcactttgcatgaactattcacatgtcttttgaacaatatgatttaatggcattggaaaatcatcatgatgtcatgcttgcaatgagcaggacagctgtatgtcttgatccaatacacattaaaaatgcacctatccacacatatgtatctgtgaaaatgtcttcagctgcaagtaacacagcgtccgacgactagtgtcttaaatcttgggtgaccagctgtctctgtttgcctgggactgagaggtttccaaggatctggaaactgcagtgcagaaactgggacagccccaggcaaaccaagtcagttgttcacactacttaagtcataaggacatttaatatttacttgaggctggacacagtggctcacacctgtaatcccaacactttcggaggctgaggcaggtggatcacgaggtaaggagttcaagaccagcctggccaagatggtgaaactccatctctcctaaaaatacaaaaattagccaggcttggtggtggatgcctgtaatcccagctactcgggaagctgaggcagagaatggcttcaacctgtgaggcggaggttgcagtgagccgagatcatgccactgcactccagcctgggcaacagagctagactccgtctcaaaaaaaaaaattttttttgacttgataagcagtccagatgcaggtggcccgagggtcagtggggtggccccaggatgctatcaagggtctggctgtttcctttcctcccctctgccctagatagcgaacctgtccccttctgcccatgggtagtaagccaatcgctgttatgatggatttggcaaaagaaaagaatttattcacaccaacgcagccaagcaaggaggcaggagaaaaggtctcatacttgcctccctgaagatggaatttagggatctttatggaataaaggagcagggtggtctaaagtgtgggaagaggtgattggaggcaaggaaaagtgaggtcattggcaatctgcacatacatagccaagcttcctggatcttcatagggtgcatgtttagaaaatggcagcattagcatgatctcggggagttttgggccctctgacgtcaaaaggtcacttctccggcatttgcacaggttcagttgaagggtcattgatctcaacgggttcgaactggacaggagctgcccccatagtcctgaaaaacaactttaagcaaccattaccgtagtcacatatgtgtcgtagcgacatatatgtgacatatgacatatatgtaccataatgacatatagtgacatatgtaaggaagccggtgggggggttaggtatatatcatttggctgcttgacttttagctatataagttttaagaccagctagaagtaagtggttaaaagcaagcaaggcaagttaagtttggtgggcttcatcaggttagcgttcggtttcgccattctcacgtgagtggctgtaggagcttaggaccaggacaggggagaaccgaaggccctaattatccttcccagaagcctgcccaagcggagtttctcttaagggctttctctaagcccaccaaacttaacttgccttgcttgcttttaaccacttacttctagctgatcttaaaacttatatagctaaaagtcaagcagccaaatgatatttaactaaaccctccactggcttccttatatatgtcactatatgtcattatgttacatatatgtcatatgtcacctatatggcactatgacacatacgtgactatggtaatggttgcttaaagttgttctcttacatttcattggcccagagtagatgtcatagctacctccacttgcaagagagcctggaaaagtatgtgtctagccaaagcaaatgggattctgtgactggcttccatcaaggcagggcaggttgcctcctggacaaatcagagctctgggagaaagcgggaggggaaggtctacaaccagtcatgcccgctgcaactcatggagccacatggagaggagacaacacggtgaaattgtcaagagcaggagctagggctgaatctggaaggccacttaccagtgcagagctttgggtgtgttgcttaacctccatgtactcatctgtaaaatagagctaaaaacaatgtttctcttcctggactgctgtgacggtctagaagagtttatgcacagaaagtgcatttacatgtaaatgctccgtaaatgctgacttcttgtttgccttaatggcagaacccatccttccatattccagaaaaagacttgatttttagttacgtgaatggacacctaaccctgatggacagcttggggtcgggggacaagcttctttcttggaaggatgttcaaaggaccatgaagcttttggttttgccaactggggtttgtaagttgaagaacagagctgagtaattcaggacaggggtgtccaatcttttgtcttccctgggccacattggaagaattgtcttggaccacacataaaatacacttatagtaacaatagctgatgagcttaaaaaaaaaatcacacacaaaaaaaatctcatgttttaaaaaggtttacaaatttgtgttgggctgccttcaaaagccatcctgggcctaatttggacaagcttgatttaggacctgatggtcctcctttagcggaaggtgtgtggaggaggtagagagagagagagaagagatgagacatgaggaaaacagagccatctcatagggacgttgatggagtcctgcagcgtgaatcccgtcagcagttctgtagagctccacctcgcttgtcaatgggttgtgggcttggatcttttgggaggattcaatgacatgctaagggcagccttggaggtggacaaagggccagggcaaaggcccccagggcatgcccgccacccttaggttacatggaggaaaaagattgctgtgaaatacaccagaaccctcggagtagaagtggcctctgctacacgtaggtcaaggttctgcatactttcatcttccttctttgtacttgtttgtattttccaaaatttctacaatgattagggatccattctataatcagataaaattgccatttacaaacttttattggccaggcatagtggctcatgcctgtaatcccagcactttgggaggctgaggtgggtggattgcttgagtccaggagtttgagaccagcctgggcaacatggcaaaaccccttctctaccaaaaatacaaaaaattctccaggtgtggtggcgcctccctgtagtcccagctactctggaggctgaggagggaggatggcttgagcccaggaggcagagattgcagtgagctgagattgtgccactgcattccagcctgggtgacagagccagactccatctcaaaataaaataaaataaaataaataaataaaaataaaaacttttacaaagaagagtataagcactgaaagttatttttaaaaaggttttacttgttagctccattcctcagaaatagtgcttcttccacatcattttctctttccttttttctctgctgcttttttttttttttttttttttgagacggagtctcgctctgttgccaggctggagtgcagtggcacgatctcagctcaccgcaatctctgcctcctgggttcaagtattctcctgcctcagcttcctgagtagctgggattacaggcgcccactaccaaccatgcccggctaatttttgtatttttagtagagacaggatttcaccaagttggccaggatggtcttgatctcttgaccttgtgacctgcccacctcagccttccaaactgctaggattacaggtgtgagccaccacgccggccattttttttttttttttttttttttttttgggagaaggagtctcactctgttggccaggctggagtgcagtggcatgatcttgactcactgcaacctctgcctcctgggttcaagcgattctcctgcttcagcctcctgagaactggggattacaggcatgtgccaccacacctggctaatttttatatttttagtagagaaagggtctcaccacgttggccaggctggtcttgaactcctgacttcaagtgatccttccacctcggcctcccaaagtgctgggattacaggtgtgagccaccccacccagccattctctgcttctttctcacagctaatgataataatagtaaaggccaagggtggtggctcatgcctgtaatcccagtgctttgggaggctgacatgggaggatcgcttgaggctaggagttctagaccatcttggccaacatggcaagattctgtctctacaaaaaatttaaaaattagctgagtgtaggggcatatgcctaaagtcctagctacttggaaggctgaggcaggcaaatccttttacccctggcgttcgaagctgcagtgagctatgattgcactgctgaactccagcctgggtgatagagctagaccctgtctctaaaaaacataataatagtagatagcatttactgggcatttgactgtgtaggtcccaggcactgtgcttaatgcttgatgtgcataataatcccagcaaatagtactgccattattcctatttaaaacatgacggctaggtgcggtggctcacgcctatcatcccagcactttgggaagctgaggcaggtggatcacctgagatcaggtgttcgagaccagcctgatcaacatggtgaaatctcgtccaaaaaaaaaaaaattagctgggcctggtggtgcatgcctgtaatctcagctacttggaaggcttaggtaggagaatcacttgaacccgggaggcaaaggttgcaatgagccaagatcgcgccattgcactccagcctaggcaacgagagcaaaactctttttcaaaaaaaaaaaaaaaaacataaataaataattaaaaatgagttaggtgagacagaaaaggaagtcactgtaccatggccctttgagccagagttgtttggtgccaaaactctgcctcctaatcactacctgtctctccttttgtcctttctccatcttctcctctcttacctctcaaaaattatcaataatttgataattctgtggttagaatccaagattcctcaacttcagtgtgattgacatggtggctggctcactttctgttgtgggagctgttctgtgcacagtaggatgtttagcagtgtccctggtctctacccactagatgccagtagcaaccacacccctccccaacacacactcaattataataaccaaatatgtctccaggcattgccaaatgttcctggggaccaagattgccctgatgtagcctgatctctgcaaaagcgtctggagtctctccagttgaacgatcgctgatagaaactcacgggaacagtctgtgccctcccggcaagtccacgctcattcgaggcagctgtcacctgctaggacattccagggcacgacttgaaaaatgcttggcgtgcctctgacaacaagagatgcaggctgaagcaaggcattcctgcctcttgtcctgaaactgggatgctggcattagaatggacagcatgagttgttcttgagtggcaaaaggcaaggggtcctgctgtggtttgtatgtctgtctcctccaaatctcatgttgaaattagtctgttctcgcatttctataaagaactacctgaggccgggcgcagtggctcacgcctgtaatcccagcactttgggaggctgaagtgggtggattgcttgagccaaggagttggcaaccagcttgggcaacatggtgtaactctatctctattataaagaaacaaaaaaatttttttttgggacggagactcgctctgttgcccagtgcagtggcgcaatcttggcccgctgcaacctccgcctcctgggttcacacattctcctgcctcagcctcccgagtagctgggactacaggtgcctaccaccacgcccggctaatttttcgtatttttagtagagacggggtttcaccatgttagacaggatggtctcgatctcctgacctcgtgatctgcccacctcggcctcccaaagtgctgggattacaggtatgagccaccgtgcccagccagaaaaaaaaatttttaaacaggctacctcagattgggtaatttatacagaaaagaagtttaattgacttgcagttccactggctgtacaggaagcatggctggggaggcctcaggaaacttacaatcatgatggaaggcgaaggggaagtcttacgtggctggagaaggaacaagagagcaaagagggaggtgctacacacacttaaacaaccagatctcgtgagaactcactatcatgagaacagcaagggagacgtccacccccatgatccaatcacctccccccaggcccctcctccaacactggggattatgatttgacatgagatgtgggcagggacacagatccaaactacatcataggccccagtgggaggtgtttgggtcacgggggtggatcccccatgaatagattaagctcttcctgggaggtgggggtgagtgagttctcactcttttagttcctggacagctggttgttaaaaaaagcctggcacctccccctctctcttgcttccactcttgccctgtgacttctgcacacatgagctccctttcaccttctatgaatgtagccagcctgaggcccatgccaaatgtcccatcttccagccagcagaatcatgagccaaataaacctcttgtctttataaagatattatttcctcttcattaaagaacagcttttctaaatgttgggggaaatgtccatagtcattactcaatcaaaacttgtgttcccataagcctaaggaccattctagattttttacatgtttttttgtgtgtgtgtatctataaaatgcatacataaatttttttttgtttttaagcattcacccaaacaaaaaatcacaggtaaacccatatttctgagatgccattattccgagctaaataagagataatcacttcaaggtaaattgaaaattttcctgaagccatacatttcaagtgaaataagtaattctaaataggacaatttaaattggataattttaaagcgtctataattggtttatttgcaaaattcctgaaaggaaaaattttatcactgccatcacagcaggtttccacatccagatgagaaaacaagacaaatgctagtgtgttttaactagctaaacaaaactaagttaaatgaatatttaaaaatttccctagtgggccattccttaacaaaatgttgaaatccctgttgctacattgactaaaagatcatgttgaatggaatatgtaagacttggctcatagaaacctaatcagatggttagagatgctggcagtttaggacctgctgccataaatgtgtgaacaaccttttgtaatctaacctactgacctgcatgttttttctttaccccagctcattccttacatgtagcctcaatcttcagtttgctttactggttcagcaaaagccaggaagaacaactttgtagtaatcagaatgttatccaactgtatattgtttactttatcgtaaatactggtgaacagtggttaataaatagttttatattcctttatgcaaaaaaaaaaaaaagcactcagccacaggcattccttgatagcaacactcaggggactaagatagggccccatgctggtatacagatggcactgctgaaaggagtcagcagccccggcccttgatggagacgctgaggaacgaggcagaaagatcagtggactcagactccgaagggtcgatttctagttctggtcctgcccccatgagctgtgtgtactcagttgagcctctttacctgtttccgcatgagtaaaatgaaaatatgatttctgtcctctggtttttcctaggatagttgtcaggagcaaagtaagatactggctccaagctgacccactacatcccttacctgcttcagtcttctttgtaacatctgaaatattgtatttgggtttaccttctgtctctgctagcaaaatgtcatcttcctgagggcttggtcttctttgctgttgcaagcctcagagatgacaacaatgcccaacatagtagatgttcaataaagacgtgcaggccaggtacagtggctcacgcctgtaatcccagcactttggaaggccaaggcgggaggatcacttgaggccaggagttcaagaccaacctggtaaacagcaagaccccatctctatgaaaattttaaaaattaaaaaaagtatgagctgggcatgatggctgcacagctgtagtgccagctacttcagaggctgaggtgggaagatcacttgagcccaggagttcagggctgcaatgagctatgactgtgccttgggtgatacagcaggaccctgtctcaaaaaacaaaacaagaacaacaaagacaaagacacgcagagtgaatgtgaacctgtgtatcacggggaagttatttgaagatacatctcaacagctatggaaatatcaagccctttgtacacagtgattccacttctgagaatctaaaccccaaataatccaacatggagaagaagccttagaggaactgatgttcatcctgcagtggccaaaattgctcaaacctgaaaagccagccttagtaatcaagatgagggtgtaattagcacaatcccgatgaatctcatttgtgaaattgcagacagccattacaaatattgtttacagcaagatgagttaatttttgtagcacacacacaaaaccataatgtgtaatgcaaaattataatgtgtaatgcaaaactaggttgcaaaagcaacccaattactgagatgacaggagccagcacccactgtcccccatggccacactgttggtaatgtcacacatgatctctccggagggcaatttggaaattcctactacaatgtaagtgttcatgccactagacccagcaattgcatttctatgaatctatcctagaaatgtattaggaaacaacccagatgtctatgaataggggaatagttaaataaattatagttaaatagatcactgtataatcagctgagtgcagtggctcacgcctgtaatcccagctactagctactctggaggctgaagccagagaatcacttgaacctgggaggcagaggttgcggtgagccaagatcacaccactgcactccagcctgggtgatacagtgagactgtctaaaaaaaataaaaataaaaataaatttaaaaaataaaaatagatgactgtatatcaatataatggtatactatgcagccactaaatatgtggagatttgcatatactgatatggaaagatgatcaagactattaaagattattaaattgaaaaaagcaaattgcaaaaaatttttgtgcaataacaatggtgtcatatatgatattataagcatacgctttttttttaaatctggaggaggctgggtgcagtggctcatacctatatcccagcactttgagaggctgaggtgggaggattgcttgaagccaggaatccaagaccagccgggcaacataacgaggtccctctctctacaaaaaactgtttaaaaattagcctgtagtcccagctactccgtagggggctggggttgggaggggttgtgcagaggtgggaggatcccttgagcccaggagttcaagtctgcagtaagctatgatcacgccactgcactccatcctgggcaacagagcgacactctatctccaaaaataaaaaataaaaaattaaacattttcaaaataaaaatgtttttaaaaaatccagaggaatacatactaaaccgttgacaatgattctctccgaaggacagagggagactttcctctatgttgtgaatttctgcagtgtttaaaaaacgtaaactttagctgaaaaacgaaactgaatatgccatatgaacccacttatataagcaaacctaagtcaggcacatgaagactggaaggagctctatcgaggtgttattaacagtgactgatggccaggcaccgcggcttatgcctgtaatcccagcactttgggaggctgaggtgtgcagatcacttgaggccaggagtttaagaccagcctggccaccatggtgaaaccctgtctctactaaaaatactactaaaaatacaaaaaaagttagctgggcatggtggcaggcacctataatcccagttacttgggaggctgaggcaggagaatcgcttgaacccggaaggtggaggttgcggtgagccgagatcatgccactgcactccagcctgggcaacagagtgagactctgtcacaaacaaacaaacaaacaaaaaacagtgatcatttctaggtggtgggataattgagcagtgtttggctttttccttttgagggaaaacctctacaatgagcatgtatggcctcttcaaaagataacccacctttaatagcttctttgtgttaaccgggtgatgctcagggcgtaatgctctgctgatgtaacctgctgttgatggtgtcctgtttccccaggatggatgacatccagctctgcaaggacatcatggacttgaagcaggagctgcagaacttggtcgccatcccaggtaaccatttgcaacttcaccttgtgctaaacaggtgcttgggggcccccagcctggcccatctgtacgcctgggtctggaagacagagcctcattcttgcaatgcagtgctccctgactgcatgtgtcaaacacaacttcgagtcaggaagacctgggttcaagtcctagtgaattctggtcaccttcttgtccttggacaagtcactgtacttctctgagactcaatttctcctcctctgaaaattggctagtaatagtaagagggtctaattcattgagtataaatatcctaaagaggctgggcacggtggctaatgcctgtaatcccagcactttaggaggctgagatgggtggcttacttgaggtcaggagtttgaggccagcctggccaacatggcaaaaccccatctctactaaaaatacaaaaattagccaggtgtggtggcacacacctgtaatcccaggtaaccggcaggctgaggcaggagaatcacttgagcttgggaggtggaggttgcagtgagctgagattgtgccattgcactccagcctgggcaacacagcgagacactgtctcaaaaaaatatataattaaattaaattaaatatcataaaaatcgatgagatgatgcaaactaagtgcttagcttgatatttggcctcaagagtccagtaaatattagcaattatgaccattattatcctacttgggaacagatgaagtgtgtacaaactctaactttgaagtcaccccagatttggtagttaataatgcctgacttatttggcatcttctccaaaaaattttcccctgcccatcaggctgtgttagttgccctctgtggggcttacccttatcaaaatgctagtcccaggccaggcatggtggctcacgcctgtaatcccagcagtttaggaggctgagagggcagatcacttgagttcaggagtttgagaacagcctggcaaacatggtgaaaccccatctctagtaaaaatatgaaaattagccaggggtggtggcgggtgcctgtaattccagctactcaggaggctgaggtgggagaattgcttgaacccaggaggtggaggttgcagtgaggtgagatctcaccactgcacttcagcctgggtgacagagcgagactccgactcaaaaaaaagaaagagagaactgagtaatttataaagaaaataagtttaattggctcacagtcctgcaggctgtaccagaagcatgatgctggtgtctgctcagctgctggaaggcctcaggaaacttataatcatggcggaagacaagggagcagacatgtcacgtgcccagagcaggagcaagagagtgaggcgggaggtgccacacacttttaaaagaccaaatctcatgagaactcactatcacaaggacagtaccaaggaggatggggctaaaccatcatgagaaacctccatcatgatccaatcacctctcatcaggccacgcctccaacactgggtattacatttcaatatgagatttgggcggggacacacatccaaactatatcagaatggatgctgctgattggttggggatgcaatcataggtgtgtgaaaaatgattctcaggggtgctaagtccacttctgggtggcaggtccacgtggatcatcattcatcagaaatgcaaaacctaaagagatatctcaaaaggctgatcttagattctgcaatagtgatgttatctgcaggagtaattggggaagttgcaaatcttgtgacctctggaataatggcagtagtcatttatgtctacaccttagcagaattcagcctcctcccatccttctaacatgggggccttttattagctttacaaaggcagtttagttggtggaaaaggttataatcatttaaactataaactaaatgtctcccaaagctagcatggcctaaacctgggaatgattaagggcagcttggaggttaaaggcaagatgggggttggttagatcagatccctttcactgtcctaattttctcactgttatcatttttgcaaaggtgttttcaaataggccagataagcacccaccattacccttgacttgaatgtttttgccatgctgtcagttcaataactatgtcccaagaggctgttctgcagcaagctctgaacctaggagccgggcttgcagtgatgaacagagaacggttctccactctcaaggagcccccaggttagcagaaagagactgggcccagcacacagtgggtgcccataagtggcagttcttactgagctacaagtgcagcatgatgagccttaaagcagcgtttcccaaccttcaactattgacatttggggttgacaaatgtcagtatcttcctttggggttgatcattttttgttgggggtacggggctctgtgttgtgtcttgtgggatgttgagtttcatccctggcctctacccactacaggccattagcacaacgtacctctccgctacccctcaatggtgatgttacctgaaagggatcctgatccagaccccaaagttcttggaccaagagcaagaaagaatttagggcgagtccgtaaagtgaaagcaagtttattaagaaagcaaaggaataaaagaatggctactctgtaggcagggtagcagcttgggctcctcgattgattgtacttatagctatttcttgattatatgctaaacaaggggtagattattcatgagttttctgggaaaggggtgggcaattcccacaactgagggttcctcccctttttagaccatgtagggtaacttcctgatgttgccatgacatttgtaaactgtcatggcactgatgggagtacctcttagcatgctaataccttataattagcatataatgagtagtgaggacgaccagaggtcactttcatcgccatcttggctttggtgggttttggcagccttctttactaatgctgttttatcaggaaggtctttgtgacctgtatcttgtgccgacctcctatctcatcttgtgacttagaatgcctaacctcctgggcattcagcccagtaggtctcagccttattttacccagcccctattcaagatggagtcactgtagttcaaacccttctgacagtgacaaccaaaaatgtctatagatgtacagatgttgctgaatgtaccccaagcgaggtcaggggggtgtgcaacattgccctatgaaaggaaaataaagtcccaggaccccaattcactataccaaaaggaaaagttaagcttgggaactatgagtcatacaaaaacctacttttttttttttttttgagacggagtctcgctctgtcccccaggctggagtgcagtggcgcgatctctgctcacagcaagttccgcctcccgggttcatgcctcagcctcagtctcccgagtagctgggagcctgtaggcacctgccaccacgcccggctaattttttgtatttttagtagaggtggggtttcaccgtgttagccaggatggtctcgatctcctgacctcatgatccacccacctcaagcctcccaaagtgctaggattacaggtgtgagccaccacacccagccaaaactgcctttctttttttcctaaacagatagctgcaagatagaaaggccacctatcttcccaggggcctccctcaccctgtcaatgtaaattaacagcttatcctaacaggtaggggactaagacaagactataaatcatcgtccctccgcccacccggagacaaatgcacatttgacttcctcctctactccgcgtttcctttatcctatgtaaaatgcaaattcactgagggccagagaatgcaatcctccccttcctgccctctctttcccctttaaatattgaagtccttaagatcctctgcagaaaaaagcacaggccggggatcctattgctgcctgtgtctctttttcccaggtgcctcctcgactttggcaaaataaacctccagattgattgagaccttctcagacactttgcagcttacagctcccacataagaactactactttagtaattagagtgcagcaatctgggtttgaattcagccttagcaggcaggtgaacttcgtgaaagttcgcgacttaatttctctgagccttgaattccttgttgggaaaatgaggccaataatactaccccccgcatggttgttgtgaatatcccataaataacaaaggcaaggtgtaggagtcttccacacagtcttgttgtaagggtagtgtgcgcaatgacagtagaactgaatcctctagctttcgtgagcatttactaggtgcccagcactgtgtaggccctaaggataaacgagtgaatagactttcctagttgaaagagagcgacagctagtgggtatggggtttcttctgggggtgattaaaatgttctaaaatggattgtggtgatggttgcacaactctgcaaatacacttggaacagatgaactgcatggtatgtgaatcatattgcaataaagctgttaccaaaaaaagttaaatgtcaaacataaaacaacgaaggaatgagggaaaagtaccaaagtctattctccacccactagaaaccccaatgcaattgatctggcattgttggctttggactctggcattgtaatagaactcaacttgtgatatggtttggctgtgttcccacccaaatctcatcttgaattgtagctcctataatccccgtgtgttgtgggagggacccagtaggagatgattgaatcatgggggacagtttcccccatactattctcatggtagtgaagaagtctcatgagagctgatggttttataaggggtttcccctttcgcttgattctcattttctgtgctgcctgctgccaagtaagacgtgccttttgccttctgccgtgattgtgaggcctccccagccacgtggaactgtgagtccattaaacctctttttctttataaattacccagttgcgggtatgtttttatcagcagcgtgaaaatggactaatacaactagggtctgctttcctggcacagtaagaccagctgtctccccagagtttttgcagtggtaaaaaggaaacagtttatttgcaaggctccaagccaggaggactgggcagctaatgcttcaagcctgacctcctcaatggcttataggtaatgttctgtccaacaggttcaccttgccctctgcctagacaaacctgacttatcaagactggggaattacaatagagaaagagtaattcatgcatagccggctgagggagactggagttttattattcctcaaatcagtgcccctgagcattccaggatcagagtttttaaagacgatttggtggatgggggtgggggtgcagtgagaatggagtgctgattggttgggtcggagatgaaatcacagggagccgaagctgtcctcttgcactgagtcagttcctgggttggggccacaaggtcagatgagccactttatctgggtggtacccactgacccatcaagtgcacggtctgcaaaatacctcaagcattgatcttggtttttacaatagtggtgttatcttcaggagtaatctggggagggtcagcatcttgtagcctccagctgcatgattcctaaaccataattcctaatcttgtgcttaatttgttaagtccattttcacactgctgtcaagaactgcccaagactgggtataacggaaagaggtttcattgactcacagttcggcatagctggggaagcctcaggaaacttacaatcatggtggaaggtcaaggagaagcaaggcactctcttcacaaggtgacaggaaggagaatgaacgcaggaggaactgcccaacccttataaaaccatcagatctcatggaactcactcactatcataattcctaatcttctggttaatttgttaagtccattttcacactgctgtcaagaactgcccaagactgggtataaaggaaagaggtttcattgactcacagttcggcatagctggggaagcctcaggaaacttacaatcatggtggaaggtgaaggagaagcaaggcactctcttcacaaggtgacaggaaggagaatgaacgcaggaggaactgcccaacccttataaaaccatcagatctcatgggaactcgctcactatcacgagaacagcatggggaaactgcctgcgtgattcagtcacctccacctggtctctcctttgacacgtggggatgatggggattataattcaagatgagttttgggtggcgacacaaagcctaaccgtatcacctacaaatgcagtctagttcccaggcaagaagggagtttgttttgggaaaaggctgttatcgtctttgttttaaatgataaagtaagttcctcccatagttagttcagcctatgcccagtaatgaacaaggacagcttggaggttagaagcaagatggagttgattaggtcagatctctttcactgtctcttataattttgcaatggcgatttcagtgcaggtttttaaaggcaggggtaaatttcagtcaagcagaagttacaggcaaaattgtaaatcaatacattgagattacatatcaattttggcctaaaagggctgcatacgttgaagctggggctcacaggtcataggtagattgaaagattttctaatttgcaattggttaaggaagagaagctttgtttaaaaatcgggggtcaaggccaggtgcagtggctcacgcgtataatcccagcaccctgggaggccgaagtgggcagattgcttgaggccaagagttggagaccagcctggccaacatggcgagacccccgtctctactaaaattacaaaaattagccgcgtgtggtggcgcctgcctgtacttccagctactcgggagactgaggcaggagaattgcttgaactcgggagaggggggttgcagtgagccaagattgtgccactgcactccagcctgggcgacaaagcaagactctgcctcaaataaataaataaataaaaataataaaaatcgggggtcagcagaaaagaatggcatccctggcccatgggtgtgactccctccaggcctctctggaagacacttagaacaaggaaagatggtcagaattcagtccttagtcttcctttatctgacgtctatatgccagtggatccatttggtagggtcctgggtttctgaaaaacaactcagacatatatgctaagatgtttatcttcagtttctatagaaaacaaaacatctccagattctaacttccttggctattgttttaggctactattaccttcttactgataagttgcttattgacttttcaaggctagctaggtgcctagaatttcctttgagggaactcaagattttcctttatttccatgcttggggtgggggtctcccacagaccccaaaagggagtccctgtgttactggtggaaggtgtccaggttcttggtgttttgaacaaagaattggacaaaatgcacacacaaacaaaataagcgaggaaagaatgaagcaacaaaagcagaaatttattgaaaatgaaagtacactccatagggtgggagtgtgcctgagcataggggctcaggagccccaatacagaattttctgaggtttaaataccctctagaggtttcccgttggctacttggtgtacaccctatgtaaatgaagtagtggcccacaattagtctgattggtcgcagaaagcttttgcagttgctttctgcgaccaatcagatatactttcaatttctcatgtgacacacagaaaaggaggagggtttgcaaagggagtagcctccagtccttttgttacttatgtgtggaaagttggggtttttcttttgatttagttctaggaagttggccctaggttccctgcctccagaccatattctcctgcctcacctgatccatctcagcattagtaatttttttttttttttttttgagacagagtcttgctctgtcacccaggctggagtgcagtggcgagatctgggttcactgcagtctccgcctccggggttcaagtgaagtgattctcctgcctcagcctcctgagtagctgggactacaggcgcccgccaccatgcccggcaaattttgtttttgtatttttagtagagactgggtttcactgtgttagccaggatggtctcaacctcctgatctcgtgatctgcccgcctcggcctaccaaagtgctggaattacaggtgtgagccaccgcgcctagccgagcattggcaatttttaaagctttgcacctgattgtgataagcagggacggttaggaaccgccaggcctgttcccctctctcatttcacaattctccaaggattagtctggctgaaaggtacagaaacccatccaagcttatgtaagcacaaaacaaacaattactggaaggacagtggagtctcctgaagccctagggcattacattcatttcccagagctgcctaacaaattggtgcaaactggatggcttaagcaacagaaatgtattctctctcggttctggatgtattctctttcggttctggaggccagacatccaaaatcgaggtgtcaacagggccttgttccctgctaaggctctagaggagactcctttgcctcttagcttctggtagtgttagtgaagtagtgttgttgactggggtaaatacccaaggttcgttgtctctctccaagcagattaaggacacagacactgacatacagaggagtgagtttaggagtggaggtttaataggcaaaagaaagagaaaagggaacagctctctcggtctctctcgagaagtccctgaatgggaattccggcctgtggcagactgcaccaaattttatagacaagcttgaggaggtggtgtctgatttacatagggcccacagattggttggagcaggtgtgacgtttgcatagtgcatgggaaggctggccaccccaccctaatcttatcatgcaaatgaactttccacttgggcggcgccatgttgtcttctccttactgtacacatggctggcaaagagaagggagcgtggagccgccattttgaacatacctagaccaggtggccttttcctatgggcacagctgccagcattcacccgtgtaagcttccagctcccttgactatgtctacagctcgattttactggctgctccttgttagaaaagaaaatgatttgggggttgcttttcattaaaaggaaaaccttaccgaggacttccttaccctatctgcctaaataatttcttcttcactcctgtatcattagcagtagcaaatccatacgagtctgaagcaacttgatacttgcctcctcagaggaaataattccaccagcgggcataaggcagagtgagagaccgaggcaagttttagagaaggagcaaaagtttattaacaagttttagagcaggaatgaaaggcagtaaaggacacttggaagacggccaagtgggtgatttgagagatccaagtgcaccgcttgacctttgatttggggttttatatgttggcatgttccggggttttatatgttggcatattccagggttttatgtctctcctcccttcattttccctcagggcaggttgtgcgcatgcgcagtggcctgccagcgcttgggagaggctgcaaacacagtgtatttacagaagtcatgggcctgattatttgagatgtttttccctcaccagttgagtgttcctagaggaaggtcatataccagttagactccgccattttgcctcttaatgtgcatgcttgagcccagttgcccaactcctgagatctcatcgggaaaccgctgataacttcaggtgttttctgtctgttgggagatggcctttccctggcaccagctgtgaccaattattattttagagagacaattttaacaactgcctgacatcacctgatggttgcctggcattccttgggggggaaatcccctctcctttcttgctcatggctgcctggctacctactctaacagtaacacacacaattcttggcattgcttgccttctggttgcaccacttcaatctctgcctccatcttcacgtgaccctgtgtgtgtctgtgtgtcttctcttctcctctttttttttttttttttctaaaagacagggtctggctgtgttgcccaggctggtctagaactcccaggcttaagtgatcctcctgcttcagcctcccaagtagctgggattacaggttcaggccaccatgcttgggtctctttcctcttctcataaggacacaagtcattgggtttagggtccatgctaataagtatgacctcattttagcttaactattataattacatgtgcaaagcaacttacaaattactttggaaatagagtatttccaaatagaagagatataaactggggaaaactatttccaaatagggcacacatgaactttgggggtgccttagtctctgtggcttgctctagaccgggggcttgtaaacaacatttattacagttctggaggctgggaggtgcaagatcaaggtgttggcagatacagtgcctggtgacggcctgttccttatagatggtaccttctcactgtgcctttgtgtggtggaaggggcaaacaagctcccttgggtctcttttataagggcactaattccattcatgagggttctaccttcataatctactcacttcccaaaggcctcatttcttaatactatgaccatggaggttaggatttcagtgggtggcacctgtaggcaagtggaagatgatgggaaaggtatgtggcacacacgcacgtgagcagcattggccaatgacttggagacttgggctagtcataggtctgtgagctgacgcaggccacttgtgtgagtaggtggtttctcctgggagttgctgcagctgaggctggggaatgcctctattggtgagtgacagaacacatggatgaatggcttggagacagaggtttgcagatgttgggggcccagccagttgttgggtgattctggctaagatctagagagcagtggagggcacttgggaatgtcagagtgctgtcaatggttatttggagagtaaagtcacaccacgagctcctgagtgagcaggggtcctggtgagtcgatgggtgttggtgcgtgcttggagagggcagggagcggctctgcggtgctgacgagtgatttggggaatcagacccaacccacaagatttaccacggcaggagcagtgacaccatcatccaatgcaccaatggctgggaatggggagcggctggcaagcctattgcccttcttcgtgcagtggtggactcctggttaatgagagaaaccaactttctgtcctatccaaatattatgttctccttacccctggttctgcttccagatccagaaaaaatgatcaacgtcagtcgtgggcaggcagacaagctgtcccacattttttattctgaagggatttgagcagaaagagcccaagtgggtttaagtttttgcctcttaattttctcaaacctcatcttcagccctctctcttttttttattttttctctttggcatcctagcacttggtgtttgggacagggttagtgtcattggcatggatgattttcttctgataaattggtttaccttcaccaaagggaaaaaaacaactagttccctcccagcacccctatctgagcctctcctcaccccctgcctttgcagaagaccctggctttgtcatgaccatttactgaaggctctcagccaaggccaagcactccactaagccatttactaacactactgcatttcaaaattgtatgcaatttagtatgcaggatgtgcaggtttattacataggtaaacgtgggccatggtggcttgctgcacctgtcagcccgacacataggtattaagcccagcatgcattagctatttttcctgatgctctccctccccacactcaccctgccctctcaatttttttttttttttttaagagacagggtctttctctgttacccaggctggagtgcaatggtgcaatcataactcactgcagcctagaactcctgggctcaagagatccacccacctcagcctcccaagtagctgagactacaggaacactccatcacatgtggctaatttacagagaaaatttttgtagacataggagggtctcactatgttgcccaggctggtcttgaactcctggcctcaagtgatcctcctgccttggtctcccaaagtgctgggattacaggtggcaggcactatgcccagcccattactcccattttaagcctcactgtgtattttacagatgagaaaactgaagcttgaagaggtcaagttgcttctccaagttcatccagagggtggaagggcagagtcaggtctccaatcaatcctggccgctcagctcaagtgcttttttttttttttttgagacagagtctcgctctatcacccaggctagagtgcagtggtgcgatctcagctcactgcaagctccacctcccgggttcatgtcattctcctgcctcagcctcccgagtagctgggactacaggcacccgccaccacacccggcgaattttttgtatttagtagagacggggttccaccctgttagccaggatggtctcgatctcctgacctcgtgatccgcccaccttggcctcccaaagtgctgggattacaggtgtgagccaccgcacccggccagctcaagtgcttttagtggtcaccctctcatctgtctctctgtaattttttgttttttttttctttcttgaaatgaagtctcattctgttgcccaggctggagtgcagtggcgcagtctcagctcactgcaacctccgcctcccaggttcaagcaattctcccgcctcccgaggtggtggctgacagcctcccgagtagctggaattccaggtgtgtgccaccacgcctggctaatttttgtatttttggtagagatggggttgtttcaccatgttgaccaggctggtctgaaactcctgacctcaagtgatccgcccacctcagcctcccaaaatgctcatctgtctccttgttgatgtcttctttccagaaaaagaaaaaaccaaactgcagaagcagagagaggatgagctaatccagaagatccacaaactggtgcagaagagagacttcctggtggacgatgcggaggtcgagcggttaaggtgagtgcactgcgggtacccgatcactgggctgcaggacagcaaccttctgcttccttccagaacccatcttctgctcctgggactcacagccttgcctaacaggcatggccttgatccacagtctctggacactgaatcccaaggaaccccagccttctggcttgagaattcattttgtatataagagaatttcaaatctgtgcctcttgagggaatgttgttccaggaagtgaccagggaggagtcacatcccataatacatggcagagcttccttcacatcctgtcactcctgaaggcaatgtcttgaaacttctgctatcagtttctaccgaaactctgccacctgaactgacttgctcccaacctctgtcctcccaacctcccagctttgttctcccctttcccttccccttagtggcgccaatgcccttttctaagtatcagggtcttctctttgcatctgctgccttgacctcgacaaccacagccctggagctgcagtgtaaaaacatgttgtaaatgttgaaaatgtggaaagctgtacatgttggttcttgatttttgtttccttacaccagagcaaagcttttagggcctttcacaaggaaaaaggcccttccaacccagagggcaacttgctctttattgtctgtgttctcagagacctttcttcaagggtcctgggactagcagttccactgcccttcttcatgctgcaatggacttctggttaatgagagaaaccaacttttccctcctatccaaatattatattctatggtcgggtacagtggctgacgcctgtaatcccagcgcttctgggaggccaaggtgggtggatcacctgaggtcaggagttcaagaccagcctgggcaacatggtgaaaccccgtctctactaaaactacagaaattagccgggcgtggtggtgcatgcctgtaatcccagctacttgggaggctgaggcaggaaacaatcatttgaacccaggaggcagaggttgcagtgagccaagattgcaccaatgcactctagcctgggtgacagagtgagattccatctcaaaaacaaaacaaaacaaaaaatacagaaaactacaacaaatattatattctccttacctccggttctgcttccagatctagaagaaattatcaatgccagtcttgggcaggcagacaagctgccccaacatagtgagacccccctatctctacaatttttttttttaattaactaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctcttcaaggcagttcagcaagtctgcacccacctactttatcttggtgatccttggaagagctggggtgactcgctctctgagacctgcctcatactttgtgggagcacaggtgaatagggtggcttcaaaatacaaggtcaggagaggtgctgcctcactcactgaccccccagcagggtcctgtaatgtccctgcctctgccctggggtcacatacctacctctgggtaagcatttaccccatcattgatatgtgtctctggttcagagcaggttcaccagatacaacatatacatactgtacacgcataacacgtgacaacatacatgccccatccacaaagcctgttgcttaacctattggtttatttcattggttccttgatgctttccttgcttgctgtgtatcttcttttcttttacccatctactttcacagggagcaagaagaagacaaggaaatggctgatttcctgagaatcaagttaaaacctctagacaaagtaaccaaatctccagccagtgagtatatacattattcattcccctcccccacaaaagagaaaagtatatttcaggccaggcccacagtggatcacgcctgtaatcccagcactatgagaggccaaggtgggtggatcacctgaggtcaggagttcgagaccagcctggtcaacatggtgaaaccccgtatctaccaaaaatataaaaattagctgggcacggtggcacacacctgaaatcccagctactcgagaggctgaggcaggagaattgcttgaacccgggaggtgggggttgcagtgagctgagattgggccactgcactccagcctgggtgacagggtaagactttgtctcaaaaaaaaaaaaaaaaaaaaaggccatttcagagaagtctgggagccataaggggcgcaacaaaatgctttctagagatcagatctagagatcagatttcagcatgggatgacagcaggcaggaccagcctcacgggcctgcaggcagttgcctggggcctcatgcctgaccagcctcatgggcctgtaggcagttgcctggggcctcatgcctagaagggtgccatgcttggtttaatgttctcctgttgctgtctagaaattgttaatacgtttggaacatggggccctacattttcatattggattgaactctgcaaactacgtacctggtcctggtagttgttcctccctaattgcaaagtttggtgcatttcatagaaagaattgggtagctactgaggctcagggagctctggcctctcttaggtctggaatctctggagaagccagaagcatatgtctcagaatattaacctcatcagatcctcagagcaaagagggttttatatgaaataagtttgagaaatgctgtttacttgaccctgtatttggagagtcccagtgtccattaggatattaaagtgatgatggatcctgctgtcaagaaactgtcttttctttgttgacccagcgtttctcaaatgtgtttaactgctgtattagtgaggcctctttcagttagaagaaatggatgcctggctgggcgcggtggctcacgcctgtaatgccagcactttgggaggccgaggcgggcggatcacaggtcaggagatcgacaccatcctggctaacacggtgaagccccgtctctactaaaaatacaaaaaattagccgggcttggtggtgggcgcctgtattcccagctactcgggaagctgaggcaggagaatggcgtgaactggggaggcggagcttgcagtgagccgagatcacaccactacactccagcctgggtgacacagcaagactccatctcaaaaaaaaaaaaaagaaagaaagaaaagaaatggatgcccaattcaaactggtctaagcaaaaaaaggaatttgttggagaaagagcaacaagaactagagcctcaaggactgaacactattacctcccctccttttcttctttttctcatctctgcctctctttgcatgtaagcatcattttttcctacaacacaggccttctccatgggaccagaaccctagaaccatagcttagcaactctgaagcaataccacaggttcttttccctggtatcgaaatacataagtctcagggaaatattctcacccgcccttctgggattatgttcccacctcttagatccattaccatcaccaagaggctgggggtactgggattggccaggaatgtataacatgcccactcctgcagccacagggacatgagctgttagaggaagagggacttgaaatcttgctgggaagacaaaaaccaaaagctgccactgtctataaaactacaaacccagttttcattaacatcctgtgaaagatggttggagggagtaaggaaagagaagggcaatgatctcttctgctggctcctataaccacaaggcacgtgatcactgccgaaggccagcatcctcagtggaccctttcatgaaaggcaaggtagaaaaactccacttagcagcatggaggaggagcaaggaaacttgccttctctattggattatgggtggaaaaaagaaatgattctggcgagaaatcaaaacaccaagcatgcaccacatgcaaggggccaactttacactactcatctggtactggaattccaagttgaaaaataaaaactattgtaaaaccagtgaaatctctgggatcctagcagatttagcaaatgcaaaactgctcagtagggattcttctggatcccatggtatacagtattctcacagaaaaaagcaacccccttgaagatgagccctcaataaaaatgaaaaacccggccgggcacagtggcttatgtctgtaatcccagcactttgggaggccaaggtgggcagatcatgaggtcaggagctcgagaccagcctgaccaatatggtgaaaccttgtctctgctaaaagtacaaaaattagccaggcatggtggcgcacacctgtaatcccagctactcaggaggctgagcaggagaatcgcttgaacccaggatgcggaggttgcagtgagccaagatcacaccactgcactccagcctgggtgacagagcgagactccatctcaagaaaagaaaagaaaagaaaaacccatgaagaactgaatcaccatgaggagaatcagtagatgcaccaaagagaatgtcctcccaagaaccaaaaatatagaactatttaaaaaggaaaataaactaagtacttttaaatgatcaaagagctaagagaaggaataaaacccaaaatgaaatagtaagatgctatgaaaaaagaataagtagacatgcaaaaaactggccttctgaaatttttttttatcaataaagtaaaaactcaatggattaaatacagagacacagctgaagggagaatttatacattggaagacagccctgagaaagttacacagaatgcagcacaaagagaaaaagagatgagaaatatgaaagagaagttataaaaccgagaggatagagtgagaaggtccaacttacatgtgataggcattctaggagataaaacagagaatgggaggtggaggtatctgaaaagacaatgtatgagcattttcaaaaattgaaaaatatgagccctcagattgaagtgacttgaacaaaatttcccatttatctatttaccaaatacttcttggatgtcaggccctgtgctaggcttggcaggtacaatgatgataacagctgactaggagaagggctgaaagttagggttggaagctgagcattgaggaccatataaaatgaggactataaaatgaggaccagctgaggatcatatgaaatgtgcatcagctctccataccacctgaacaaggcctggaacaagacctggccaggggttgcagtggggctgggctgcagatggtcagggctctgctcacctcacctctctctctctgttcctttctccccctctccctgtgcccacatcttgctgcaggctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtggtatcatttataaccagttttttcctacttattataccaccatcttccacatcattaaaagctctttgtaaacattaaacactcttcataaatcatgccaatgtctgtttagtaatccatcttgtggatgtactgtaattcatctaatcatttcctcactattggatgtgtagactggttctaggttttcttataaatagtgtcttggattagccaggcatggtaatgggtgcctgtaatcccagctacttgggaggctaaggcaggagaatcacttgaacccaggaggcagacgttgcggtgagccgagatcgtgccattgcactccagcctgggtgacagagcaagactccatctcaaaaaaaaacaaaaaaagtgtcttgggccaggcgctgaggcgggaggattgcttgagtccaggagttcgagaccagcctgggcaacatggcaaaaccctgtctctactaaaaatacaaatagctgggcatatgcggtggcgcgggcctgtgatcccagctacttgggaggtgggaggattgctggagcctgggaggttccagctgcagtgagccatgatcacaccactgtattccagcctgggcaacagagcaagatcgcaccccctggaaaaaaaaaatagtgtcttgataaacatctagggggataaggtttcatctgaattttttattttttccttaagataaactcctagaagtaaaattattgggccattcataagtagcattttcaaaatatttgtaaattggctgggtgcggtggctcgcatctgtaatcccagcacgtcgggaggcagaggcaggctgatcacttgaggccaggagttcgcgaccagcctggccaatacagagaaaccccatctctaccaaaaaatacaaaaattagctgggtgtggtgacttgtgcctgtaatcccagctactcaagaagctgaggcaggagaatctcttgaacatgggaagcagaggttacactgagctgagattgcgccactgcactccagcctgggtgacacagcgagacttcgtctcgaaaaaaaaaaaaaaatttgtagatcaaaaggtctttggttggacaggccctcccagcaggctgctagaccccagtcctcccactctgcgtgttcgcggctttggtctgcacaccacttcccaccattctgatgctgaaaagggtcccttgggctactcagtgccaccacaatggcctcagaggaccccgtgtcctccttcaccaacctagaccaatcatgaagccagactcttcgtgtactggggatgccataatgaatgaccttctactgggtgacttaaaacagtggaaccgtctcctttcacagtcctaaaggccagaagcctgaaatcaacctgtctgcggtgctctgctccctctgtggggaagaatcttcttttgcctcttgcagctcctggtggctcctggcaccttggcagttccctggctgcaccactccagtcttcacctctgtctccacgtggccgcctccgctgtatatgtgcctctgtgcaccctctcatcttaaaaagacaccagtcattggagtgagggccacccgaatgcagtatgatctcatttggaccctttccttaattacttctgcaaaaaccctctttccaaccaaggtcacattctgaggctccacgtagacatgcatttggggaggacccaattccacccaccacagacccctcccgctccaacgtgcagtgaaaactcaggctgcaaagggcccaccgccctcttttccccataaaaaatgtgggtcaaggctgggcactgtggatcatgcctgtaatcccagcactttgggaggccgaggtgggaggctcacttgaggtcaggagctcatgaccaacttggctaacatggtgaaaccccatgtctactaaaaatacaaaaattagcaagtgtggtggcacatgcttgtaatcccagctactcgggaggctaaggcaggagaatcggttgaaaccaggaggcggaggttgcaaagagccgagatcgcaccattgcactccagcctgggcaacagagtgagactccatctcggaaaaaaaaaagggggggcttggggggtccgggcgtggtggctcaagcctgtaatcccagcactttgggaggccgaggcgggcggatcacgagttcaggagatcgagaccatcctggctaacacggtgaaaccccatctctactacaaatacaaaaaattagccgggcgtggtggtggacgcctgtagtcccagctactcaggaggctgaggcaggaaaatggcgtgaacccgggaggcggagcttgcagtgagcagagcttgcggtgagcagagattgtgccactgcactccagcctgggcgacagagcgagactccatctcaaaaaaaaaggggagaggggagtgggggggtcagcgaggtctgacctcaggccagttatacagcagtcactcacagatccaacgaaccagaggagatcaaaccctcatcaaaatcctgcctctggtacttccgctaagctctgggtacacctactgtatgttcctgtaattcctactgatttttttaaaaaaagaaaacattaaaaaatccaatttatttaagctgtcacagacgcttccagattaccagggccaccttccaagctgggaaaccttgcagactgtggggtcctgcacacctagacttgctccttttagaagccatggaggaggttgataatgggaataacatttattgtagcttatctctatgccttgagcaatgtgctcacactggctggttccctcctcacatcagcctgatgagtcagatcctgttattacttctcactttacagatgaggaagtagcagtaaatccattacccttttcaagcggaggttgcaagaggttgcaagcggaggcagaataaacacttgaaacagtgagtcagatcctgttatcacttctcactttacagatgaggaagtggcagtaaatccactgcccacggtcccaggggttgttagtgacagagtcatcattcatctccctccctccccaccactgtagccccaattgttctttctcttcccatcggagggatttaaacaggtctctcccatttaaaagcaaacagggctggacacggtggctcacgcctgtaatcccagcactttgggaggccgaggcgggcaaatcacgagatcaggagattgagaccatcctggctaacatggtgaaaacccatctgtactaaaaatacaaaaaaattacctgggcatggtggtgggcgcctgtggtcccagctacttgggaggctgaggcaggagaatcgcttgaacctgggaggcagaggttgcagtgagccgagattgcgccactgcactccagtctggagacacagcaagactttgtctcaaaacacacacacacacacacacacacacacacacacaacacaacacaacaacaacaacaacaaaaaaagtgtcctcttccttttagagaatttaaaaaacagggtgaaaccccatgtctactaaaaatacaaaaattagcaagtgtggtggcacatgcttgtaatcccagctacccggaaggctaaggcaggagaatcggttgaaaccaggaggcggaggttgcaaagagccgagatcgcaccattgcactccagcctgggcaacagagtgagactccatctcggaaaaaaaaagtgggggcttgggggttccgggcatggttgactgtgtgactatattatatctatacataatatatagatatatatctatatataatatatagatatctatatattatatatagatatatatctctattatatataatagatatatctatttatatatagatattatagagacatctatatctatatctatatataatatctatattatattacgcctgtaatccccgcactttgggaggccgaggcaagtgaaccacttgaggccaggagtttgagacgagccagagcaacatggcaaaaccccgtctcaaaaaaaattagccaggtgtggtggcagcatctgtaatcccagctgttcggaggctgaggcatgagaatcgcttgaacccggtaggaggttgcagtgagccgagatcgtgccactgcaccccagtctgggcgatagagtgagactctgtctcaaaaaaaaaaaaaatgtatttcctgattcttgccacacctgcccttgatgcatcagactctggctgctgaaataccaagggcggcgaccctgcagccccagtgtggatttgtctgcacttgctgataccagaaactgcagtgggggcaggtgggtggtaggagcgggggttccctcatgcccaggccctgcacctgggaagcctttggaggccatcacatgagctgcctgaggcggatggaagagacggtgccaagcaggcccaatatgttccctgctggccctggtactgctcccctgcggatgctcctggttggttcaccacctcgtgcggagtgaggagctgagcagcccagccactgagcaggatttccctctaagaacggccccttccaccctgcaatgccttcttcctctgcacctcagctcccccacttccaaggcgttccttcccggaacgtgtgtattcttctcttcatcttgctaaggaaagttctggctcttggtgctctggcttggcaccttctaagctctctagcccttttccccccgccccccccccccccaaaaaaaagcgttctcagccaggcgtggtggctcatgcctgtaattccagcactttgggaggctgagcccagaggatcacttgagctcaggagttcaaaactagcctggccaacatggtgaaacctcatctctactaaaaatacaaaaatttgccagtgtgatggtgcacatatgtaatcccagctactcgggaggctgagacaggacaatcgcttgaacctgggaggtggaggttgcagtgagctgagattatgccactgcactccagcctgggtgacagagtgagactgtctcaaaaaaccaaaaaacaaaacaaaaaaccactcaggcttagccatttctctggggtcttcatttccttatgaagactctcgcaaaactggtatgaagtaaaatttgtttgcttttttcctattaatgtctttgtcagtttaaggcccagccagggacactaggagaattgaggaagttttgccgcccaccgcccccccccccagcaatggggacagcaggtgggtggaggccgctgagggcttctgcgccatgactcaccctctgcccatggaagcagctagaaagtgaaggtgaatcccaaagcgcaacgctccttctggcaaagggaacagagagggaacagatcttcttcaatcagcgcagccccctctgctacggacaggtctgctctcccccagacagctgtcttctaggcccccacctctgaatcaccttcctaggtgggaaacaaacaaagataaatgcaaagccaccgttccagccccagtccacacctaacaagacctcctgacgccgctcaaaaggggcacgatggctactcaactttttctgcacaaatttgccatcgtgaaatgtttggaaaggtctttagcagcttttaacattgctgaacttgaaaaaaatgtcatcaagaagcaatttactcaagtctcttctgggtccttttaaattcttgccagagggtgctggtggcaggggtgacggggtaatggcggtctcaggggatgggagggcttcacaactgtatctgtggaataactcttttccaaattggcttattcaaaaagcatgcttagcagtgaccaaaaacgagacagcgggcacgctggatttctttcacaagaagagagagcctaggaattaatagagttttctaactggaaggtttttgtggttactgtattttcccacatgtaattataagctggaacaaaggctggaaaacttggaggatcctgacgacgaagggcccaccatccagccacctgcttcggcgtgtgctgagtttaaaaggcctctaagatgtagacggatttactctccacctcacaattctatttccagaaggggagagaagttgaggagacccaaaatgaaagatggcagaactgtattggtttgtaattcctccccacagacagacagacagacaaaaccactcacttgggaaactcaaaatagatgctcgcttgtaaagtttattgacaactgtttggtcccaacacacaaaacagcacttgaaccacaacaaaagtgttcaaacaaagtagacaactaagaaaaacatctctttcccccaaacccaatccaaaacaaacagtgcaagatgggaaagggggttttggtgataacttttgtcatttttttaaacagataaatttaatccggtatatctttccacccagaaataaagaattacattgtcttaatgctcaaacatcattttaccacatcatttaattaagcctctggataaaaaaatagatagcaattggactggccattgtggagtacattatgaacacaatgtgcttccgaagtcttctctctcattttcagacagcaattgttaagagtcacacacacgtcccagacctaagcagcaactccagtgaatggtactcagacacactcacgggacagcacagaacttgattcttctttgtctgttgcccaaagaacctgttctttgagtctgttccaggtgacttgtaatgatacctcttacggttttaaagtccaccactctttacatgctagcagaactgaagtccaagcgtgcaaactcagccttatgaaatcttagaataaggcaactgatgttctcaacaccaattattattactttgtttaaaagctcctttaaaaaaaattgcacatttgcatttcacttcctgtaacactatgtctgtagaggaaatgccttcaggaggattcggagagtgccataatacttacagggttttttccatggtgttctgtcttgactggggccatgtgttgagaactgggagtcactggcttcatttaaaagatttggggaacaaaaaatctgacttgtaaaaatctctctatagcccttattttgtggcattttatcaaaatgctatgaaatcagagtccattttctggctttctagaagttaccaaatataaacatttccccaaaagaaaccatctaactagtggaagaccttacgccaacaggttctttctgctctatgaatgaatccgccttttttgccggacaaatacaatccattgtaaatgtcaggtttctctagaggggggtgagaggccacccgtcagcggacacctcaggcacctagagaggaaggccattccacaccagacgccacaagaaacccagagatgcttccaacagcgagaagtaacgagagtaaaatcagacacgattaaaagatgctgagctgacatacacacacataaagcttcccagctaccgataccagctttaaaattacaataacaaggttaagtggatcaaccttggccttcctatgtgtaggtagaattcctgtctcttcccagtggaaatcgtattgatcccgctgctgctgaagcacctccccactcagctctgatttgtaatttatgcacttgatgcatattttagaaaatcaggctctttccaatgctgcctctcgacacacaataatgtgtgttgtaatccaaatgctgactttaaatccatgacatcgagaccatctccttttccttaacctaacccatatcaaactggaacacagaagggaagcttcaaacatcctcaactttctagaaagctcctaaatggaaccccaaagtagaaacgtttaaaaaaatttgtgatgaagccacttttgtcaactacagacatagtttaaataaaaaacaaggcacacttacaagtcacatggaagccaggaaccttcacattccaacctgaaaatacactccgaacccctcgcctacccttctcctttggtgtgtgaacacacaggctagcgggacaggctttgcttcaaagacatgccacgcactgggttaatactgtcggaaacaccagtaagcaaaggctgagagactctattatgctacatgtaggatgacaccaccgacgtggctcaatggaagcaaaaccgcttcctgctagttgagtttttagtgctttcttcttttggaacaccattgtatttcataatagttactaaaaatttggtaaaatatattaaggattctttaacaaatgccacaagttcttcaaataattgaaaaaagaaagaaaaaggaagaagaaaagaaagacttcagctcaaagctgtgttcaatggaaaagaaaaacatgatagaacacaggtaagatgaagtcaatggcttcggggggttttcatgacacagaaaaggatgtatttttgaaacccacttttgtgtgcagaatcagacagtgttttcccatcctaattctatattccaaatgggagttaaagcttggttataggtgctaaggaaaagttggctgccaatttgactctatttttgggttgctttttggccgggctttccacggggtccttgctgagcagtgactcggaggtttccgaggaggggcagggaggcacggggacagctgctgagatgcaggacgagctggagtcagaggtcagagttttgctctttcctggtattggaatctccattttttcttcttggtttaaaatcataatttctgtaaacacagaaaagcaaacagattcagatccaggaactgtaagaagtgtgggttttctcttccttgctcatattttctcaaaagataataatagtaataaaaagcttctaaatgctacatctatgccacagtttacatatgagttgtgtggccagtgaacttggcacagaaatcaagtatctataaactgcatcccacctctcccactggattacaaagttggaaagatctctattttgagctataaatgaatgagcaaaggttaaaactttttgtttttccattttggattctctgcccattcattctgcctgccagatattaaggacccataaagctatccacgacttagagacttcctgaggcgggaggccgtgggtggtagggggtggggtcggagcatctgggtgtcagggagctcctggcctgctccatttagagaggacctatgctccccatgggtctattaccggggataaggaaggactacgcagagtgagaattaccctcagaacccaggaagttgagcacagccagctttcccacagtgcttctggactgccatttctgtggctgagccacatgtaattcacctgctctacacacagggccacgctgcttgaaagagatgcatcattatgccttagactcccactgcatagggcacagggctcctgctcccaaaggcccatggaaggtgagagtggcagaggggacagcagagccagctccctgcctaggctgaccctcaagagaagagcggctgacagaactgcccacagtgttttaattattttcctctcttgtccggtgcatgcagttgaacttgcccagactgaaggcacaaaggccacaaccccacaaacgagctaacatcaatgtgccaccaaccctaggggggcactgcacaggagcagggcatggtctaggtctgactgcacaggctggttctatccgcaggcagttacttccccatctcctattttccaagtcaacagcctcagttcttttcctgggcaacagtgctgaacgctgccaagaacaaccaagatggtaaaagccaagccaggagtccacgggttgttcctggtgacctggaaagcagcaccagcagtggggaggagttgggttccaacagatgaagagcagggagggatctgtacagggcagatgggccatcctctccagaggccaggagacaccgcaggacaagagggcttgggttccaatgccggctctgcccttgctagcccagcagcccggggccactgcctctctagtgacggcaccagctgtgccttagtcacgcagcctgtggaataaagcagctgcctttattccacggctctcacctggagccgtggtaagagttaaatgtgatggtgtctgtcagccctgagcacagggtcagtgccaatgcctgcactaggctgggactcagtgtgctcagcttcctgtctgttatatcactgggcagagtccggggctccagccacagacacctccctccattcacccctttataaagcccttgggccctctggacccccaccatgggtgacgtgtacatctggtgacaggtgtgcctgagagcagctgaaccttcacaaagtctgggagagcagaagcccaggaggccccacccacccctgtggactcgcccacagccccgagccaccagccctccagagctgccaaatcgcccttgcctgatgctcgccaggcaacctcaggctgtgcatcccattctgcaggaacccaggtggggaaagaaggtcgaataatcagcacagtgttttccacctgaaaaggggtagtcccttcccacctccgtcatttactatatcagtatctcatcgtggttttgttttaaaccccgaagaaaatccccatgacaacatggagtcacccaccagaaggctcttgagggcgctcctcaaactgaatgagatcagcagattggaggataacggggtctggtctcagctgaggggacggcaggcacgaggggacaggcgcacacaggaggtcgacgggggagtcgtcggtcaggcggagaagctcctgctctgtgtgactgggccctgggcaaacaaggagggccgtgacaccacaggacctccacgcccacccccagcacacaccctgggctcacacctgaagttttccttctaagccttaaagataagagagtcaagaagtatttaaggtattaaaaaaaaaaaaaaaaaaaaacaaaaacccaaaacccactaacaggaagatcctggtaatggaacgccttaataagctagttcttctgaagatccgtgttcttaggaacactggcccctcaaaagacccaaccagagaaaagggtcctgcagtcagcttccaaagagaagggacagcctgagacggggtgtacgtagttaacagcaagtggaagctcagaatccgaagccctgggcctggttccgtggcttcctagctgctgactctgggtgagctgtaatacgtgactgcctgagatttccgagcctccgctgcacaacggaggtcagcactgctgaaggctgtggggcagcttcggcagatgattcccaggagggcgcttcataaaacgtcaaatgctgtgtaactcagttatcctaagggcacaggggacggtaacgtgctatctcgccgcatgttatgaagacaaaattctcacctataacgatgaattcaaaagtccttcagaaaagttagaactgctataacattccaagaattggcctctatctactacagaggtggatctatctgaaatctatgtgactcagtgtaattttgggtaatattaatgcattagtatatcaaatcctgcctagggctgtcctgtgacaaagacgccttgaccagccatgagtcaggcaccctgagccctcttccggatcaggcctgaccttggccttccatgtctgttgctgaacttgccggctcgctctagagtcttagcttgagtcagtttagtgagaatcccctcacccttcacagctgatcgaattccttattcccaaccactgatgtctagatccttggctggcctgcatgcctatagcaagaatcctcttagtaattttccacccactgagccctcactctgctcctaggctatgtattgggagttggctctctctcccctgttgcaagtgtcatgaatatccattataataagtgtcggaataatttttttcttcaacatctgaactggggtaagatgatcattatgggggtgccaacatccttcagggactttaaccagtcaaccatgcaatgctaacagataaaggtcaattttatcctgttactaactaaataccaaaactgctttgaaaaatgtgtggctatgtaacttcagcagattggatgacttgctggagtcctttccctcgctctccccgaccccaaagccgtttctcctagaatttcacaagctcctatgtctctgcttttcctctcttaccactgccgtcagctccaagcttgagttccgaggctgtgtgcgattcgggcacctccaggatgcgctcgccctccgagggctggttttcatgattggcaggggagagactgagtgaactcaaacgacctacaggacaaagagcacccgtcagagagaaatgtcagtgagagaaccgtgattttttaaggggggaggggatgggtgcttacttacttttcatgtcattttttaacactacaattctcttatgaccatgtccttttatccagaccacctgcacacaagacatactactggttaagcagcggaaaaggaggggacagaagccctaacattcaggaagagtgtgacctacggagcctgccttaggctagaatttaggagctgagttactgccaagaagcatgtttctctactctctccttagcttttaaagcaacagaagctgacagaaacatacccctataaaaagcagagtagttcaaaaatcatgagacacagtttcagaaatatcctttataattcttaaaaagactgtcttccaaacaccagctttggcatataaattaaggtagttctcacatgagagctctttgccatttttttgcagaaactgaacaaccacctaaaagaattaagagcaatctctcagaccctttaaactaagttcattatcagcatcttaaagtcctctccctgatggtgccgctctccatctcagccaagcagagtggtagtagtggagctaggctcccaggccccctacatgtgcacaccgtcgccaggtcactgatctcagctcccaggcaagctttgcctgggtccttcctacttcctctattctactatttttactctggctcaatccctccatctaacactgacccagacctctgcagtggccaggatcctagcccagttcccttctccatgcctgcttctctcggctctaccatggacagcaccactggggtgcttttcaaatgcaaacctgggctccagctctctccaacacagtcctccctccttacctggaggagccacgccctccctaaccgagctctcagctccctcttagcctctcgacactccatgccacttgtcacaaccctgcatctgctcatgtcatcatcccctttgcccagaatgctctctcccctccttgtcacgtgcttccctcaggcacatccttgaaggttttgcaacaggctccccaggcttgggaagtgggccctgacacggccctcctcagcgcgcccactgccctgaccgccctgactagttgcctgcttgggggtcttgactctcccattaaccaacacctttctagagttacagcctgaaacttactcacctggcatatagggatttaataaaggtttacagaaagaatcaaggagaaatgctaaaatcatttactttagaccaacagtatgttttgaaaggatcaattcaaaatgcctgccgttccattattctggcagcattttatttttctgttcaggacagttagcctgtggctgttcagaagatgctctcccggaagctgagaaaaatgcccacctgtggaattgctcccaagagctcctccacgctgctgtggccgtaggtcttgggctgcagagtttctccgacatacttggtataggccatggaaaactcatgaaggaaaatctgctggtagtggtaagtatgaagtaaagaccgcacattctttgcaaacaaatacagacttgtgagcttcacacattcttccatcttatcattagtgaaaacctggttaaaaagaaaacgcagcattagaaatattagtgactggccctgccccgtggaaagtgaaggcctcccactgagggaaaaggcccagagttgaagacgaagacaaagaagaaaaagaaggcaacgaagatgagaagatgaagatgaagaaggagacaaagatgacgaagaagaaggagacgacaaagataaagaagacaacaacaaagaagatgaagacaaagacgacgagacaaaaacgaagataaagacgacaaagatgaagacaaagaacaagaagacgaagacaagacgaagacgacgatgaagaagacgaagacgacgataaagaagacgaagacgacgaattggacaaagacaaagatgaagaagatgaagatgacaaaaaagacaaagaagaagaaaggaggaggaggaaggaaagaaggaagaggagaaagaaaaggaggagggatatattcaaggatttcctccaagagaaggctatagcctccagcaaacttcagttctatttgcaagtcgaaggctgcagcggtctgaagagacagtgtgtgagtagggaagaaatcgggggaggcaaactgtgttggcaaatcacggtacacacagtgaacactggggccattaaactgcacctccaaaccagttttccaagaaacactgtgataagaggatgacactagcattctttaaaaacacatcaaaagcaacaagaaacaaacacaaaacccttgtgtatgcagggtaaggaagcagatttctttaccacaaaccttttcaaagtgtttaacatgctatggaatcgccaagagaaaggatattcccaatcttagctggacagggaaagtcctttgtcctgaaatatgcattaacacctgtccagaactggtgttcttaggatagatattaacagagtttagaaaatgctggatgtatatcctttcattatttaatgatgtgtcccacagttagatgataatggcatatcattcttttaaattgctggagctcatttgttaatatcttatttaggatcattttaagggactatcttatgtttttggtattaaatttattttggcttcgtaaaaataaatggtaagctttccttttttctttttcagcagcctagaacagtattttttttcttggggatgggttcttgctatgttgcccaggctggcctcaaactcctgggctcaagtgattctctagcctcagccttcttagtagctgggattatagacgtgtaccaccttgccgggccccagaatggttttttaaaaggtagatttatctgttcttttagggttggttgaaattcaattgttatctcacttggtcctgatgcctttttcactggtatatttcagtgatcttttatagtctcttttatggtaattggtctaatttttaacttcttgagtgaattttggtaacttattttttccaggatttcatttatttactctaggtttttatatctgtcgcccgagaattgcatgcagtattctcttaagattctctcaatcttggagcgccattcttgaaaggctgcctgggggactggctggccaaccttcctttctgccctcaccttactcatctctctcttcaagccaccacataaaccatctcattcagaaagataaaacagtagcgaaatccatcctggaatgggacaaacacaccccagagccaggatcaggagaccaggctttcatcctagaacgggacaaacacaccccagtgccaggatgaggagaccaggctttcactggcttctgccacccatttaggcagggctgcttcactgcctgaggtctcggcgtgttcatccatgaaatggtctctcgggtcccttccagctctacacactctaatctagaccatcaggtaatccggaaatgcccaatcgatagttttcaatgatagttctaaagagccattaacgtgcctacctcaaccaagtatggcaggctcttcagcagttcggtcaaggtcatgaatccatattcacaggggttaaggggagtgttgtgggtactttcgtaatgtctcttgagctcctcaacagaaagatgggtggttccttcccaagacatcaacaataccagcaactgggcagtgagagatcgcagagactttcggttgatcagctgaatctgtctgccagattctatatcggcaacctggggaaaacgagaattcacacttttcagagctcaagagagacaccctaggttatacccaactcagctcacttcattttggttaatgagaccaacagatgaaaaatctctaatttttttctcttacactgaaataaagcaagtgggtttgtttttagcgtctttgggacaccagaccaacatggaagcagaaactgtcctccccctgccggtccataactgaaaactctcaacaagataataatgggggaggaaattgcatcattctctttatttttcattcattctttccaaaccccactataagaaggacacagactggccagctgatggccagtggtccaagcttgtgaagtgtgggttgctgtgctcgaaggggggtagggatggggaggctagactctaagcaacactcacatggcttctgtgcagacccgacttgcccatatgcgtccccagggcgggctggggaggtgagagagggcctactctgattacaaggcaagctgcatttttctagtctgctattactcaccacaaagctggtattttcatctgactagtaactgtccactcctcaattatttcagattctcaaggagataaagggtttaagcggttaaatgcgctgagagggaaaccttacaaaaaagacagagattgtcacttggggaccaaacaccatgtgaagaaacacgcatctggtgactgagccagcaggctgtgggtggcgagggtgaggctgtggcgtgagcctttcctggcacaaaaacaggcagagctttggcacacacacggctccggcactgctctcacaaaccaatgctcatcctgacagcttgtttgccccctttatctggttttcctgccagggccaaaggtcttggcagggctaagtcaccacaagttggcactctttggaccgtggattctgagaggcagagagaggtgggtggcacttgaggagccatcccaagaccagggcatctttatctggttctgacatgtgcccagagccaaggcaggagggaggctggcagggtcccaccctacttatcatgattatgggactgtatagatttcctcctcagaagcgggtttaatcaaccaaccgatacaagtccaggggatcccagtcatcttagccacccagacccccaccatcactacagctgcttaggaaagaaaccaaaccagagcctgctcctctggtgcgacttggatccatcccttgattctcaatcccggctatgcattagaattgcctggggagcttttaaaaacaccaatgctcagagtgtgctgggactaattctataagaatctgaaaggtaaggttggagaagctcccaggagacccagtgggcagccagggaggcaccacggagcctctctcagctctccccattcttgctgctcacaccccagctgcccacccatcacactcacccagcaaagccctaggtcatggcgtggggtcttcctatccacctgagtccacccctttcatcatcctgggcaactgaacacccagggacctgtcccacaccacagccgtatagcctttcaatgccttgcctctgtcatctccgacgacatcctcctgtgttcaatttcactgcagacacccatctccagggtcacagtgcaaacctgtcattaccccatccaacataaatcattcaaacctcctgagcatcccacttgcaaaagcaagtctggagctgctgttggggtgggagtgcagaaagagactctacccgctcaactccgccccttctcaaacctcagcagcatcactgcctcctatctgctcccaatttgccagcccactcccttgcttcactctcctcttttgtcatgctggcactgacattcttgtcaatatttaaattcgctcatcccatgccttttcctgacgcccatcggtaaactcccaccttgaatccaaccacctgctttccctgaaccgacacctgcatagccacaccccaactgctgctctcccagagtctacggtgccaacttgcagtgagctctcgatacccctgcactccacgtgacatcctgatcaagccactctccactcaccatgacaactgtggaccttctccccactcctaagtcctgagccctgcctctcctctctctctctaagcagagatcagtccctctctctagtggaaaaccactcttggaagaggactcccttctattcctgatgataaacatcagacctgcccatgcctgcccccagcctattgccctgtatacttcctccttcctctgtgtgctgtttcctagtctcccacacctcaaggccctcctgtcttaccccttctcgcccttgtatgttcatcttctctctctagacagatccacatcaatggctttcagacatgctcaagtttttccaggtaggaaaaccaacagcccaaatcctcccttgctccctcagccccacagcctctagctgctgccacagccctccatcttcacaagcagacaaaccaggatgctgtccagatgacctgggccattttctcacctctcctcactcctcaccacactccaaggtggcttctgtctacacaaccaacactgccactgacctggccagcagcaccgactcttcccactgagctaaacctggaagtcaggcagtccctctctgaccagccctcctgcgatgctgctggccattcctctgccttggctcagggatgttcggctctcctggttgtgcttcctgctctctcacctcctcctccaaccaatcagtacctaaggagagctctgagcgttcctacctctgccaaggtaagaacgtcttcttagctgcagtccaatacattaaaaaacagtgggggctgggtgcagtggctcatgcctgtaatcccagcactctgggaggctgaggtgggcggattacctgaggccaggagttcgagatcagcctggccaacacggtgaagccctgtctctactaaaaatacaaaaactagctgggcgtagtggcgggcgcctgtaatcccagctacccaggaggctgaggaagaagaatctcttgaacctgggaggcggaggttgcagtgagccaagatcgcaccactgcactctagcctgggccacagagcaagactccaactccaaaaaaaccccacagtgggaaggaaagggagagtgaacccgttctggctgtttacggaattaaatgacacagaaatgtgtgcagctagtaatgggcctgtaactgagggtgccgtccttcatgcttccctttccattccttcctcctggcagtgacttcttctggtcctgtgggggaggaggccgaaaactggcagctgctctgcctaggacaggaagggtcaagtgcagtccaggacagcaaacagcacgagctgccctctctactacagctctgccagtgacaaaggccactctgcaccctcgcttgctcctaagcctactcctaagtgggtgagaatgtggagggagaggacactgtgtgattacgggctcccaagaacgtcacaggcaaaactcacactggaaggagtcaagctcaggccagcagtgctgaggcagctgcacctcatgaccgaaccctggggtgaagagtgacctcatcagttcacaaaggcattgctttggcaaggccattcagaaacacacaagaggaagaccaaaactctcaacttccaaaccaaggcttctattacctaataagcactaatgacacaaaacgagtcataatgctgtgacagttaagtagttcaaggtgtaaataaagaaacgctacagcacacgcaaacgtcctaatgagaattaggtcactgtgagttttatcccatgagggaaaaaaaaaaaaaaaaaaaaaaacatttaccttcacgacatggcagagtttctgagttaaagccgaaatggaactgacatcatagtcttggagacgaaatgtataaccaaaagttttagcatattctgtaaggagatctgtcatcataaggcagttatctttttgggaccgaaggagtttaacaaactgggcagctagagctttgaaccgctccacctctgtcagagtaaggatcttttcttctccacattccaatacctttgaaaacacacggggggaggaaagggaaaataaacaaatcacgggtgtttacagaatagcaaaaaaagtatgcagctagtaatgaaaaaacaagtcagcgttactgaatgggtataaagtttcagttgtgtaagatgaaaaagttcagaagatcggttgcataacaatgtgaatgtgctgaccactactggacaggagatataaagatagttacgaaggtaagttctatgttatgtgtattgtgccacaataaaacaatttttaaaaagcacttcagtagtaaaaaaagaaaataaaatcaacaacagaaatttggtttaacttagcaacagcgaacagcttagcactgatgttacctcatgtactcagacctaccttcaacacgaaggattttaaaagtataaaagtaatgaacaaatattcagtgtaagaaatcagcaggtgtggtggctcacgcctgtaatcccagcactctgggaggctgagacaggcggatcaactgaggtcaggagctcaagaccagcctggccaacgtggtgaaacaccatctctactaaaaatagaaaaattagctgggcatggtggcgggcacctgtaatccccagctactcgggaggttgaggcaagtgaactgcttgaacccgcaggcggaggttgcagtgagccaagattgcgccattgcactccagcctgggcgacaagaaagaaactccgtctcaaaaaacaaaaacaaacaaacaaaaaaaagaaaacctactgaatctttttttcaataattacccccaaaacaagtttgaataatcctttattgaaggaaaaagccatatttatctaaaaatactaatgagtcaggaatatggcttctctgactggaatagcttagattttcatcctctttcgtaactccctacttcccagaaaaacaggtctggaacgtgaaaaagtatttcctatacgttgttcagaaaaatactttataaaattagaatttcttcactcacttgtaaagtatcaggtatggcttcaaaaagttcaagtagtttggtaaacccatagtacgcaagtttgcactgccggccaaagtggtgatggtaagaagggataaatttattaaagggcatccggaaatggggttggtgacgcagcaaatcaacgacatccttggagaactgttttgtcctttctatttcatcctgagtgcgttcttttaaaaaaaccaaaaaacataaaatcacagtttttttctacccatttgtgttcaacatccacactagagtaaatccttttgggaatttataaacgatatcatccttgccttccaaacacacacaacctaaaacaaacacatatactcttccctctttgcaagtggttctcaaacatgttccagggcagaacaccaggaagttatgatattattatattatgaaattcatatatattcatcttataagctagaaacaatgtcatcttataagctagaaacaattttctagcccctgccccatatctattaacatgacacacacccaggtccctgtacttaagcaagtactctagaaattattcccatgaaatcacgcttctgaatatccccactttttttgtttattcatctgatcttcagttaaaacttgctagcagaagagagaatcaggcttcaaaagttgaacaaaaataaacaggagggaaagcttaagctgagattgtttctattaatttttaagtgagaatgggccctggaattctatgatttcatggacatcaatgttctgcaggagcaccgtttaagaaccagataatagaaggaggatacgaccatacagtcaccccttggtgttctcaagggatcgggtccaggaccctgcctggataccaaaatccgcacctactcaagtcttgcggtctgccccgcggaaactgcagacacgaaaaattggcccccagtatccatgagtttcgcatccctcaaatactgtactttctacccgtaactggacctgtgcagttctgacttcaactattaaaatttgaaaggcaaaagaaaaaaaaacattcgagttgtcttcccttctcaagtgtgcacagtaaataaagtagctcagagttcaacagaagagcaaagccaacaggcacggtgacagattctcaactggatgactaaggctcatgtagccacagccaggctgcagaaggcatttgagcaaagtgctgatgatgcccctttttccccttagagtcaattctaaaaagccagcctgcttttgttcttgagaacagcttcacctactttgaagaacacagaatccaaagagcagcagttttcacactgtgctttctgtggaatcttcaggaagcacggacagggagggaaaaccacatcttccatgccacactatgttaaaataacaggagatagacaatatccttccagcaaatgttaagtcacatacctcttttggggatacaaatcaccatttcattatcttgttgggacaagcagatggttgtgtctggaatctctgatacgatgtcaatcaactcacaaacaccatattcagtgacatcccagtcctttgagaaacacctaggttttaacaacggaagtggatacggaatgagtagtatcatcggtagaagaactacaagttttccggccgggcgctggggctcacgcctgtaatcccagcactttgggaggccgaggtggacggatcacgaggtcaagagatcgcgaccatcctggctaacatggtgaaaccccgtctctactaaaaaatagaaaaaataagccgggtgtggtggcgggcgcctgtagtcccagctactctggaggctgaggcaggacaacggcataaacccgggaggcggagcttgcagtgagccaagatcgtgccactgggcgacagagcgagactccgtctcaaaaaaaaaaaaaaaaaaacaaaaaactactacaagttttccaaaagaatgcttaatagaaatactagataactatttagagtttggcagaagataaaatgtcctaaaatatttactttcatttctgttcttttcatcaactcaccagtgataagcctgtgagaattctctcacaatgacctgtttgctggcctgggatttgagaagttttagtaaatcctgagtaaagcgcttcacctgggccctgtgggtaagggtcagcagacgtttggagcccattccaagaatctgcaaagcaaatagtttatttatacacataagacctcagcagacagcgacttccttgctgctggctcaccctctcgttactagcctcagagcatgactccctttatgtagaatgtgtgcaatttgaaacacatgtcgatcaacaaaatgtagttggtcaaaaggaacaaatgtccaaggccttctgaaactcttatcgtttttggcctggcacaccttctcccaaacagtcgttgagtataaaaatgaaaagtgtaatcttttgaaaagaaaagtcgtgagtacagaaatgaaaactgtattggttgtccagacaaattggtctacaagtttttcaagccgtttttagtgagtgggaagctgttataacactgtgagttaactggtaaaagtcttcataggatccagtgctacactctagcccagtaacttgtctccaactagttaaatttagaagaaaggttaagcccttgactctcacataggcaccaacatacaagtatgtggctattcatgggagcttccttgtaatcatgaacagttctggagaaagctgtgctgggatgaagaaggtctatagagcttagagggaaaatactcctcagtcctccaaggagttcctctaaaactggaaactagcagcgttctgaaaaattgagaagccgcctgtgtgtgttattcctgccctctgaagaaagtttttagtggatgttctgcccagaactgacttcttaggaattaaactgtttctttgatggaggcagccaaagccatggaggaacattcctgcctgtaaacaagtaatcccgtgacacgccttacctgcaatacatgaggcactgcttctaataactcaatcagcttggagtatccgtagtctgacactcggcactgctttgcaaaatgatggtgataggatgggatgaaatgactgatgggtatgacacaagatggctggcttttcagcaagtcaatcacttctctactgaactggatcagctgggggttacctacaggactcttcgaacgcagaagccaagggtctagaagaaaaagaacgtgtataagacagaaagcacagatttcaccagctgaaagaagggaaaatggccctgcagtccctggcttgagttcgatcatggggaagcaaacaaaaccaaatacagtagctgctttacgtctcagtttctatattcaggtctcatagtccaataactagctaactaacttattcacgggctgtcaaatgctgtcccactaatcctcaaagttaagcggccaaggtaaagcagagtctactatagtgttatttatagcagaagtcaaagtacacaagaagctcccagtttagaaactagttatatttccaagatccttctgaaacttggtcatgtggaacgtacctttccacaaagttataaatggtcatcaggtaggtggcccagaagagcaaaattaatccatagtggagctgaaaacgttacccagaaaaccacagaaagtgataatgttgtaagattagcatgacataaaagggtgtaaggaacaggtttttgcaccatcttgactgcttatacctattaaaaaggtataagtaatcaaacggaaatctttatagaaaggtggagaggcttgctggtcgcggcggctcatgcctgtaatcccagcactttgggaggctgaggcgggcggatcacgaggtcaggagatcgagaccatcctggctaacaaggtgaaaccccgtctctactaaaaatacaaaaataaatacaaaaaaattagccgggcgtggtggcaggcacctgtagtcccagctactcaggaggctgaggaaggagaatggcatgaacccaggaggtggagcttgcagtgagcctagattgcaccactgcactccagcctgggacacagagcgagattccgtctcaataaataaataaataaataaataaataaaataaaataaaataaaataaaaagtggaggcttgtgggctcatggcttaggagaaaggaggagtggcataatctatggcccctgagaagtctaagacagagggaaaagaaaggaggtgtcccgtaagaaacctgagtacacacattcctaagagcaggctgactcagaaagaattccttggttatcctcaccttttttcctgtagggtaagggaggtgggagaagcaaaagtgttggggacaaagaggaggaagtatgtgtgtatacacaggaaggcaacaagtaaagtgtcgttcacgggcagcagccttggatatctgcaactcaggacatgcccgtaactcagacactcacccaagtctaggtccaaataccttggtcttttaaatttattttcacatttatcaaagtccaaaacgtggaccaaaatgactttcgaaggtaaatctgcattaagtggtatttccttcaaatacctgaaagtacttttttttttaaagacagagtttcggccaggtgcggtggctcacgtctgtaatcccagcattttgggaggctgaggcgggcggatcacgaggtcaggagatcgagaccatccttgctaacacggtgaaaccctgtctctactaaaaatacaaaaaaaatagccgggcgtggtggcaggcgtctgtagtcccagctactcgggaggctgaggcaggagaatggtatgaaccgaggaggcggagcttgcagtgagctgagatccggccactgcactccagcctggtgacagagggtgactccgtctcaaaaaaaaaaaaaaaaaaaaaatcctgggcgcggtggctcacacctgtaatcccagcactttgggaggctgaggcgggcggatcatgaggtcaggagatcaagaccatcctggctaacaaggtgaaacccgtctctactaaaaatacagaaaaaaaaaaaaattagccgggcgtggtggcgggcgcctgtagtcccagctcctcaggagactgaggcaggggaatggcgtgaactcaggaggcggagcttgcagtgagccaagattgtgccactacactccagcctgggcaacagagcaagactccgtctcaaaaaaaaaaagacagagcttcactcttgtcacccaggctggagtgcaatggcttgatcttagctcaccacaacctctacctcctgggttcaagtgattctcttgcctcagcctcccgagtagctgggattacaggtgcccaccatcatgcctgatttttctatttttagtagagatggggtttcaccatgttggccaggctggtcttgaactcctgacctcaggtgatttacccacctcagcttcccagagtgctgggattacaggtgtgagccaacaggcccagcccctgaaactatttttaaaaggtcagtcaactggcaagccaaaagcttcacaaaattaggttgctaaaaggatctgtaaatgtgaaatttgagtttcaaattttttacatagcttatgttggtactttcaaactggccaggtgtggtggctcatgcctgtaatcccagcattttgggaggccatagtgggacgacatcttcagctcaggagttcaagagcagcctggacaacacagcaaggccctatctaaaaaacaaagtctaggccggttgctgtggctcaggcctgtaatcccagcactttgggaggcggaggcaagtggataatgaggtcaagagatcaagaccatcctggccaatatggtgaaaccctgtctctactaaaaatacaaaaaattagctgggcgtggtggctggtgcctgtagtcccagctactcgggaggctgaggcaggagaatcacttgaacccgggaggcagaggttgcagtgagccgagatcgcaccactgcactccagctaggcgacagagcaagactccgtctcaaaaaaaataaataaataaaaaataaaacaaagtccagtaacgccaacccctcaagcattttaggaattttcaaaagatcaaaggacacatccatggtgttttcacacttggcaaattgtgctgctgtttaaaataaaagccaatagcctcctctggtctcatagtggacaggtggtagctccaggacaaaatacctgacacctaccagtgttgggaggcgggggcttgttgtgaatccatttaaccactttgatgccattctgagcagtggcaatgtttacacctggaacacaggtaatgaagtgttctaagggaacacctccttggttttcttgcactacttctagatcgccaaactctgcaatgtaacaatctggaaagctgaaataggaaaaaacaacaaaaaaaggaaaggttaaatcaaaataacagaaaaggaggcgcttgctaaacagaaggctttggtttaatgtatgtgttaatcatttgtctgaatgcccaccaccaggtttgaaggttaaaattaaggacccagggaggcaagcactgaggcactggcctctctgatgcattctgatggcattttctgggtagttttccaggagggggattaaaaatagggcaactgggctccaagtcagttacgcgtctgcttccacatcagcagggacgtgcaggccactgagtcctgtgttggcctttgtgttaagtctactgttgtggctcatggagtgattaaatgaacttctgaagaatacttttctctcacaagtcttgaaatgtatgcatatttgaagctgtgtactctcaacacttgtggagatttcgactgcagcacttatgatacatctcccctctgtggaagaatctgccctcctcacgtttacgtttctaaaatgtagcgcaaacacacattttcttgttgaagtactgagtgaatggatcccatttcagataaacagtcacgtgctgcttcatgatggggatatgtactcaataatgtgttgctgggtgattctgtcacctgagaacatcatcaggtgcacttatgcaaacctagatgctgcggcccactgcacacctaggctggtgcagcccatggttcccgagctacacatctggacagcctgttactgtactacacactgtgagcaactataacacaatggtatttgtgtatctaatcatcgaaaggtctagtgaaaatatgtgattataatcttatgggaccactgtcctatatacagtccatggttggccaaaattttgttatgtggtgcatgactgtactttgactgaaggctaaacacatgaggatgaagcattgtagagtacttatttgtaaagagatgtgggcagaaagggcaggcttcctataaaaagcagaactagggcattatatcgacaaaggctttgagatggttcacctcaataaaggcacggtgccctcgtgggtctggagaagactgtgaacctggggcgcaaatgtcttcaaagaaagaatcacaaaaggaatcttgtaagagtctggatcaaattcatgttcgctgaagaaaagagaacacaattggaagctgacattccgcaggggtctaagatgttcacaaggtcatcctaacatgttccacaatcttatagaaaagaattacttctaaaggaaaacgaacggcacacctgaaatccttattggaacaatgctgtctgcagacaggctcgtgatattctaactcttcaaatataattgggctgcaattcgtggaggagccgtcgtgtgactgggaagaccccaaggggctctggcgggcctgactgctgggtaggagacacaccagccgtccgtttccttgttcacggattgcgaccgtgtctgttaatttatatagatctgacacattcaacttgtgtccaaacctaaaagcaagagaagagagacgctgacttagaaggtttttctttgattatacagaaacacgcatcctgtttaaataaagaacaataaccaagaatggttcctccatctcttcaaaggtaaaactggaataattctactacaaattcattcactagcaaaccagtgatgcttggtactcctgagtcgtctctggctccgaccatgacaatgctcacttcatttgaaagccacccccagcccctgcccagtttctttaagtgacctcaccaaattctcttgagttggaaacctctctcgatgcagctcccctcacttccaattctctgtgttacttctcaccatccccattctcccctctcagaagtatatgtgctttccgtgaccctctcaactctcctatgcctcaactgcatgatccacacaccctctgacactggactccccagttctcctcctgacctgtatctttcttacttggaacttaaaggcactggccctggaggctggcagatttgagttcacatcctgactccacttcaacctgtgtgaccttagtcaagttccacgaccaatcggggcctcactttttccatctgtaaaatggggtgatgatagcgcctatctcacagggtcaatgtgaggattaagtgtggttaggcctggacagaacttggctcatagtaagtgctcagtaagtgttccctggtcttctcactgtctgaccagtgttttcttcccagtgtcctacatatgctcagattcccatctaccaaaccagcccctggtcctcttccacctcccggagagacacactctcccttgtactctcattctcagtctcgtactctaccctgtccctgtaatggaaacatccagctgctcaggagctgcttctgctgtgttacccccgagtctctcagccccttccctactggattttagccacaggactctgtagtgatgactcaaaagttatcagcggcctctgcctcatccccacacctcatgcatttcctcatggccttggatccccccattcctgatgtgctctcttggcacacatcctgggtgctcgcccacatccctggccctggtggcattccatccattcctgccctctatttctccttccccctcccaaccttatctgctctctagtctgtcccaatcgtcttaaaggcaaatgactgccctatctccagagcctacttctctcccaaagaagtccctcaatgtgcagaagactatgtgacctctccacccagctactccaatggcccctaaaacctgaatgtccaaaaccaagaccaaaaacttgctgtacctccttgccatgctttatttccctatttccagtttaactgtgcaaccatcatcccagtcatgcaaggcaaaacactcagaatcaaaatgacctctcccttttaccttgcttgctacataaaactagttactctggctggacgtggtggcccgtgcctgtaattccagcactttgggaggcctaggagggagaatcacttgaagccaggagttcaagaccaccctgggcaacatagcaaaaccccctcattacaaaaattaaaaaatattaactgggcaggatggcggatgcctgtggtcccagctactcaaaaggctgagatgggaggatcatctgagtccaggagtctgaggctgcaatgacctagggtcgtgcccctgcactacaccctgggtgacagagtgagaccctggctcaataaaaattgtttttaataaaaaaaattagttacccactctagtttcaatgacatttgacattttgacatttctgtaacatcgagttctgtcccaacagtatctgctctgaatttggactgatgtagctactttccctctctgcctccttctctcccctgttcctgccctctcagacaccactgctacgagaagagtcttcctgcagcatgattcccatcaccacacctttcccctcccctccttcctccagcacttcagtggctccctattacctgtgggataatggccaagttccttgttcttcccttcctctgtgttctcaaagctttttctcctcctttccaatcagttttcttcactgtccataaggattcacgagcattttctcttcccgctagacataagctcctcaaggacaagacctaagtcttgcccagttctgccttctctgcagtgccttggtcttgtactcactagtccctgctaagcatctactatgggctgggtgcttaggatacagtattatggcagagctagtccctgctgtcctggagcttatagtctagtgcttaaaaatgttcatccaataaatactaaaacttggccaggcgcagtggctcacacctgtaatcctagcactttgggaggctaaagtgggcagatcacttgaggtcaggagtttaagaccagcctggctaatatggcgaaaccctgtctctactaaaaatacgaaaacttagcaaggcttggtggcacatgcctgtagtcccagctactcgggaggctgaggcatgagaatcacctgaacttgtgaggcagaggttgcagtgagttgagattgtgccactgcactctagcctcggcaacagagcgagactctgtctccaaaaaaattaaaaaacaaacaaacaaacaaaaaaaacaaactaaagctagtcaattaggggaaaaataagcacaacactgaggaccaaaggtctaactttgttaaaaataaaagacgttttaaaactgtctgctaaacattcattgacatgtaaatctgaatgccagtgtctctgtctcctctcctctaccaggctgaagttcctcaagagtcattaccatggttttgtgcatgtaagccaccaatcagtactgactggataaagaaaaaatatacctaacttactttttttcatagatatctgtaaatttaaacagaggcaggcaacaggcaggggcatcctgaagaacagacattgtttctgcactgtaaaacagaagtttgattagggaacagaccatttcctccatattacaagttatataaacagagttcataaaattaacccagtgcatatgcaaaataaatttacggatttctggtatgtcagaatgtattttccagaaaaatttaaagaaaggattttagggacaaggcaatgaaagaagattacgttacacagtagaattagtatcaatcatagggttttccacaccagtggagcagaaaagcatgatgaattcagagcaaaagggagaagagcttaaatatctcctgccacactgcagtttgttagatatatgtgattggcgttcccatagataaggatacacaactgaatacaacataatctcaactacagttttaaaaaaccagaggcaccaaaaaacgctcaaagggaaaaaatccaaacaaaactaaaagaagatgccaaactgttaagtgcaattggctttgggccataggcctgtggatggttttttttcccctgcttcttttatgtttctaaactttccaaattttcttcaataagcatcatttttattctgagaacaacaacaaaaaaaaaacccgtaactcgtaatttaagtaatagtgaagtacaagttagaaaaaagatctctgatcatccaaggaaacactcaggagtgggtcctgttttgccagtctccccgaaacagggagacccaaagaagtatcacattttactatgaataaaaccatcaccagacgcttgagactgagatagtcttaaggtagacttatggggctgagtatctatttgacactaaggatatatctgcaaatggagagcttgaagatttgtagatctagtctttacacacaaatctaccttctacctaagatctcaaggtaatattttagacttttcaggcttataaacttttattgtaggggtctactatttttagaacctatttgaacatgttgcgtattattttactcccaagtgcctgtcaagtttaagctgtattccagctttgattaatgacttagacaagagtcaaatggcttgtttctaactgtatcaatctagaataagcattattccacatgcaatcatcacaagggggtgggaatgtgattgaatctatttttattatttctaaaattgtttctgggtcaaatgttatttcctgaaataaacagcttgcttgtttcttacctcagtaaagagagtgatttgctggcagccccggtggcaagtgagaccaggatctttttgctgccaattttgtatctgtggaggctattcactgcaccgatcgcatcttgtaagttttccatttgcacaacagccttgagttgataatctgtatgggggctgagctcaacactcttcacctacaacaggaaaagcgaaaactaaacgctatgtccgcccagaaccctgtcgtcttaaaactgaaggtgaaccatgaaggaacacatttgtcgactgcagcgcttccatgaaggagtatgtctgaactctgctcttctgctgaccaggacgtaagaaagtgaggatagggtgacctttagagatgtgacactggcccggcctgcctgtgtgctctggcacacacaggtttccaaggcaggctcagaggccaacacatgggaagagtgtttggggtcttttctagactctacaaaacccaggacatggccatttttaagaatctactaaaaaggtgcatttttagcaaaattgcacctaaaaaatgagtcaaatataataaggcataaacaagaccagccaacattattttagaatcctacctgtatttcagcaggaagagctaactgaaatccatcaatgttttacttatcaaattgcctttttttttttttctttctgagatggagtctcactctgtctcccaggccagagagcagtggcgtcatctcagcttactgcaacctctgcctcccgtgtttaagcaattctcctgccttagcctcctaaggagctgggactacaggcgtgcaccaccacgcccggctaatttttttttagtagagacggggtttcactcgccaggctggtctcaaactcctgacctcaggtgatctggccgccttggcctcccaaagtgctggaattacaggcatgagccgccatgcctggccacaaattgccatttcaatttctgcctaagacaagagcttttcactgctaggcgtcttgctctctggggctaacattgtaaaaactggatttatagcaccaccctgagcagaccaaagggaaaaggaaggagttcaaacttgttcagtcacacttctatcccggctgtggttatgtatatcaaattaggtcctcttgactagagactccatcagagagtataacaaagcaagcacaagagggaaaaagttaccttgccatgcctggcaaatgcttcctgcaggagctgctgcagctccttccgggataatctgtagtctatgttgctgacttggacatcagcaccatttgcaaatgggtctgggcagtcggcttcgctgctcgaatttgcaatgttgaaagcaagcggggatgctctgtttaaaaggtttggagacatactcctgcttaaaacacacatattgacattattttaaaaaactgttctgtatatttagattttatcatttaggctttgtttgaaactatatacagaagcagattttccacaacacaaccaaaccaaacatttggttttcaaatgtgtttttaatctttttttttttttttttttttttgagacagagtctcgctctgtcacccaggctggagtgcaatggcacgatctcggcttactgcaacctccacctcctggattcaagcaattctcctgtctcagcctccccagtagctgggactacaggcatgcaccactacacccagctaattttttttatttttggtagagatggggttttaccatgttggccaggctggtcttaaactcctgacctcaagtgatccacctgcctcagcctcccaaagggctgggattacaggcgtgagccactgtgcccagctgtgtttttaatcttaaatacacattgatttcagacattgtcaaaagtactatctactgacccctaattaccgccaaccaattaatatatattcttcctttgggttaaagctaaaggcaggaattagaggcagtcctgatgaattaaccttctgctttgtgcattatccttaggaaatcagcctgtgataccaatttaaggcgtctaacctcctctgtgtctctgaaagagttaaacgttcttgcctacatgttacagttctttctgcacataaggaaaacttttatgtggctttttagatgtaattttatagatccatagtcactttctctttttttttttttttttttgagacggagtctcgctctgtcacccaggctggagtgcagtcatgcgatctgagctcactgcaacctccacctcccaggttcatgccattctcctgcctcagcctcccaagtaactgggactgcaggcactcactaccacgcccggctaattttttgtatttttagtagagatggggtttcaccgtgttagccggttagccaggatggtcttgatctcctaacctcatgatcctcccgcctcggcctcccaaagtgctgggattacaggcgtgagccaccacgcccggctgatccatagtcactttctacagtgatctgccaccaactcagcagaacaaacacaatgctaaaaggagctcatgggaatgcaacacggccttacggcttctctgtctcccaagcatcaagaattccttggtgtgagagacagtgataaataattaccatggtttacagaaaactttacttccaaatagcttcctatacagaaccatatgaatcagaaccaccaatgcacggctcgtttgggctttttcctcaacacagcgaacatagggacatctttacatgcccccctgcactggccagggactctccaacaggcttctctttctgacctctgcttaccacaatttccagatggaggaagaagaaatggtgaaagcattgcccctaaatgttaacgatgattacctgaggagagggggactggcagaagagtgatgggagacttactttgtgcatttcagtactatctgaattcttttcaacaaacatactatttcataatccttcctattacatgtaaccacccccatgggtcaagaagctggactcacctagaagaccaagactgagatgcgagcagaggactgacttgcctggatgcaactaacttgctaaaagcagacgggtaactcacttggaatacagtctcctctttatcttttttctctacaggagaactggtaacacttcgggcactgaggttctcctttctaacagaaggggaaaattgaaggcaaaaggtcatatgtcttccttcacattcaagaagcagctatgagaaagagtagtttcacatacttctgactggttttgtaaacgggttctgccacccccgagtttttcggcgtcgacactgcagcacttgagttaccgtgagtgggtacgaccagcctcaggtgaccttgctggtgctcactgtttctatgaccagtttttgactccatgcggcacagctccttcaaagacacaagcacagtggggtttaaattttaagtacccaagatgtgttagatcctttacagaaaacgattgactttgagtatcatcaaacactgaaatcaaaaagggacacgccaaaagcaagcgggcacgtaaaacacagaaacaaaccaaacctaccataaacttcagaaagcaagaggtatcaaaattacctgtaaacttttaacatttgtattttttgtagcagatccagaatttgcctgtgacccttttccaggcgtggctttggcactggaagattgttcacttgcatctttgatgaggcacaattttggattcttaagttttttgggagacttcactttatcagcaattgcatttgaactctttgtttcacagagttctctattttttggagtaaatgacacaatgatcctattaccaaagacatcttcgttttccattcgcttctgagcgcgctctgcactatcttggtttatgaagcggagaattgcactgcagcctgtgatactcagcactttcccaccacaattatcggacaggcgtctgagcctgttgctgacgctcttgccatccttatttgctggtaggttataaacatagagcagagtgtggcactgctaatacagaggaaagaagtgttacgtcaggttaattcaagggcacacattcaatttcaaaataagaacaatgggtgacctccaaacttcagttaacaactttgaagagaagatgacagtgatttagatgggagagggtaaattatttagtgttgacaaagtaactgaatattgttttaaagaatatgctttagctgggcatggtggtgcatgcctacagtcccagctactcaggtgggaggattacctgagcccaggaagattgaggctggagtgactgtgccactgcactccactctgagtgacagagtgagacactgtctcaaaaaataaaaataaaaaagaatatgctaggcacagaggtctgtatactatatgattccatttctataaagcatccagaaaatacaaatctacagagacagaaagattagtagtgcctgggagtggggaaggggattaattataaattagcataatagatttactgaggtgacaaaaatattctaaaattgtacaactcaatttactaaaaattattgtacacttaaaagagctgaattttgtaatatgtaaatcatatctcaacgaagttgttttttaaaagtctatttattctgcaggtctgctgaataataacttatagagccagaaggtgagcagggtcagtcctggttggtttttgcataggagaatgcctgggaatactaggagctataggcttaagtaaacaaaaatttttttaaaacccaacaatttagagcctgttcagcttcaacagcagattgccagtagttaggctggaagttttatttggcagtgggtagtcataattcttccagataagttgaaatttatgtattaagaagtagaacttggcctggcacagtggctcacgcctgtcatcgcaacactctgggaggccaaggcaggtggatcacctgaggtcaagagttggcgaccagcctgaccaacatggtgaaaccccatctctactaaaaatacaaaaaaagttagctgagcaaagtggcagacgcctgtaatcccagctactccagaggctgaggcagaataatttgcctgaacccaggaggcggaggttgcagtgagctgagatggcaccactgtactccagcctgggcgacagagcgagattctgtgaaaaaaaaaaaaaaaagaaagaaagaaagaaggaagtagaactggagaaaaagaaagaaaagagagagagagagagaaagaacgaacaaacgaacgaacgaacgaactggccaggcatggtggctcatgcctgtaatcccagcactttgggaggccgaggcggggggatcacttgagcccaggagttcaaaaccagcctgagcaacacagtgagaccccatctctattaaaaatttttaaaaattgccaggcattgtggctcactcctctaatcccagtacttagggatgctggggcaggtggatcacttgaggtcaggagttcaagaccagcctggccaacatggtgaaacctcgtctacaaaaaactagccagaggctgggcacggtggctcacgcctgtaatcccagcactttgcgaggccaaagcgggtgatcacctgaggtcagaagttcgaggcaagcctggccaacacagtgaaaccccctctctactaaaaatacaaaattagccaggcgtggtggcgggcgcctgtaatcccagctactcgggaggctgaggaaggagaatcaattgaacccggcaggtggagtctgcagtaagcggagatcacgccactgcactctagcctgggtgacagagtctcaaaaaaattttttttaaataagaataatattttaaaaagcagaaccattaaagcaccaggagaaaacttaagataattatataaagggttaaatccagaaaccataagagaaatcactaacaacaggcaaaggatgtgaacaatttacagaagaaataaaaagcaaacaacgataatcataaaaggatattttgcactgtgttaaagattaaaagtcaattataagatgatgctgtttttcacttactggcctggcaaacatttaaaacagacactcttatgagtgtaaattagtaccaccttcctggaggaagacatggatcttgctagtaaagttctaacccagaactcttatgccttggaaattaccctatggtatgtcagcccaggagcctaaagatataaattaccttgctggaaatggtaaaaaacaaaacaaaacacaaaactgggtataaacaaaatgtccactaacaggtagactggttaaataaagaccagccatacaagtacttttcaaaccaaagttctggtttttaaaatgtggcagatttatattaatatatattaacatgaaaagacatccaagctctgacatagtttttttccaaaagccacagaacactgtatatgtgacacatttttttttaaacgtacattttttaaatctggagggcaataccaaaatattaacagtggttacttctggagggtagaattgtggggttttcactttccacatttctaaatattgtgttttgtttgtttttacaatgatcataccatactattcttttctttcttttttttttagattttttgagacacagtctactctgtcacccaggctggagtgcagtggtgtgatctcggcttactgcaacctccactttcaggttcaagtgattctcctgtctcagcctcccaagcagctaggactaccagtgcccgccaccacacctggctaatttttgtatttttagtagagatggggtttcgccacatcggccaggctggtctcgaactcctgaccttaggtgattggtgatctgcccacctcagcttcccaaagtactgggattgcaggcgtgagccacatcactcggcccacaccatacttttctaatcagaggcttttctttttatttgaggggtactgaccaattatcaacaaaatctacacttttcctattacacctgggactcaaaacccaggcagtaccaatgtatgtttaatttattaaaattaaaggaacagactaaagaacataaaaagaaatgtatcttaaattatcactctagtggatgggaaaaaacatccagcaaaactaaatggtttgaattatcaaaacattgttttggtttttttaaccataaggaataagaatctccaaagtgggcaagttcttacctaaaacactacatttacttttttttttttttttgaaacagagtctcgctctgtcgaccaggctggagtgcagtggcgcgatctcagctcactgcaaccttcacctcccaggaaaaaacaccgtatttacataaggccttcaaagttagaaaagtgaccgtcaaacagaagcagaagggaagaaatgtaactacagccaagtgactaaaaacaaataatgacaaaggtgagttaggaaagagcctcaaaagattaaggtaaggcctgtatatgcttactccctgggtaagcctctggtatccacaactctcaactgtccatagcatgagtttcaacttaagccagaccgcagggggcttgttgggtatcggggacacaggtgactagcaggcaagtgccggaatcaggatacccggggcccactctcttaactgctgcaatcaccaatgacacgtttactttttctaagagctgatttctttctcccttaaatgaagactttgcatgagatcatgtctaacgtacttctgtaactctcagttattaaattatatgtgaagactttcatttaacgtatgggattgcccactctcctggatcacccacaccatggctccttctccattatcattaattctttcagagttacacacatattcgccagcggcttaaacacagcccagcactgcaataaacattcttatcccaagtcaagtctatcagaaatgctagtcctggaaatgtgctcacaccctcctcccagtatatggcataaacaggctacacacaggtggagcaataaccactcctgctaattgtgtccatgcaccacagggaatgcacaatagaaagcacagactcagaggcccgctgaagcttaaggattaaataccgaaaaaaatgcacaattgactccacttatttggtgccaaccacacaagtatgtgagaaccctcgccatattctctacccataatacttggaagcaaaaagaatcatgacttttaatccgttatttctatccacctgacacaaaacactgctagctttgaagacactggcaagttgggaaggtaaatctacaagtcaatttcatatgatattttgaaataaataaaagcaaacttcatacataccaattatctgtatatttgtgagaagaaccgaaggtttctaagccttacttcaaaatctaacccacctcttacaaagaacagccccatctgggcctggcaacccccttattatgggctgtctttcagcctccacaatgtaatattggaaaatggcaaaaataacgcaaacccacttactggcatttttagtggtaacctggggggcaagtcggaaatgaactcttcaaatctgatcagctcgttagcatgatgcagcagtgcttctgaggcctggtttttatggaccaaaataatgtggaaaccatgcctgtgtctcaggtcactaagttccaatgcaaaattgacatcagctgaaagaaaaggtacagaccaaccccatccccaaacattagaaacacttgacaaagacagacaactctattgacacccactgagaagaaaggaaaggctggactatattcaaaattgcttcccccgtttcttaggaaagaaacacgtttcacatcagaagaatgtaagacaatcttaccaaaagaattccaagacacatatgttactttcagtattaaaaaggagcaaatatgttggggagactcaaatttgaaaattaacttaaactttaaaaattattaatactgagcacaaggtaaaaaaaaaaaaaaaaatcacatttttctttaataaacctggtcccggccgggcgtggtggttcacgcctgtaatcccagcactttgggaggccgaggagggtggatcacctgaggtcaggagtttgagaccagcctgaccaactggagaaacccccatctctactaaaaatacaaaattagctgggcgtggtggaacatgcctgtaatcctagctacttgggaggctgaggcagaagaatcacttcaacctgggaggcggaggttgcagtgagccgagattgcgccatcgcactccagcctgggcaacaaaagcgaaactccatctcaaaataaataaacaaaaaaataaaataaaaaataaacctggtcccacaataactcaagttccaaggaggaaatacagaaatccacctagacccaattttttttctaaacagttctcaacaataaccataaacatgtctcatgtacttcagcctctttggggatacattttactttcacatgttgctggcttctatgataatttcccacacagtgagtttagctgaaattagcagatgtttctgtacttacttgacacaagaaccactgtggctggagcagtgtgtgtatttgcaaatctgcggagactctgccgcagtttatcatcagcggcattctttgcagtagcattgatgtgggcaacggttacctgcattaatttataataagggtgaataagcaggagctgaggctagaaaattgctacacattctgcccatattttttattttttaaattttattatactttaagttctggggtacatgtgcagaacgtgcaggtttgttacataggtatacatgtgccgtggtggtttgctgcacctatcaacccatcatctaggttttatgcccccacatgtattaggtatttgttctaatgctcttcctccccttcccccaaccccgacagacagaccccagtgtgtgtttttcccctccctgtgtccatgtgttctcactgttcaactcccacttataaggcaagaacatgcactgtttggttttctgttcctacattagtttgctgagaataatgacttccagcttcatccatgtccctgcaaaggacattatctcattcttttttatggctgcatagtattccatcgtgtattatgtgccacattttctttatccagtctatcactgatgtctgcccatattttaataagtaattcttgagaaaaaaattcttattactattgggaatggtaaaaaattacaacagatctcagtaatctcaacattggttcttgatatgaactgggtttgtgactaaccctgctctcatctccaatcttctgtttttgcatttctttcatcctcctttcagaaaataagtagaatataggaagtgaaatttgaactcagttaaatttgctctaatagcttctgccaacaatttggaggtggtaaagatcagacaaatgactaaaataagatttaaggctgtgttttatgtcaactgtccatgctacccatgcaagcttgtgcaatctgccttttgttgttgttttctgttttgttttgttttgggcttttagcagctggaagccatagtttttagtttccgtccctactaataagcagaaaagagagataaggaaggtgctttactagcccaaccagaaacagaaactgagaatccatgattgtattctctcccttggacacccctggatggctttcaggatctggggtgaggtggtagagagaggagggaggatatcccctaagggagctaaaatgcatttatttctgttaaaactatcaggctcgcatataagtccccaaaggaaggaaaggtttattttgagaaagttgcctcaggcacctgcaatacacaataataacttgctggtttttgtaaagaacatgggtatatcattttagacaagcaatatggactatcaatataattaattatctaagagtcaaaagacccaaattctagtttcagcttaaaagcagactctgggggtcagacaaatctagatttggatctttgctcttcctggccaagtgatcttaaacaagtttcttcacctctcagggccttagtttaatttgtaaattgtgaattatatattctacgtgcctggttcaaagagcagtaatgaaaatcaaaggaaataatacatatataaccattataccagtatagaactaaaatataaattagggagcataactgaaagaatgattaaattatttctagtactttggaagtgatcttttgctaatttattttatttgaaaacttggcacaaatgcaatatcattaaacaaattttcaatcagaattctaaaaaaaaaaaaaacaccacacacacacacacacacacacacacacacgtacagcacttttagaggccaaggcaagaggactgcttgatcccaggagtttgagacaagcctccaccacctaaccctggatcctgaaagccatccaggggtgtccaagggacagaatacagtcatgggttcttagtttctgtttctggttggaacatagggagacctcgtctctacaaaaaataaaaaatgagccgagcatgatggcgtgcatctgtgatcctggctagttgggaggctgaggtgggaggatcactggggtcccagggttcgaggctgcagggagccatgaatgcgtcactgcactccagcctgggtgacacttagactctgtctcaaaacaaacaaacaaacaaatatctgcttattcctctactgtagattaaaattattaaattttttttttttacctggcaattattcagctcttgaataacttccttgttttctttactgatgtcacatacacagatgaattctgcttctctgtggcctttaaaaaacttctcacggattctttgcacaacagcagttgctgaccggccagagggaacggagcagttttcaatatcccaaaaaactccaatggggggtaagttttctagcacctgtccagctactgcaacttctggtgacccttaagaaatgttaacattttcaattacttgtagtggaaaataaatggcaagttacaataagataataaactacctatcattctcagtggtagaaaaactaaattattaatgaatgccaagttttaaggctaccaacctcactggttgacctaataagcaatcaagctgtcaaaaagtatcactctaagagattatttctgtttttcaggagaagacaaatctaaaagtcaagtaactttaagcccacaataaatccacctccaagcatgagccactctgacattaagcagtgatgcttctctgaacacaagcacactaactgaccggatactgcagctccaggacccgactttcaagcttagcccacacttatctacctacttggtagtaaccaacactgaggagctgacaaagggtgaagctgttactgtcgttgattttgagttaacgctgcattaacatctgatttaatattttaaaaatgttttcaaaacgtcgcattaactactttttagggaaattattttaactgagaactctttggttttcaaatactgtttttaatcagccattagtaaattgttctaagcacttctagggagtataccatcaacaagtgtgatttccaacctaaggtgacaccaagtcttttccagcacttttatttctcctgatatactaccaatttttctatacacagcttctgtgtatagcctcggcccaacataaagggcaaatgacttcctggtccataataataaaaagatttctaccaagatatggaattggagactcacatacacagtagctttagaaccataaggaatccttcaaaggtgattaaatgcaatgttagtatgagatattgaaagctatttaaatatgcacattttatgccatactgtcatttaccaaattttgaagcagctttgcctagactggtcgccaataacaacgtggtctccttccctgttcctttggttccacagccattacacagagggacagcaagaggtgcaggttgagtatttggaggtggtatatttggccagactttagccgcatcgattatgctatttcttgctggctgttttaaattttttttaaaaaggaggaggtgtcagatacatcatttcagaagctggagttatatacaacaactgaaaatacactctaagtgttttacctttccacttgctagcctctaataaaaaggactttcaaataatctttccaagaaccattagctatcagttcataaattcatttccagaagtgacttgacatgatcaagaaagatattcacgtggtcagatctttacattctggggcatgagtctgctgcaacgaagacctcacacatattttacataaagggtagcaaagtctcacttgaacaccaatgtgactgaggccaagcttcaggtttcccacattattgcaaaaagacaacatgcagttatctaccttacatgaatgggcccatgtgtaagctgaatgtaagttataaaaaatccatcgtgctttagcctttaaacatagaacacgaaggctttgccaacctcttgtttgcaacaagaggctctaaaagtataaactacaaaaataatgactctctacttttttgaatgatctcccatcttaccctttgtttctttcagaaccagcaaaaattatgctgatggggagattcccctataccatgggagaatcttcaaccccatgtataatacttttcaagataaatccacttcaaaagtcattcctcaatcctcagctgcacccaacttaagaaataaaaagatacgaaccttgtttagacagtcttcgcagtaaagtgagccctttaaacaaaccggaggtaccacattaaggtgcaaagagttggtgcacaagtgaggcgttagctccgactgtgaaatgtgctcttccaaatgccctggagccccgcttgtgaaatcagaacaggggaaatagccagcggaggtgcagccctgcagactcggaaactgatgcagcttgtgcacattaccatgacatgactggaagtggagttttccacaacagggcaggtgtttgcaggaagacaggttactctctagacacatgctgggaaagtcacttgcaatgcctgccaaattgttcctagctgaggcattctggagtgaagatgcagactggaaagcaaaccctgaccctacctgacacgtgattgtcctggtgctttgcgagtctaacagtgcgcccgggtgaatcaagctactggtacctccgctaccgccaccaccaccaccaaaacgcattggcgaagtggagggttcattagggcaatgagcacagcagcttactttggggacagaagaaagctgtattttaggctgctgaagagaacgaatatcaggaagtgggactgctggaaaaagcttagagccagcatgaaggggtgatggtacatcctttagttccacagcaactttcttgttctccatgtactctttctgagaaaagaaaatcagaacataaattaattttatgaggtccgtggttttttggttactcatatcttactgcatgcacaaacagaaatagtgttcaattctgttacatcactaaatcataactgaacaaaatggaatcacagctagttaaaaccaggaacattcttcagagaggtctgcaggacatgaacactggaacacacaactaaaattaagactacattcttcctgaattgaaacagactggggtgggagggcctgtttacatctttagcagccaccatgcctcagtaacttccttttggtaatttccccttgcctcacagaatcttctgaagacaaaataggtggtatgaaaacaacccctcacaaacagcattcaataaagatggctaacacacacagtggtttgaggacaatacttaatagttctgtggtcaggccataaggggttttagtaagatcccccaaaggaaaagagtaaagtttcaaacacagatgagatcagccatctacccagatggcccatccgtgttgctgatgacatttcataaaccctaagatatcatgacctaaagccataatgacaattatattgcagccagtgaaaagatttagagaattagaaaactatccaagaaaaagatccaagacaaatagtttgccacatgactccaacacagacacaggaagccagtatattacaaaggttctgagcagagcatcagtggcagagacctgggttagaatctgatactcaatagttgtatgaccttgggtaagttacttaacctacactttggtttcctcatccataaactgggaatacaatatacctcctagagttgctaggaggataaaataagatagagcacatagaccacctggcacagtacctagccactgaaaggggactgaattcatcagccttcacaggctgactgcaagagacattaagatgaagagggggccctgctacagtgactgagacgtgctcaccgttcacagcatatgagggtccatctgacgcctaaaattccactccctttgctgtgattctacactcacctgggagcataggctcatctggaagaaatgtgaattttcagctaaactttccctaaaagggagataacagcaacgggctgaccagccaatgaactgccctcttggtaattatagttcagactgaaattaacacactggtattctgatttatacagatcaggctcatacaggcaggcttactatgagttgatcccctgaacctactccattctgcatgccactgacaaaattgagtttcaagatctgtaaagttgaccgtgtaattctgaattgtgtgactccatgaggaccagatctaccaccccatcccaggaagccttgcttttgatgccaaccctcactgtcaactgtctctaaaataaaacactcctaaaatgacccaaattacttgatgtcttgcaacaaagacaactatatagtgaaaacctagagaaaatagagaattaaactggtttttaaaaagttattaatacccggccaggcgcggtggctcacgcctgtaatcctagcacttgggaggccgaggcgggtggatcacctaaggtcagaagttcaagaccagcctggccaacacggtgaaaccccatctctactaaaatacaaaaattagccaggcataatggcgagtgcctgtaaacccagctactagggaggctgagacgggagaatcccttgaactagggacagtggttgcagtgaacccggatcgtgccactgcactccagcctagggggctgagccgagactctgtctcaaaaaataaaatcaaataaaagttgttaatacccttatataaaattatattacagtctcacttgaatcccacatacaatagaaaataagaaatagaaaggtggtaacatgagtgcatgaagtcaggaaatgtcaaaattggctggacgcggtggctcacgcctgtaatcccagcactttgggaggctgaggcgggaggatcacttgaggtcaggaggtcaagaccagcctggccaacatggcgaaacctcgtctccactaaaaatacaaaaattagccaggcatggcagcacaggcctgtaatcccagctactgaggaggctgaggcaggagaactgcttaaacctgggaggcagaggttgcaatgagccgagatcgcaccactgcactccagcctgggccacagagcaagactgcacctcaaaaaaaaaaaagaaaatgtcaaaatcacaatgagtaagcaagaagttagagacataaatgtatactgagaagtaaatattcaagagaaatctcgaaataaaaaacaggcagtggataagctcttcccaacccttcctagattatagactcaaaactcaagagggctacagtaaaatacaacatattttgtattttcctctgattttactccacaatgtggatttttaatctttgttacctgtgactttaatgaggaagaaatctttcccaaattttaacattaaatattcaaggcatctactgttactcaaagtgaaatagaagagttaaaaaattgtgctgtgctctcacattataatgtggtataagaggcaatacaggcaagatctacagaaaaatgtggcacagactctaggatgagagactgtatcccagaccaaatggacctctctcatctatttggatgaggaatctgctacatccttagtcttgcatatagttaccgtttggggactatgtggcagcgtctgctcaggacgagaaaagcaattagagaatttccaaagccatggcttagcatcattatcttgttgaagccatccacgtgttctactgcaggagttctcagttccgtttccttccatcatacagccatgcaaagtgattcaacatcctttcatctttcttttctttcattcttccaccctgttaagaatgagtaagatttcagtgttatttccttgcataagtacaaattttacaacatactaaaatgtgaaaccacagctatatttacagtcctatggctctcaacaattcaaatctttgtttcaagaggaagtctcgctctgtcgcccaggctggcatgcagtggtacgatctcagctcactgcaacctccgtctcccgggttcaagcgatttttctgcctcagcctccagagtagctgggactacaggagcctgtcactatgcctggctaatttttatatttttagtagagatggggtttcaccaagttggccaggctggtcttgaactcctgacctcaagtgatccaccctcctcggcctcccaaagtgctgggattacaggcattagccactgcgcccggccaacaattcaaatcttaacaaacaaaataataataataaaataaagaaagaaaaaaacacaaaatatcagagcatattacgggttaataaaatttggtaaacttggttgactgtttatgcttaaaatctaactgcaacaacctgatttcttaaaaaatctataatctgccattcttcatgtttcatagctcttcaaataaaaaatgaactctccatgagtcttgtttcctttccacatgtaaccatgtttgagagaggtagccatatcttggaaacttgcatattccagagtgagacttcacctcctcacttggctggaatcaattttttctacagtttttctgaattcttttcggctctctctccctaaagatgctgctcaggaaagtcaaaagttaacagaagagagcatctaatctgagtaaaagagccaccaccacatcctcattgacaactatatgtaagattttaaaattgacttaagagcaacttcttgcactggtttcttgatctgagcatgaaaagtccaaactaagtggcctctgtggactttgaatttgatttgctacagaacaaattgaaccaatttcttagtttactaatgatgaaagtgcaatctgatataccaccaaaaatctaactgatagaaaaatctcaagtcgcagatgtgttatatctacgccagagcaacaacactcttacaggtcttaacaataaatgcaagcgaggcaccgtggctcaggcctgcaatcccagcactttgggaggccaaggtgggtggattgcttgagcccaggagttcccaaccagcctgggcaacatggcaaaaccccatggctacaaaaaattagctgagcgtggtggtgcatgcctgtagccccatctactcaggaggctatggtggaagaatcacctaagactgcgtagtcaaggctgcagtgagctgtgattgcaccactgcactgcagcctgggcgacggagtgagaccctgtctcaaaaaccaacaaacaaaattacatgaaattaaaatgtcagtgtccataaataaagtttaattgggacacagacacactcattcacttaaatactgcctatgactgcttttgcattccaattgcagagttgcaaagagagtctctgcaaagagactgtatggcccacaaagcctatatttactacgtggctcttttgtcagcctgggcaatatagcaagatcacagctctaaaataaaataaagttcaaaaaattagcatagtgtggcagcatgcgcctagtcccagctactagagagactgaggtaggaggatctcttgagcccaagaatttgaggctacagtgaactatattgtgccactggcccttcagcgtgggcaacagagtgagattccatctctaaaaaaatttttgttttcaagtttctgtttcctcctatgcaaaatgtggctaatttctccccgccactgcattacagagaaaaaaaaaattagataaatgaaccccactgtctattttcaccactgtatctcttgtgccaaccaaaatgctccctactctgtaaatacaaagtaaacattacctactacacactattgggagtggttaatttggagatggatttaactgctaccactgatagtaaattacgattcttgtctttcctattagatacaggttttatgtcccccaaaaaactcctctcaaaatcgtaagaatctgtgatattcacagtgttcataacttaaacattctctcaaacttcttcaaagccaaatcctgaaagtgagctaacattcacagtataatctagtttataaagtattttcacttaacattacttatgtcttcattcagcaaatatttacttagtatctactatgcagcaggcctgtgcttggcacaaggaatataatgatgaaaaaaacccagacggtgggatcctcttatataatttttgcaataatcctgtgaaatagacaggggagaaattagctacatttttgcagagagagaaaaagaaacttaatgaagttttgtagcgagcctgacacaagattaggcttgttcacccctttccactacatcaaggtgccttcaatactgctcaatacaagcgattaaaagtaaaaactttcaggtgcctgcaccctgaaaacttcccaaataccatccacgaagcaacttaggtagccaaaagcaggttctgtttgacttgagcgacagtctcctttctgtcactctcttcaagtcttttgaccaattcaatgaggagagcataggctctgtcgactgtctgcattttggtctccaatttgactgcggtgcagctttggacaactcacaacctctctgaacctcagatcccatctctaaaatgggtgtgataataatagaaaccaccttacaaggccgttgtttggattacatgaggtaatccacggggaacatttagcaaatgttgtttccttagcacccaatctagtctttgaccccacaccaccccatcccattaccgttttctcccccatagctcttctgtccaaaacggcctttttagcttattttattatctttctcccccattaggctataaactccatgacagcagagactatgttttcttatccactattccaactcctgtccttagtacaatgcctggcatattttaataaataactgttgaacgaataaagcttaataaataggaaaacagtttaggtttcaatacaccgatatgcaaaagagaagaatatttaccgctcagagaagtccaaaagacacaaatgcaattggacagctcttggtaataccggaaaggtgcttgagaaactctaaaaggtgtatcacgaggtcgcgttacaactactagtgagagtggctgaagccctagacattgtcaaccctgagactacaccctatgtgttgctaaaaggccgaggagaatgcaaaacggccggggaggggggagtgtgttgcaaaaacacccgcccctttccttctctcttaaccttccagctgtgcacttcactcctggagggccccaccaggggtcagacaggggcgggcggggagccaaatgccctcgaaggggaacagcggcgccaacagtgacagtagtgaatggacccgaaagggagacaagccaactctttcgtggggggcccaactggcgcgtcccagttagctaacctcccctctccaccaccatcccaccagcaataggcggggaaagaggggacactgtcctccgtcccgccccgctggcctcggagcagagcctgccggggtctggtcgcaggactgtctgcaaactcacctctgccgccggctccacctccgctcacattccggccccgccgccttccccccgccccccccaggccctttgttttgattcccgactccgcagctcccgccgccgccgccaagcgcacccttcacttccgcttccgcaccgcaccgcccctgtcgcaaaaccgacgcccttctctcctcttcgccccgccccttcctcgccccgcctccgccgccgcgtcctgtccgcgcggggcatgctgggaaccccggggggggcggggcctcgcggccctgcagcctcgtcaggctcagtcccctcccgataaacccctaaatagggactttcccggggggtgaccctggcttttttggcgaaaacccccagtttaaggaggccttccccctggcttcacgttgtggagtcgaaaggaaccttgaagcggagaatgagctcgtgacgtggacccgaggaaaaaacctgccaaccaggatttaatagaattcagctctttcaggctttggagggaaggcgatttgaacgggatttcaatgaaaaaccctgtcccttcggctttttttttttcctctctcgggtctcgtcacgtgatggtcctactttatttttaaaaattaaatggcgcatattccccagcatcctaaatctagtgcaacctagtggcaagtggagaaaaaaataactgccaacctggcttcctacgaggtcccccggagttctcgcaaagttgcgacccagttggcaaaaatacagtgtgtgcaaagactcaactggacattgccaccaagaatcaagagatttttggggactttagcaagaaaacgttatttttaaaagccctgctccaaagctggttacaaatgaatactgcgtttccagtgacaggttgggcgagcagaaaggaaatcttacggttagtttcaaacactttgtgttttaggtggccagatatgctgtgtggtttgctttaaaaaaaaaaatagcgccccacaatcttcacgtttccctggaataaaaaaaaatttaagactcagcaaaagggtgatttctgaaactaccagctgattactattttctgttgcaaattaggaaaaaagcaaagcacatattgtgtaagttaaatctagacacgatttaggatgtgctagctgctagctaaatgctaccttaggagtttatttttaaagtttgcccagaaacaagttgactttgcaaaagaatcagtaagtcgaaattgccaaacgagaatattttgcccaaaaaaatccttactgggaggttatttcaataggcaatccccattacgtggggattaacacatccctgtaaacatccctgtagacgggtattgtggagggcaggatcagacatgtagctgaagaatcctttgtgcctgtatttaattttccagaaggcagatgacaagcacacatcctctccctgcgtaggtatttattactgctgactaaatcttgactgtgggctgggcgcagtggctcaggcctgtattcccaatactttgagaggctacggagggaggatctcttgagcctacaaatttgagactagactgggaaacggtgaaaccctatcactatttagaaaagaaagaaaaagaaaaaaatcttcattatgtctgtgtataggtagtattttccaagtggagattagaatagatgaaaaacccgtttctagcgttttggcttttttcaaagtaccaaacaaatacgctactcttcagaggtgttttttccccattttatttcagttgagtatgtttcaacacaagccatattaactaaaaatcttaagaaacaaggtaattgtaggtttctaattgctttttttaaaaaatagtttttagccagaaaacatcaaagaatgcagacacatttcctttttactttttttttttttttttttgagacaaagtcttgcttcattgcccaggctggagtgcagtggcaggatcttggctcactgcagcctccacctcccgggttcaaccgattctcatgcctcagcctcctgagtagctaggattacaggcgcccaccaccatgcctggctaatttttgtgtttttagtagagacgggatattgccatgttggccaggctggtctcgaactcctagcctcaagtgatcctcccgcctcggcctctttaggattacagggctgagccaacgagcttgaccacattttctttatatgtatatttttcttttagattcctttttaccaagcagacacattttgtttgacttagcttggcattctttcaagtccaaagctgtaactagtcacaacaagtaaatgtagtgattgaaaatgggcggggcatggtgactcatgtcgtaatcccagcactttgggaggctgagacaggaggaccccttgaggcttggtgtttaaaaccagcctgagcaacatggtgtgacacttgtctctattaaaaaaatttttaaaaacaaaacagtcgtattaagtggaaggctaataaaagtctgaattacaaatacttttaaaagaaatgtaattttattgctgctttctaaagactaggagcctaagcaaagtataccaggccttaggagacaattatgaatcaaaatacataaattttctcttaagatatattttaagtatgtatcctctattaattgtattcctgtttctttgctgggaaaactttagagagtacaagtaactttcagtttttcccttgtccaaattatagtcttcacatgtatgaaaaccgaaagacttttttgtgtgctatttaagtagctactttacatgcaattcagcttttcaactaaccaagctgttattaaaggagtttctccccagaaaccaatcttctacctgtattaggttcagtggtttgaattaataaatgatcatggaaggacctaaggaagttaaattgagttatctgctcagccatagtccaaagctacaaggaaaacaaattgaatttaaaaagaacaagaaaaacattttaaatgtttttaaggttttacccaatgacaaacctatttccctaaatgttgttcccaaataggactttaaggattattatttcaatgccctctcttttttctttatggaaaatttgggaaattgagaaccaactagtttaaataccttgatcaaagccatttaggcaacaccagtacctcatcagtttgtgcttcggtttctctgtaagctgaggtgattagttcctgtccagaaacgtcacagagtggttagggccaaataaaattccgaggggggccaggcgcagtggctcacgcctgtaatcccagcactttgggaggccgaggcaggtggatcacttgaggtcaggagttcgagaccagcctggccaaaccaacatggtgaaaccctgtgtctactaaaactacaaaattagctggacgtggtggtgcacacctgaaatcccagctactcaggaatctgaggcaggagaatcgcttgaacccaggaggaagaggttgcggtgagccgagatcgtgccactgcactccagcctgggcaacagaacgagactccgtcaaaaaaaagaaaaaaaaaatccaaggggggttaataccagctacttggtaggctgaggcaggagaatcgcttgaactggaaggtggaggttacaatgagccgagatcgcaccactgcactctagcctgggcgacagagtgagattccatcttaatgaataagtaaataagtaataaaattcctaaggggaggcttggtgtggtggctcatgcctgtaatcccagcacttttggaggctgaggcgggtggagcacttgaggtcaggagttcaaaaccagcctggccaacatggtgaaaccctgcctctactaaaatagaaaaattaggtgggcatggtggtgaacacctgtaatcccagctagtcgaaaggctgaggcaggagaatcgcttgaacccgggaggtggaggttgcagtgagccgagattgcagcactgcactctagcctgggcaacagagtgaaactctgtctcgaaataaaataaaattccaagggggaaggcatcagacgtagtaaagtgtgaagcagcatgtaaatgattcattaatgtttgggaagtttcctgaaagacatttggtactttccttaaacctgttgataggtggtggggttcccctttgtgcctctaagcagtttttaggaattagcaaggagttcaaagtagaatttgagaaaggctgttgtaggatagcaggaaggcaagatggggtgggagatcctgtaatagctaagatctctttgcctctagcatagtgctgaagaaggagggtttaggagtcagagccagctctgaagcctgatttgttaattactagttgtaagacctcggacaactcaattaacttcctgcacctttattttcttatctttaacatggatacaatttaatgctttcctgtggttcatcacctgtggttcagttgcatggtctcctctctacagtggccttccctgactatagcatctgaagtgacccctcccagcccgttgtatcaaatgggcttgccttagtcatagcacttatcagtatctgaaatgacgttactttttctgcttatagatttagtatgtttctctcttaacaatataagccctttgaggacaggtactttgtctgactgtattcactgtgctgtaagggtgcattgtacagaagaatgctcataatgccgggtgctgtggttcatgcctataatcccagcactttgggagggaggctgaggcaggaggatcacttgagcccaggagttcaagaccagcctgggcaacatagtgagatccacgtctctacaaaaaaatgtaaaaattagctgggcgtgttggtgcacacctgtggtcctagctactccggaggatgaggtgggaggatcacttgagcctgggaggtccaggatgcagtgagctttgattatgccactgcactccagcctatgtcacagggtgagactctgtctcacaaaaaaaaaaaaaagctggataataatatatatatttttagtttttatgggtacactgtaggtgtttatatttatggggtacatgagatattttgataacaggcatgcaatgcatcataatcacatcagggtaaatgggtgtccatgacctcaagcatttatcctttctttgtgttacaagcactccaattatactcctttagttattttaaaatgtacaatacattgttgtggactgtagtcaccctgctgtgctcccaaatactagatcttattcattctaactctatttttgtacccactaaccagaatgttcggtatttgttaatgaacatgttatgacaggatgttttagaagaaaataaagaaaaaaagaaattccagccaagcatggtggcttgattttatttatttatttattttgagatgaagtctccctctgtctcccaggctggaatgcagtggcgtgatctccactcaccgcaacctctgccttctgagttacatggctcacgcctgtaatcccagcactttgggagactgaggtgtattgcttgaggtcaggagttcgagaccagcctggccaacacagtgaaaccgtgtctctactaaaaatacaaaaaattagctgggcgtaatggtgggcgcctgtaatcccagctactagggagactaagacaagaaaatcgcttgaatctgggaggcagaggttgcagtgagccgagatcgcaccattgcacgccagcctgggcaacaagagggaaactctgtctcgaaaagaaaaaaattattttttaattttaatttgttagtgaacaattagggttgctgtgagaattgtgcctggcacacacagccatttaaaaatcacgatcttcaggcagtgtgtggtggctcacgcctgtaatcccaggactttgggaggccgaggtgggtggatcacctgaggacagggattcgagagcagcctggccaacatggtgaaaccccgtctctactaaaaatataaaaattagccgggtgtggtgatgcgggcctgtgatcccagctactcgggaggctgaagcaggagaattgcttgaactcagaaggcagaggttgcagtgagtggagatcacgccactgcattccagcctgggagacagagggagatttcatctcaaaataaataaataaacaaaatcaagatcatttaacaaatacatatattgtacttactaagttcaaatttctgttctaaacgtttttacaaatgctgttaagtcatttagtcctctgcataatgtcgtttgtttgtttgtctgttctttaagacggagtcttgccctgtcgcctaggctagagtgcagtggtgtgatctcggctcactgcaaccgccacctcccggtttcccgtgattctcctgcctcagcctcctgagtagctgggattacaggtgcgtgccaccacatccggctaattttttgtatctttagtagagacggggtttcaccatgtgccaggctggtcttgaactcctgacctcgtgatccacccgccttggcctcccaaagtgctgggattacaggcgtgaccaccgcgccagacccataatggcgttttatagatggggaaacggagtcatagaggctaaacaactttcccaagaccacacagttagtaaggggcaggactaggactcaaagccaagtttatgaccaaattctggtgcactacgttctcctgcttctggagaagataatgatgctgaagattctacttttggtgtaaaggagtaggaagggcacggggcactgctagcttcagtgggcctgaatctttgtctttccttctgatttggagaaagtgcaagaatgggaaaatgcaatcgaagtgaaggagaggccggcgtattttcctgaaatgcgcggcccgcaagcccaaacccgtttcccgggtgtccaggcagcgttctgcagcatctccaatgcccgccagcccgccgcagcccagcgcccggcagccggcgcctctcaaaccccctccggccaggagccttcgccgcttggccgcgccgcgcccggcctgggaaaaaagtttccaaacgacgctgctctgcgctgattggccgaggcggacgcggtaccgtagagcagcagccaatgggaggcgccgaccgcaggctccggggcgggggcggggtccggagggccggggccgcaccgcccttcgcagccgcctctgccgccgccgccgcgttggcctcgccgcccctgctcgggtaagtgaggcgctgcgcggggctggggtcggggtggctgtccggggacctccaccgcggctgaaaagctcctctgccccgccccaggatcccgggaccccgggccaccgcctggcagggacccctacgcccctcgcttgcgcgtcgcttcccggccgcctggactcccccggtccctgggctccaaaatcccgcctccctggagcctcccgtcctaaaaagttaggcactgagtgccttgccaccggtgcgttcctcgcgctggcccctcgcccttggcaactttgtttctctttctgcgttggtctctctcccaccccgttgccctcttctccttccgggacttcctgggtggttaagccttgccggtccccaaaccccgctgccaggctccatcctctttctcctcttccttcctccccatactcctctcctagatgaccctcgtttcttttctctctctctcctattcctccatcctgccacccgcttctctgcgaccccagacccctcgattgcagcgttgcccctgccctcacacccactgtcccgcccctgcaggcctctttccaaaaacccaccctgctccctccctccgggaacacgtttggggcagtctgctctccgctttgctcccgtctctgccgcaggacggttcaggtttcttctgacagcactttggggagggattgggtaaaggacgaaaatgcttattccgcagcttgagtgatggctgggctcactgaggacctgagtctctgaggtcctgggaaaccccgctgtcaccttgacaccgcttttggggaggcgactttatcttctccgagccatctcaggctttctgcctcctgagggcctgagcttccttgattgctttgtccgtggttactaccaggttgtgcctcttaatttctactttgagcctcaggccccttttaactttctaaagaaaaggcctttgcagcacgacctaggcaggttcatcatttttagttttgttatagtgtattctagcataggatggcattttaggacatgggtcgggtgttttgaagattaattagatcccagctactcctaaagcctcttgttacccgaccaccccagcctccatcacctcgttggtatacaacccgtttttttttttttttttttgtttttgtttttgagacagagtctcactctcgcccaggttggagtgcagtggtgcgattttggctcactgcaacctccgcttcccgggttcaagcgattctcctgcctcagcctccggagtagctgggactacaggtgcgtgccaccacgcctggctaattttttgtatttttagtagagatggggtttcaccgtgttagccaggatggtctcgatttcctgacctcgtgatctgccccctcggcctcccaaagtgctgggattacaggcgtgagccaccgtgccggcctacaacccattttgagcctttcctcttagtgtgtgttttgtgtaggattaaatgcagatgatctgtgccgctgaagtctcaggggcctgtgattcatatattttatcccatgttggataacagtttattaacttgacttatttttgtttccaaagtgtgttatttattatttatttatttatttattttgagacggagtcttgttcttgtccaggctggagtgcagtggcatgatctcgactcactgcaacctcagtcctccgggttcaagtgattcttctgcctcaccctcctgagtagctgggattacaggtgcgtgccaccatgcccggctaattcttagtagagatggggtttcaccatattggccaggctggtctcaaacttctgacctcgtgatctgcccacctcagcctcccaaagtgttgggattacaggcatgagccactgcacccgactctatcattattattattttttatgtagaggcagaatcttgctttgttgcccaggctggtctcaaattcctgggctcaagcagtcctcctgccttggcctcccacagtgctgagattacttgcaggcatgagccactgcatgcagcccaaagtgtgttcttttgccttagaatgtgagccgagaattgacactccttttcctcacaaggtaatttcctaacatgagcattcctgtgtacagaaagtttgtgcctgcagttagtactacacgtgcacctcgtgcaatggatgtgggtgctttttgtctgcctccttcagcagtgcccagcacttagtaggtattcaagaaatgtttgaaaagggttggaggaggcaaaaccacagtaggaaaaattctttccctgtcacttggttcagtagaataaaattatcctggaacaatagctattttactttttgtccaagtttttgtttgtttgttttttgagacgggatctcactctgtcgcccaagctggaacacagtgatgcaatcacagctcactgcagtctcgacctctcaggctcaagcaatcctcttgcctgagcctcccaagtagctgggactaaaagcacatgccaccatgcttggctaatttttaaaattttttgtagagattggggtctcactatgttgcccaggctggtctcgaactcctgggttcaagcgatccttccgcctcagcctcccaacgtgccggggtgggagagagccaccgcgcctggcctaagctttttaaaatctctaaagcgatctatgcttactgtatatatgtgtatgtagtttaccttaaagcaaggtgtcaggtacaaatccacagggcttgctttacccccattctggtgcatcctccagacccttttctattctgtgtacagagagagggaaataaacaaaaatgggcacccatttttaacatatcctgagctttcttccatattagtacttacagttcttaacaactgcatcgttttccattcagtcctctgttgacattgaggtttccagttttccacattcgtgaatgatggtgtgcatctttgaacatgggtccttgcctgcctaagtatttttgtaggttgatcattgtaaacttggaaagcacaaagacagaagccaggcttgctgactcttgactgatgttgccccagtgatgtcactcctgcaaaatgcaaagcctgcgtcctggctgtcggagcatgtgtggacatttggcagcttctttctcttccctcctgctcttctgtttgttttgattgggaaggatatggagtggggatggagaagggtgttgagtaattatcgatggtttctgtatgtttattgctcctgactagcagtgctgggtttcttctctcagaggaaagctgaaagagattgctttgcttttttccagagttttaaaatcagaggtgtgtgtctcgagtgtattttcagacttttttgttagctttaatcatgtaaaacatgcaaaaaaaaaaaaagcatgtggaaacaattttttttttttgagacgggttctcgctctgtcacacaggctggagtgctgtggggcgatctcggctcactgcaaccaccgcctcccatgctcaagtgatcctcccacctcagcctcctgagtagctgggaccacaggtgtgcatcaccacacctggctaatttttttgtgtttttggtagagatggggtttcaccatgttgcccaggctggtctcttatctgctgacctcaggtgatctgcctgcctcaccctcccaaagtgctgggattacaggcatgagccaccacacccggccggaaacaaatttttgaaggaggcatagatctctgttgtgcaaaatagatactttttgtaccactgggtcctagtttgtcattgttccttgcatgatcccatcagatttgtctacagagctgctggggcatgatggtgtggtggcgtattaagaacgcaggttagtggcacacagatgaaataaatgcatgtggggtgcatttttaagatagcaggtgcaaagttgtatatactgagaccaggcattaacacttgcctattacagtgccttttaaaacactatgtgagggccgggtgcaatggctcacacctgtaatcccagcactttgggaggcctaggtgggcagatcacctgaggtcaggagatcgagaccagcctggccaacgtggcgaaaccccgtctctcctaaaaatacaaaaaattagccagtcgtggtggcatgcacctgtaatccgaggtactagggacgctgaggtaggagaatcgcttgaagctgcgaggcagaggttgcagtgagctgagatcacaccactgcactccagcctgggcaacagagaaagagattccgactcaaaaaaaaaaaaaacaaaaaaaaaaaaaacaaaactggaccaaatgaaacaagtgaatctgatctgcagtcagtcagtttgcaacccctgggaagccttggacttgaatgcaaagatcccttgaacttggatctagtttgcctctgctgctcacatgcacatttagagatggccaaggcatacggtgtttctgcttccaagaaacagagtggttgtcctgtttagccatctcttacagtcacacagcttaaagaagataatgtttgcaaacaatttttgaaatgtctagcacacagcaaacagaaggtcaaattcagtacttaatgctgataaaataagagaacccttgcaagtcatgttgcctgctttctgccacagagagtactgcaatagaactttctgacgttttcatgttgtttatttatttattttttgagacagagtcttgctcttgtgcccaggctggagtgcagtggtacaatttctgctcactgcaacctctgcctctgggttcaagcaattcttgggcctcagccacccaagtagctggaattataggtgcgctctaccacacctggctaatttttgtgtttctagtagagacagggtttcaccatgttgcccaggctggtcttgaacccctgggctcaagcaatccacccacctcagcctcccaaagtgctgggactacaggcgtgcatcgtgacgccctgctgatttgtgtatttttagtagagacggggttcaccttgtgctggtctcaaactcctgggctcaagcaatctgcccacctcagtctgccaaagtgctgggattacaggcgtgagccatcgtgcccggcctctctctgacatttttgaatggcaaaggcaaaaatcttatacttttaaggatgtggagaaataggaacacttttacactgttggtgggactgtaaactagttcaaccattgtagaagtcagtgtggtgattcctcagggatctagaactggaaataccatttgacccagccatcgcattactgggtatatacccaaaggactataaatcatgcttctataaagacacatgcacacgtatgtttattgcggcattattcacaatagcaaagacttggaaccaacccaaatgtccagcaatgatagactggattaagaaaacgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcataggtgggaattgaacaacgagaacacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctgcacattgtgcacatgtaccctaaaacttaaagtataataataataaagaaaaagaaaaaaaaagattgctgttttatgataaagtgaagtgcagctgttacttcttccttctttgcttccagcatctctcttccctaaggattgcttttaaaatgtaagagtttttggttgaaatgctgttcctgtggtttttgtctcttggttggagtgaaagattttgcaggctgtgatacaaatccagttctctgcttattttctcctcagtccttgaaatccaaaaccagatccctcccattggcccgttgtaattagaacctgccccacaatagacgcacctcctaaagcatctcagattcatttctttcctgaggattaagtttttaaaccttcctggccaagataacagtgttttaagaggctcttttcttttattattattattattattattactcttttctttttttgagatggagtcttgctctgtcacccaggctggagtgcagtggcaggatctctgctcactggaacctccacctcccgggttcaagagtttcttctgtttcagcctcctgagtagatgggattacaggcatgtgccaccatgcccagctaatttttgtatttttagcagagatggggttttaccatgttggccaggctggtctcgaactcctggcttcaagtgatctacccgctgtggcctcccaaagtatcaggattacaggcatgagccacagcaccctgccaggcttgggtgttcaaggaagagaaagaaggcagtgtggctgggacataagtgaatgagaggtggtagggtaagaaatgtgtagaaaactatgcaggggcctgatcacattggatcttgcacatctttttccaaacctcaggaggagtcattctgcttttgttgttactggttcctcacttccgcactttattgtatgctgacaaccttccataccatgggactgagactgccctcaatagtatcaccaatgtctttttttgttttttttttttgaggcagagtttcactcttgtcgtccaggttggagtgcaatggcgtgatcttggctcactgcaacctccgcctcctgggttcaagcgattttcctgcctcagtcttccgagtagctggggttacaggagcctgccaccacacctggctaatttcttgtatttttagtggaaatggagtttcaccatgttggccaggctggtcttgaactcctgacctcaggtgaaccacccgccttggcttcccaaagtgttgggattacaggcatgagccaacgcacccagccaccaatatcttaatggccacacagtgctcattgatagatgccttggccctgggctattgttgctatagaattggtttgatgagtacatattacatgagatctgggctcattagagcttatggcttgagcagggactccttggcctaggtttatgctgctcctggccttgttaatgactgctattaacactctaccccctttttatttttttgagatggggtcttgttctgtcgcccaggctgggaggctggaatgcagtgatcttggctcactgcagcctccgcttctcaggcttaagtgatttttcctgcttcatccttctgagtagctgggactacaggcacgcaccgccgtgcccgtttgatttttgtttttgtttttttagtagacacggggtttcaccatgttgcccaggctggtctcaaactcctgacctcaagtgatctgtctgcctcggcctcacaaagggctgggattacaggcatgagccattgcgccaggcaccactctacccttttgactttgagcaagtaaggtcgttgattccatacattcattaagattcctgcgtggcagaaatctaaccccaactggtataaccaagacaaggaattgattatctcataaccttaaatcaggtgtggctgcatctaggtgttcaaatgatattgtcaggacccaggctctccatcccttggcccagctttcctctgttttggcttcactctgaggcaggctctcccttgtgatagcaagatgaccaccggcagtttcaggcttacctccggcttcaggcttacctccagcttcaggcttaccttaccaaccctagtggaaagagagtttcatttttgacagctatgcaaaaggtctggacctgggccctcactggcttagtatgggttaggcccatccttaagccaatcattggctcagcatgggttagatccgtgactgtcactggctgagcatgggggttaggctcaccctatcattggctctgcgtgaattaggcccacctctgtcactggctcatcgtgggttaggcccacccatgagctgatcactaaggtcgtgaataggcatatgcctcttcccaggtgtggaggatgatgtcagatccctctgaactcatgaaatgagtagggtattctcccaagggaatattgtgctgtcacagaagatggaaaaatgaatgcatgtctggaaaaaacaagcaaaactacaaatcattagctttatatgacatttatttattttttgtttatatgtttttgaaatggagtcttgctctgttgcccaggctggagtgcagtggtgtgatcgtggttcactgcaacctctggctcccgggttcaagcgattctcatgccttagcctcccgagtagttgggatcataggtgcctgccaccacacccagctaatttttgtgcttttagtgtagacaggattttaccatgttggccaagcttgtcttgaactcttgacctcaagtcatctgcctgcctcagcttcccaaagtgttgagattacaggcatgagccaccacgtctggccagctttgtatgacatttcgcctttctgccttgatcaaactttcagagaatctgctttccagagggatgagtgggtcgggaaatagcatgttttctctgaatgagggaaaggattgaaaaagtaggagggagaaaggatgtgaatatgagtcccaacaaatgcagagttatcggtaagttttgtgcttgaatctaggtacaattgtgcatttcctggttctgcatgaattaggcccacctctgtcattggctcaacatgggtgaggctcactaacttccaccagaagttagtggtggtgtctgtgttgacacttacatgtttagcctaatgatttcatgttttaaccaaaactatatagcttgttggttatatcttagaaagtgatggtttttgctcattcttttgtccccagggatacacaccagcctctaagttctcttgagggaaggaagggaccttgcacacaatctttttttttttttttttttttttttttttgagaggaagtctcactctgtcacccaggctggagtgcagtggtgcgatctcggctcactacaacctctgccttctgggttcaagtgattctcccgcctcagcctcccgagtagtggggattacaggcgcacaccaccatgcccggctaatttttatatttttagtagagatggggtttcagtgtgttggccaggctggtttcagactcctgagctcaggtgattcacctgccctggcctcccaaagtactgggattacaggtgtgagccactgcgcccggccttggacacaatcttttttttttttttttttgagacggagtctcgctctgtcactcaggctggagtgcagtggcacgatctcagctcattgcaacctccacctcctgggttcaagcaattctcctgccttagccgcctgagtagctgggactacaggtacctgccactgcgcccgcctaatttttgtatttttagtagagatggggtttcaccatattggccaggctggtctcaaactcctgaccttgtgatctgcccgcctcggcctcccaaagtgctgggattacagatgcgagccactgagtctggcctggacacaatcttacttggattcctcatgcccttttgacaagctcagagcctcaaataaattcagaaaataggtgattacatcaaacagcctctatcaacagggagtatacaaaccgttagcccaactgttaatagaagtctgctttcttgctgggtgtggtggctcacacctagaatcctagtgctttgggagtacaaggcaggaggatcgcttgagcccaggaatttgagaccagcctaggcaacatagtaagaccccatctcttaaaaaaaaaattagcttggcgtagtggcctatacctgtagtcccagctagtcaggaggctgaggcaggaggatcagtgccgcctaggagttcaaagatgcagtgagctatgattgtgtcactgcactccagctgggttgacagattgagaccctatctcttaaaaaaaaaattgcttccctcacctctgctgtgaaacagctcaaagtcctgagagccaaggcccctaccgcccacatcctctagctgttggctaatttatttcatcgtcttttaggtaattctccagaattccatcgctttcctctttttcacctcccagttactcctgcactcagttcttcgtctttcctcctccactgtgtagaaactgttcttgctcacaccgccagtgaccgactttcgctcagccttgtggatattttccagcccttatcttccctgcttctctgttgcatccttgtgacactggaatgtttcccttttttcccttgaaaccgcccactcccaggacagcacagtcttcctgattctcatctctctcactctgtttcttctctgcctccttcggttaccatttcttaaactgcccacctttccaatattggcattcttcactgttccatacacagtccctaggcgattcttccatggtcacgaggaaaagagaaaaaccagctatagacgcatgactttcaaatggatattgttgacccaatttcaaccctgagtttcagctgcgatattgcatcttggtgtgtcatggacatgtcaagctgtgaatgtctgagactgggtttgttatctctccttaacccacccacctacccaagagttttacttgttttttttttttttttgagtctcgctctgtcacccaggctggagtgcagtggcgccatctcggctcactgcaagctccgcctcccgggttcaagccattctcctgcctcagcctcctgactagctgggactacaggcacccgctgccaggcctggataattttttgtatttttaatagagacagtgtttcaccatgttagccagaatggtcttgatctcctaacctcgtgatccacctgcctcggcctcccaaagtgctgggattacaggtgtgagccaccgcgcccggccgagttttccttttgattgtcctttttttttgagacgggatcttgctgtgttgcccaggctggagtacagtggcatggtcatgggtcactgcagcctcgacctctccttgcccctcatcctctcgagtagctggaactacagacacaccaccatgaccagctagtttttgtattttttgtagagatagggtctcaccaggttgcccaggctggtctggaactcctgggctcaagcattccacctgctttggcctaccaatgtgctgggattacaggtgcgaggcactgcacccagccaccttctggaagtctttatctctggtgatggggatggtggcggcacccaattgcctaaggtagagccccagaagatgtcctcacctcctttttctctctcccctgccccgaaaagtcataattcatcaagttctggtaagtttgccttctaaatatttttggagtccatttctgttccctccatcttcattcctactttctttttttttagacaaggtctcactctcttgcccaggctggagtgcagtaccgtgatcatagcttactgcagcctcaaattcctggactcatgtgatcctccttcctcagcctccagagtagctaggactacagatgtgttgcaccacaccagtctaattttttaaaaagtttttttgtcaaggtagggtcttgctgtgtttcccaggctggtcttgaactcctggtcccaagtggtcctcttgccttggcctcccatagtgctgggattatacgtgtgagccactgtacctggcctattctcactttctaattcaggccacgttcctttctcttttcttttttttttttttttttttgagatggagtcttgatctgtcgcccaggcttgagtgcagtggcgtgatctcggctcactgcaagctctgcttcccaggttcacgctattctcctgcctcagcctcccgagtagctgggactacaggcacctgccaccacgcccagctaatttttttgtatttttagtagggacagggtttcaccgtgttagacaggatggtctcaatctcctgacctcatgatccgcctgcctcggcctcccaaagtgctgggattacaggcatgagccaccgtgcctggtctcttttcttttttaaataggatctcacttcatcacccaggctttagtgcagtggcactatcttggctcaccgcaacctctgcctcctgtgctcaggtgatcctcccatctcagcctcctgagtagctgggaacacaggcatgtgccaccacagctggctgatatttttctatttttagtagagacggagtttctccatgttacccaggctggtctcaaactcccaggctcaagcgatctgcctaccttggcctgtcaaagtgctgggattataggcgtgagccactgcacctggcctccaccttcctttctttcttgcattgctgcaggagctccccatcttaggccttgtccttcctctgcctgtccatggccaccaggaccagctttttaagcaggagagcccatcatatcacatcactctcttccctaactttctccaatggtttcccattgccactaagtttcttaacatcttgcaaaagccgtctgtgacttagcccctttatttcagtctgtccaggtaggttcccttccactcgtcacctttcaacccaggcttaccagactccctctagctcccctacaagtgcctggctgtttctcctcattccttcttcccctgctcaattaccattgccttccagttctttcatattcttttttttttttttttgagacggagtctcattctgtcgcccagtctggagtgcagcggcacgatctcagctcactgcaacttccacctcccaggttcaagtgattctaccgcctcagtctcctgagtagctgggagtatgggtgcccgccaccacgcccagctaatttttgtatttttttttagtagagacggagtttcaccatattggccaggctggtctcgaactcctgccctcgtgatctgcctgcctcagcctcccagtgtgctgggattacaggcgtgagccactgcacctggctttttcatattctttcacatgctcctcatgtgtcgcctcttctaggaagccttccttgactttcgggttgagttttgaacttcttaaatatcctgggcactgatagaaatgtattttcaggtgcatacatatttcagaacacaccaatgtgtatactcaaatatatgcaatttattgcatgtcaaaatcctgtgcacatttctgtggctatactaggcacatagttttatcataatttacatggggttgggtgcggtggttcacgcctgtaataccagcactttgggaggctgaggtgggtggttcacttgaggtcaggagtttgagaccagcctggccaacatggtgaaaccctgtctctactaaaaatagaaaaattagccaggcgtggtggcgcatgcctgtaaaatcgcagttgctcgggaggctgaggcacaagaatcatttgaacccaggaggcagaggttgcagtgagctgagatcacgccactgcactccagcctgggtgatagagcaagagtctgtctcaaataataattataattattattttatgcgtaatttccattccagcccccactcccccactccctccaccagactgtgaggcccctttagggaaggcaggcatcttggagacgttttatgtggctccctaggtcctttagtaggtgctcaataaatatttgcatagggatatccatgagccttgatgttaacccagggaatataacaggtgagtggattgtgttttgtttgggtttagcttcagatttttggcagtatttaatcatttaacccagcataaagtttatttatttatttatttattttgacacagagtctcggtctgtcactcaagctggagtgcagtggcgccatctcggctcactgcaagctccacctcctgagttcacaccattctcctgcctcagcctcctgagtagctgggactacaggcacccgccaccacacccagctaatttttcgtattttagtagagacggggtttcaccatgttagctagggtggtctcgatctcctgacctcgtgatccgcccgcctcagcctcccaaagtgctgggattataggcgtgagccaccgcgcctggccaagtttttttttttttttctgttaaaggggatcagctgtttaaccagatgtgggtaatcattttgaaaccttctctcctagacaccatgccacaaggagagtgatctcttcccctgttttcacaatggaggactccggaaagactttcagctccgaggaggaagaagctaactattggaaagatctggcgatgacctacaaacagaggtcagtccgagttcacctgcttttccttttttttttttttttgagatggggtcctgctatgttacctaggctgagtgcggtggctgttcctaggcgtgatcatagtgcacagccgccttaaactcctgggcttaagcgatcatcctggctcagcctcccaagtagatgggactataggtgtgcttcatcaggccaggcttttttttttttggcggaaacaggggtctcgctatgttgcccaggctggtcttgaactcctggactcaagtgatgcacctctgcctcccacagtgttgggactacaggtgtgagctctcttttttctataaaaagaacagcaaccatttattgcaggcctatatgtgccaggcagtgtgaaaggcttaacttacactatctcaaaactgcctgtgaaaaaactattagcaccccattatatagatgaagaaactgagcctcagtgaaggcagataacttgctcacagtcacacagccaataagtagcagagctggaatttgaactccagacctatggtcctgattatcctactatgctactttacattttgttttcttattttctttttcttcttttttttttgagacagagtctcactctgttgcccaggctggagtgcagtggtgccatcttggctcactgcagcctccacctctgggttgaagcaattctcgtgcctcagcttctcgagtagctggaattacaggcacccaccaccacgcctggctaattttttgtgtttttagcagagacggggttttgccatgctggtcaggctggtcttgaactcctggcttcacgtgatctgcccgtctcaccctcccaaagttctggaattacaggcatgagccaccatgcctggccttccatcttattttcttttttttttttttgagatggagtttcgctcttcttgcccaggctgtagtgcaatggcatgatctcggctcaccacaagctccacctcctgggttcaatcgattctcttgcctcagcctcccgagtagctaggattacaggcatgcaccaccatgcccagctaattttgtatttttagtagagacggggtttctccatgttggtcaggcagctctcgaactcccaacctcaggtgatccacttgcctcggcttccctaagtgctgggattacaggcgtgagccaccacgcccggtgtccatcttattttctagaagggtttttatcagttcctagatgccatatctggtaagttctttgtgcacagggaaagagcttttccctatgcctagcaaaatatattgctaaagattttaagatttgaaactcgtgttttggtcagggctcatatctgggaggtgtgtgtgtgtgcgtttggtttggcactgtttttatttataatgggtctttataatttgtacatagaggccttattccagtccccttagtttctttcatttattgaaaaattattttaggtccaggcacagtggctcacatctgtaatcccagcactttgggtaggcagatcacttgagctcaggagtttgagaccagctctagcaacatggcaaaaccctgtctgtacaaaaaatacagaaattagcaggcatggtggcatgttcttatagtctcagctacttgggagcctgaggtgggagaattgcttgagcctgggaggtcgaggctgcagtgacgcatgatcacacctctgcattccagtctgggtgacagagcaagactctatctcaaataaataaataaaaattattttagagtcagggtctcactctgtcacccaggctgaattgcactggctcttcacaagtgtgacctatctcactgcaacccctgggaccccaggtgatccttctgcctcagcctcccaggtagctgggactacaggcgtgtgccaccatgtctggctgatttttaaacacatttctgtagagatgaggtcttactatgttgccctggctggtctggaactcctggcctcaagtaattcttaatgagccactgtacccagcccttcctactttctttattctagtttgacttaaaggtaattcaggcttgatatttttaaaatattccttgaatttggccaggtacaatggctaacgcctgtaatcccagcactttgagaggccgaggcaggcagatcacctccagtcaggagatcgagaccagcctggccaacatggtgaaaccccgtcactactaaaaatacaaaaattagctgggtgtggtgccgcatgcctgtagtcccagctactcgggagactgaggcaggagaatcgcttgaacctggaaagcagaggttgcagtgagacgagattgcagcactgcattgcagcctgggtgatagagcgagactctgtcttcaaaaatattactacgtgatgattaacaattttgctgtagggcagaaaatacgcaagaggaactccgagaattccaggagggaagccgagaatatgaagctgaattggagacgcagctgcaacaaattgaaaccaggaacagagacctcctgtccgaaaataaccgccttcgcatggagctggaaaccatcaaggtgaggggctgagaggaagtgtgctcaggtgtagacaggcgtccaacacaggcatggcatgcttggctggaagaaggaaccctgcaatgagggactccagaccccaggcccatgctcatctctggaagggcctgtgcggcagacgtgatctttgaactctttgtgcctctagtgggtggtgctttttgttttgttttttttttttttttgagatggagtttcactcttgttgcccaggctggagggcagtggcgcgatcttggctcactgcaacctccacctcccaggttcaagtaattctcctgcctcagcctcctgagtagctgggattataggcgcctgctaccacgcctggctaattttttttgtatttgtagtagagacggggttttatgttggccaggctggtctcgaactcctgacctcgggatccatgatgggtggagctttgagaagcaagtcacacacatgttcccgtggactttcttggttgtgtacactgattttatagggcacatggcagggagacttttttttttttttgaaacagggtcttgctctgttgcccagactggagtacagtggctggattacagctcactgcaccctggacgtctcaggtttaagcagtcctctcacctgggccgggcgaggtggtgcatacctgtaatcccagcactttgggaggctgaggtgggcagatcacgaggtcaagagattgagaccatcctggccaacatgatgaaaccctgtctctactaaaattacaaatattagctgggcgtggtggtacacgcctatagtcccagcttacttgggaggctgaggcaggagaatcacttgatggttggaggctgtagtgagctgagattgtgccactgcactccagcctggcaacagagcgagactccgtctcaaaaaaaaccaaagtccttccacctgaacctcgggagtagctgagactacaggcatgcggcaccatgcctggttagtttttgtattttttatagagacagggtttcgctgtgttgcccaggctggtcttgaactcctggacgcgagcagtcctcctgccttggcctcccaaattgctgggattataggcatgagccaccacctggccagggagacatttttagggtatggaggtgttgctagagtaatatcatcaggtccaatattgtagcccttagctacatttggctgttgaaatttaatgaattaaaataaaaacttaattcctcagtcacagtagccacatttcaagtgcttaggagccacgtgtggccagtgagtttccttagtggacagaggggctgcagaccatttccttcattaccaaaaggtgtgttgcactctgccagttcagagcaggtttctcgacctggctgctgttgacattggagcccggatcatcctccgttgggagggactgaggtttgctttgtgggttttttgtttgtttgttttgtatttttgagatggagtcttgctctgttgcccaggctggagtgcagtagcgcgatctcggctcactgcaagctccgcctcccaggttcacaccattctcctgcctcagcctcccgagtagctaggactacaggcgcctgccaccacgcctggctaaattttttgtatttttagtagaaacggggtttcaccgtgttagctaggatggtcttgatctcctgacctcaggatccgcctgcctcagcctcccaaagtgctgggaatacaggcgtgagccactgtgcccagcctgttttttttttgagatggagtcttgctctgttgcccaggctggagtgcagtggcacaatctcacctcactgcaacctccgcctcccaggttcaagtgattgtcccgcctcagcctcttgagtagctgggattacaggcaccctccaccacgcctggctaattttttttttttttttttttgagacgcagtctcactctgttgccaggctggagtgcagtggcgtaatcccggctcactgcaacctccacctcctgggttcaagtgattctcctgcctcagcctcctgagtagctgagattacaggcacacaccgccatgcctggctaatttttgtatttttagtagagatggggtttcaccatgttttccaggatggtcttgatctcttgacagtgtgatctacccgccttagcctcccaaagtgctgggattacaggtgtgagccaccacgcccggctaatttttgtatttttagcaaggacgaggtttcaccatgttggccaggctggtctcgaactcctgagctcaggtgatccgcccgcctcagcctcccaaagtgctgggattacaagcatgagtcaccccgcctgaccacactgtgggatgtttggcagcatccctggcctccaccctctagatgccagtagcattccccgcacctccaaggtggtgaaaaccaaaagcacctctagacatagccaggtatctggagacccagtgctctgcaaggtaaaaaccatcccttctgtacatgctgtagggctcagcaagggatcactaagtcaacaccgtgccccagagactggctctcagccttagctgccagccagcatcactaggccagcttcataaacatccgacaggcctgaaccctctctccccatccccatctccccgccttgctctgagattccatttctcagtaagtctgggtggggccctggcatgtctgtgtggttttctttttctcattaaactcccaatgtacattttgatgagctgcttcatggaagagtcaaaactgtgtgtgcccagggctaggtatgatggacggtgaaaggggaagtgctggttgccttctttgggaagacaaacctaatgccatgaagcagttggggacgtgaagctcagtcacagaactctgatgtgggggcctttcaagagaaaaaggactggctgggtgcggtggctcatgcctgttatcccagcacttcaggaggccgaggtgggcagatcacctgaggttgggagtttgagaccagcctcaccaacatgacaaaaccctgtctctactaaaactacaaaattagctgggtgttgttgtatgtgcctgtaatcccagctacttgggaggctgaggcaggagaatcacttgaacccgggaggcggaggttgcagtgagccgagattgcaccattgcactctagcttgggcaacaagagcgaaactctgtctcaaaaaaaaaaaaaaagaaagaaaaagaaaggactgcatgggttgagggaggctgtgtggagggtgtttgtaggtgtatgtgttgctgacacttggtgcttggggagatggggctgaaggagagttgatctgtacccatcacagacgtggacaagaatgggtgtcgggtggaccttggcaagcccagctttactaatgtataggaaagggtgtgggaccaacaaatggattgggggtttggggcagggcggaggagaggtcccagacacgttgaaggtggtcattgaagctgaagctttctgttggagaccacagagtgcagctggccgtctgcagatccatctgccccataggtgttgtttgatcgccttcaggggtttttgttcagcatttccccatgaacgttttccagcatataaggctgaaagaatttccagtgaatacctgtgtatccaccaccacctaggctctaccaataatatttcccctacttacttgccttttattatatatattcccccatccatcaaaatttgtaaagcttcctgtaaaaagatggatttctggccaggcatggtggttcatacttgtaatcccagccctttgagaggctgaggagggagaattgcttgagaccaggagttcaaggccagcctgggcaacatagcgagactctgtctctacaaaaaaataaaaataaaaaattcattggacatggtagtgcacacctgtagtctaagctactcaagaggctgaggcaggagcattgcttgagcccaggaggttgaggctgcagtgagctatgattgtaccattgcactccatcctgggtgacagagcaaaagttaaaaaataaaaaacctgagtagtggttgtttagaacacacattgttgagtttcccccaatccccatatccgtgacacggagaccttagtgtcatctgcctctccctgtacttggcccacttcacccatttgttaacagctgaacacctgctacacacaatgagcaatgattatcgttctttttgttgttgttgtttttgctgttggagacagagtctccccctgtcacccaggctggagtgcagtggtgtgatctcagctcactgcaacctctgacttccaggcttaagtgatcctcccacctcagcctcccaagtagctgagattacaggcacctgccacaccacgcctggctaatttttgttattttttgtagagacgggttcatgtgcccatgctagtctgggactcctgagctcaagtgatccgcctgcctcggcctctcaaagtgctgggattacaggtgtgagccactgcgcctggctgattatagttcctaaattgaaggggactctgggttgaaaagctgggtaggaggaagattagtggtatgaactgcagtttggagaggataacaggccctccatggatcctgagtaaaatatcaagagaattactcagtaattctctgcttcaagactgagctcttgggcctggcgtggtggctgatgcctgtaatgccagcactttgggagaccgaggcgggcggatcatgaggtcaagagattgagactgtcctcgctaacatggtgaaaccccgtctctactaaaaataaaaaaattagctgggcatggtggcgcacacctgtagtcccagctactcgggggctgaggcaggagaattgcttgaacctaggaggtggaggttgcagtgagctgagattgcgccactgtactgcagccacatgtcagatgcaggagactcagagcacacagcacagtgaagaaacagggtaccttggaataacgaggaccctgccaccagcaagtatttgtcagtcacctaagagaaatatattcagctgggccggacttcttaacaactggcttattcatcacgggttgaatgaaaaagcctttaagggaccaaacagagcatctattgatgcccccatcagctgacagcttattcgaattagccccaaatggcagcacaacatttcagcaacaggttttcatgtccacaggttccgaggagatctctcaatcgccagtgcagtcggtggagcccactcgctgcgtcctcctggagcctgcgtttgaatttaggttaatgacttaagatcctgttttatttggagatgttcccaaataaagggtgtgaggcgatgagagccacgcctgggaacagggcctggtctgcctctacttgctgggtgcagatacttctctgcttacagccaggaaatggggagggtgctgcgggcggcagcagggatgtggtccgccctcctcatccttccaacgctgtaaatcatctgtttgttctttctttggagtcttcttgcacaatggctctcgccacgcctctctggcctaggcaccattacatcaccctgggtgcatccggactttctagcaacggctttgtttacttgattgagtaaagagaagttggccttttttaacttttaaattagaccttgcgcctttcttgtgggaagtgttttctcttatgtttgtagaatctaggatgggtgttttgtgttttcggttttgatttttttttgagatggggtctctgtcacccaagctggagtgcaggggcacaatcttggctcactgcaacctccgcctcccgggctcaagcgattcccctgcctcccgggtagctgggaccataggcacttgccaccacacccagctattttttgtatttttggtagagacgggggtttcaccgtgttggccaggctgttctcaaactcctgacctcaagtgatctgcccgccttggcctcccaagtagctggaactacagccgtgcaccactatgccgggctaatttttgtattttggtttcgccatgttgccccaggctggtgattttttttttttttttaagcgttggcctgggctagagtgcagtggcatgatcatagtttactggagcctcaacctcctggcctcaagcagtcctcccacctcagcctcccccatagctaggactgcaggtgcatgccaccacgcctggctgttcttaaattttctgtagagatggagtcttcctatgttgcctaggctaatatgcctctgccacctgaggtgctgggattgcggcatgaggcaccgcacctggctctgggtgtttggtgaaggaaagtaatttggaagcagagcaggaatagaatcgagagagcacgggaacgggcaggtgatctggattgagatggtttagggctggttagcataattgcttaaggacacctgctcaggaggctggggtttggtcttggcccagtcatttgctactggttgattctgggctagttaagtaattgagtctcagtgttcatgtctctgaagtggaattaaacgagacaacataggaagtgtacttagcctggaggccagcacagaataagtatgtaatggatgttattgctgcagctggcaacagggaatcattgagaagtgcgctggactgtttctttggtaattaacaagatctccctctctgtctctctcctctccttttctctccctttcccttcctccatcttctccctcccttctgtcttagtttttgtttgtttgttttgagatggagtcttgttcgtcgcccagactagagaacagtggcacaatctctgctcactgcaacctccgcctcctgggttcaagcgattctcctgcctcagcctcccgagtggctgggattatagacaacgcaccaccacactcggctaatttttttttgcatttttggtagagacggggtttcaccatgttgtccaggctggtcttgaactcctgacctcaggtgatccacctgcctcagcctcccaaattgctgggattacaggtgtgggtcactgctcccggcctgtctttgtttttaaacccagagattggaatgttctttctgtctccatgctacaacggagagtcctggatcaaaaattcagaataattgactgttgtgtaaaccaagtacatgctgctctcccattgttgtgggcacaaacaacagaagtcattgagattcctttttttttgctttttgagatagctgggtctcactctgttgcccaggttggagtgcagtgatgcaatcacggctcactgcagcttcaacctcccaggctcaaatggtgttcccatctcagcctcctaactgggactacaggcgacgccaccatgccctgctaatttttattttttgtagagactgagtctggctctgtgggccacgctggtgactctttgtaatacggtgataatgtgtgaaagcaggcttgcgttgcccctgtggatgaggcttggagaggtccatgtggctttctttggttgtggacaccttgggcagaatgatttgtctgaagattgctgggggcttcagacaatgatttgtctgaagattgtgggaaccaggtttgggagtgggcaggattcaaggtgctcaaggggcaggaggtgggaggcacttaggacataattgaaacagttattcagtgtgcctgcctgcccgccccctcccagtcccccaccactgccagagagttttgctcttgttgcccaggctggagtgcaatggcacgatctgggctcactgcaacctccgcctcccgggttcaagagattggcctgcctcagcttcccaagtagctgggattatagacgcccgccaccaggcccagctaattttttgtatttttagtagatacggggtttcgccatgttgccaggctggtgattttgggtttttttttttttttgcttgttttttttaagtgtcgtggtctcactctgtggcctgggcgggagtgcagcggcgtgatcatagctcactgcagcctcaacctcctggtctcaggcagtcttcttgcctcaccctcccaagtagctaggactacaggtgcatgccaccacgcctggctgttttcacattttttgtagaggcagagtcttgcccaggctggtcgagaactcctgggctcaagcaatcctgcctctgccacctgaaagtgctgggattacaggcatgaggcaccacacctggctctgggtgtttggtgaaggaaagtaatttggaagcagagccggaacagaatcaagagagctcgggagtgggcaggtgatctggattgaaatggtttggggctggttagcataattgcttaaggacacctgctcaggaggctggggtttgatcttggctcagtcatttgctaccagttgattctgggctagtcaggtcactgagcttcagtgttcatgtctccaaagtgggattaatgagacaacataggtggtgtacttagcctggaggtggcacagaataagtatgtaatggatgttattgctgcagctggcaacagggaatcattgagaagtcagctggactgttcctttggtaattaacatagatctctctccctttccttccctctccctcccttcctctctcctctgtctcccttcctctctcctctctctccctcccccattttatcccctccttttctccctccttctttttctttctttctttgtttttctggtttttttttttttttttgagacagagtctcgctgttattgcccaggctggagtgcagtggtgcaacctccgcctcccgtgttcaagcgattctcccgcgtcagccttctgagtagctgggattataggcatgcaccaccacgcctggctaatttttttgtatttttagtagagtccagatttcaccatgttttcgaggcaggtctcaaacttctgacctcaggtgatccgcccacctcagccctccaaagtgctgggattacaggtgtgagccactgcgcctggcctgtctttatgtttttaaataacctagagatcaaactgttccttttttctccatgtcacaacggggagtcctggatcaaaaattcagaatggcggactgttttaaaaccaagttcatgctgccctcccattgttgtgggcacaaacaacggacgtcattatgatttctttccttttgaggcagcagggagttgcccaggccggagtgcagtggtgccttcacagcccactgcagcttcgacctctcaggctcgaatggtcctcccacctcagcctcgcgagtagctaggactacaggcaagagccaccatgccctgctagtttttattttttgtagaggccaggtctcactctgtgagccgggctggtgactctctttgtaatacactgatgatatgtgtgaaggaggcccatgttgccgtgtggatgaggcttggagaggtttacgtggcttgctttggctgtggacaccttgggtagaatgatttgtctgaagaatgatggaggctataggaatctcaaccctgttgagagtaggcaagattcaaggtgctcagggggcagaggcactcaggacataattaaaacagttggtccgttgtgcctgctttgaatgacacctgcctgttcccaccacgttacatcacttgcctaagagtcagctctggagagaaggttctgttgactgagcctggcttgtctcccgattgtggtgggagggtgggacagaaagcctggagccccacccagggagtgtggtgggaggagtagtttcataaagagagagggtcaggccaggtgcagtggctcacacctgtaatcccagcactttgggaggccgaggcgtgcagatcacttgaggtgtcaggagttcaagaccagcctggccaacgtggtaaaacccggtctctactaaaaatacaaaaattagccactattgttggtgggtggctgtattcccagccacttgggaggctgaggcaggagcattgcttgaacctgggaggcagaggttgcagtgagccaggatcttgccgctgcactcaagcctgggcaacagagtgagactcggcctcaaaagaaaaaaaaaaaaacacggagtcttgctgtgttgcccaggctggagtggagtgttacagtcatagctcactgcagcctctaactcctgggctcaggcagtcctcccagtttagcctcccgagtagctgtgactccaggtggatgtgtgctactgtgtctagccttctcagaagtcttaagtcattcactcagtgtctgtgttgtccttcaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcggtatgggtggaagggaaaagcacgagtgggagactctcctctctgctttttgtccccagcagctgggtactgggccctgtgctgagtatagggaactaagcagtgagcagaacaaagccagtgcccttctggattttagtgcccggggggaaatggacaatagtcgaagaagtgcaatttcattacagcagcaaggctggcagcccagggtgctgtgggggtgtgtaataggatgtattaatttggctgttggcctgggagcgtcaggcgagccttaccaggggaaatgctatttaggctaagaccagaggaatgagtagccatgatgccaggaggggtgtgagacaagaacattccagacagaacaccaagcctgtgctaagcccctaaggtgggaaggaagctttttcaaagaacagttttttgtttttttttggagacggagagtctctgtcgccaggttggtgtacagtggcgtgatttcggctcactacaatccctgcctcctggattcaagcaattctcatgcctcaggctcctgagtagctggaattacaggcacgtgccaccacaccattctaatttttgtatctttagtagggatgggctcttgccatgttggccaggctggtctcaaactccttagcctccaaagtgctgtgattacaggtgtgagccactgcgcccagcccagtgattcctaaactgatgttctgtggtttagcagaatgataatgactaacatttacagaagaattactctcagccaagcagtttttttggataagaacacttgtttttaaaaaatttatatatgaattatatacagtgaaatgcgcagatgtggccaggcacggtggctcacgcctgtaatcccagcacttttggaggccgaggtgggcggatcacgaggtcaggagatcgagaccatcctggctaacatggtgaaaacccgtctctactaaaaatacaaaaaattagccgggcgtggtggcgggtgcctgtagtcccagctagtcgggaggctgaggcaggagaatgatgtgaactgggaagggcggagcgtgtagtgagccgagattgcgccactgcactccagcctgggtgacagagctagactctgtctcaaaaacaaaacaaaacaaaaaacaacaaaaaaacaaaaaaagcacagatgttttttcttttatttatttttggaaacagggtcttgctctgttacccaggctggagggcagtggtgccaccatagtgcattgcagcctgaaacttctgggagcaagtgatcctcctgcctcaacctcccaaagttctggaattactggcatgagccactgcacccggcctcctcagagagttttttttctgcctcattctttttctcctgtccgtctcggacgccatctatacacataacctttttatattgtcaggcaggttcctaaggctctcttcatttttcttttccctaattatttttttgtctttgttcttcaaattgaataatttctgtttatccagtttcaagttgatagacgccctcttctctctccaatctgccattatagcagatgaaatattgaattttcaatatattgtatttttagatgtaggatttgtgtttgttcttttataatttctgttctattgaggtttcttgacatccttgagcatagttgtaagagctgctttgaggtccttttgtgcagttttcaacatctgggtcacattttctttatactccacgcattcaataactttggggttgtattgtaggcagtgtgagtggtgtttcccacgtggtgtttcccacagactattagttgttttttgtttttgtttttgttttaagacagtcttgctctgtcgcccaggctggagtgcagtggtgcgatctctgctcactgcaacttccacctcccagattcaagtgattctcctgcctcaacctccggagtagctgggattacaggtgtgtgttaccacacccggctaatttttgtatttttagtagagatgggatttcaccatgttggccaatctggtctcatactcctgacctgaggtgatctgcctgcctcggtctccgaaagtgctgggattacgggcttgagccaccatacccagccagagatgatgaattcttttatgttcttgatttatttggttttcttaggtggtttacttggctgagcttacagcccaaattctgtctcccctttgatgggcagtagctgaaatctctttgctttttttagccgtaactgggctgctttgtgtctgctctgtgcacgtgtggtttgggggaggccagagatgtgggaagatactatattcagaatgtgggggggcccacggtgatagatttctatccctggagctttaggcaaaaatcttgtaaagatgcagacttcacccagtcttgttctgtttttctaagcgttgttttccagttcctgccagtgcactcagattattgttgtaaacattttacttagaatttatacgaggtttgatctgatacaggtttcctggtcattaccagaagtggaaattcctttcttgtcaatctgtaggagttctttgcatatatatattttttgagatggagtctcgctctgtctcccaggctggagctggagttcagtggtgtgatctcaggtcactgcaaccactgccttcctgcttcaagtgattctcctgcctcagcctcccaagtagctgggattacaggcgccccccaccacgcctggctaatttttgtatttttagcagagacggagttttgcgatgttggagaggctggtcttgaactcctgacctcaagtgatccacctgcctcagattcccaaagctggaattacaggcatgaaccactgtgcctggccctttgtatatttttactactaatcttttctcctgcattgaaaataattttttccgtggtaatcttttgtttgttgactttgtctattgtatcattttccatacaaatatttccttttttctcttttgaaaaaaaattttttatacatgtatttttcatttttaggtcatcagttacatctttttttaaataccttctaggtttgcagatttcactagggaagtctccttggttcttgattgttcatgtgttttgtgttttttttgcaatattttttaattgtttaatttttttgtatccttattccttagtctgcaatgaatttatttttgtatctagtataagatacaagttcaattttatttttattttctttaggtggatagcccagttgtgccagcactgttaaacactgccttttttttttttttttttttttttttttttgagactgggcctcgctccattgcccagagtagagtgccatggtgcaattacagctcactggagccttgacctcctggggcaagtgattctcccacctcagcctcctgagtgtctgggactataggcatgtgccactatacctggctaatttttgtattttttgtagatacagggtttttccatgttgcctaggctggtctcaaagtcctggactcggtctgtccaccttggcctcccaaagtgctgggattataggcatgagccaccatacccggcctttggcatattttaaaattgggttgttcgttgttttttttcccatgatttctaggagatttttatatatttgtctgtgacatgaatggacagtattgggagtttgtcatttgtttccagctttgtctgatgtatattttattgtacagagttactgatttgttttgttttgagtcagagtcttgccctatggcccaggctggagtgcaggtgcaggatctcggctaactgcaacctccaccctcccaggttcaagctattctcctgcctcagcctcccaagtagctgggattacaggcgcccactgccacgcctggctaatttttgtatttttagcggagatggggtttcaccatgttggccaggctggtatttgatttttttgtagtcagatttcttagtcatagttagaagggccttgtgcactccaaggtttataaagcaattagccaagtgttttcttgtagtatttttgttttttctttcttttctatttttatttttgtactaaacgtgcattgtttttgttaatacaatttggccaaatgctgaatagtttagtgttaaaaatcggatgaggtagaagcccagttcaccattatagaatcaataaagttctaggtcaccaaagttttatgtatttatgttttgagacaaggtctctctctgtcgcccctgctggagtgcagtggcacgatcacttcagcctccccagtagctgggactacagtcatgtgccaccatgactcactaatttgtgtattctttgtaaagaccgggtttctccatgttgcctaggctccaaagctttattttaaagacttgaaaatgttacaattttgtgcaagtttaatagttatatttagaacgtttgacagtcttctccaagaacaagagtttctcagcaccatcagctgtttgattgctctcatggtccttcttctatacgtccctcaaacgaaactactcacttttaactgaggacaggcactttgtataagaataaccttgaaaagtgtgcaggacctaattggaagtaactaaaaattaaatacatttcctaaaggttactttgtttcatatgagtactaagatgccaaaaagttttacaaaaattcaaatagatttaatctagttttactcttttcataagtttttcattttattttatttatttatttttgagacagagtcttgctctgtagcccaggctggagtgcagtggtgcgatcttagctcactgcagcctctgcctcccaggttcaaatgattttcctgcctcagcctctcgagtagctgggactacattgcatgtgccattatgcccagctaatttttctatttttagtagaaatggggtctcaccatggtcctgacctcaagcgatccaccacctcggcctcccaaagtgctgggattatagccgttagctctcacacccagtccaacttacacattttttttttttaaagagatggggtcacacagtgtttcccaggctggtctcaaactcctggattcaaacaatcttcccatctcggcttgccaaagtgttgggattacaagcatgagccactgtgcccagccaattccatggacttttaaagcattttttggctcaaaaaggatatgttcttagttatctaaccagtatatctctttatatttactgaaaatctgttttcctatttaagtattttcaggttctcaataactgcacatgaaattaacagctttcatagtcacaaattattgcaatattttgctgttatactaaatatgggttttttttgtttgtttttaagacagagtctagctctgttacccaggctggagtgcattggcacaatcttggctcactgcaagctccgcctcccaggttcatgccattctcctggcctcagcctcccgagtacctgggacaacaggcacccgctaccacgaaccggctaatttttttgtatttttagtagagatggggtttcgccatgttagccaagatggtctcgatctcctgactttgtgatccacccgcctcagcctcccaaagtgctgggattacaggcactaaatatgcttttatacattagttgacagaatttcaacatataaaatacataaagcaattttcactccagttacaactagcatgctgacctttatttcaaagtaaatacgctaggtgagatagctcatgcctgtaatctgtcatcttagtacttggggaggctgaggcttgagtattgcttgagcccaggagtttgaggacatcctgggcaacatagtgagactcccgtctctagaaacaaatataaaaactagccggctatggtagcttgtgcctgtggtcacaactactcgggaggttgaggtaagaaggtgaaagaatcgctgggcgcattggctcacgcctgtaatcccagcactttgggaggctgaggtgggcggatcacctgaggttaggagttggagaccagcctgacaaagatggtgaaaccctgtctctactaaaaatgcaaaaattagccaggcatggtggcaggcgcctgtaatcccagttacttgacagactgaggcaggagaatcgcttgtacccgagaggcggaggttgcagtgagctgagattgtgctgttgcgctccagcctgggcaacagagtgagacttcatctcaaaaaagaaaaaaaaaggtgaaaggatgacttaaacccagggtgtcgaggttgcagggaaattcagaaatgccactgaagggccaggcatggtgtccaacacctacaatcccagcactttgggaggcagaagcaggtgcatcacctgaagtcgggagttcgagaccagcgtggccaacatggtggaatgctgtctctactaaaaatacaaaaattagcaggatgtggtggtgcgtgcctgtaatcccagctacttgggaggctgagacagaagaatcatttgaaccccggaggcagaggttgcactccgcctgggtgacaagagtggaactccatcttaaaaaaaaaaaaaaaaaaggcactgaagctggtccccagttccctagcattccagaagcaaaatagattttgaccaaataaggagtttgttaaaatttccgattcagtcggagtttgtgttagggtacagtatgaggtacgaatctaataattttttcctggtgggtacccagtggtccctaaaactagaactgaacctgccatctttttaccaatgatctgtgatgccacctttattataaattaaactcttgtctatttctggacctttggttcctttgttcttacaaccagtagcatactattcttcattgttgaggctttatagtagtgcgttctgactctctggtagagctagttccctgatctcttttacagagttcctctgatcattcttgtttcattgtcacaggatctttcaaatcagtccagtttattcccccagtagaaacgtattaagacagtgttaaatttatcagtttaacttgtggagaattaatttctgcatgataatgggtcttcctctttatatactcagtatgtctgcatttctgcaagcattctgtactactctacatattattatgtgaatattttatctttgatatgtcaaccttagggctgttttaactgtttctggtattgtactccgaagtattatccctttgttgttggtagtagtgtgttttttgtttttgtttttcgagacagggtctggcattgttacccaggctggagtgcagtggcatagtcatggcttactgtacccttgaattcctgggctcaagcagtcctcctacctcagcctccgagtagctgggactacaggcacgcatcatgcacggctaatttttttactttttgtagagacagggtctctctatattacccaggctggtcttgaaccctgggcctcaagcggtcctcacaccttggcctcccaaagtgctgggattataggcatgaaccactgtgcttgtccctttgttgtttttaatcggtactgtggtaactttatcctatccactacttctaaagaccctgtgagggtaggtacttgtatgactccatctagacatagtaggatatgttgaataaatgaactgatgcagccattaatcagtgcagttattaatttggtgattgaaggaactgaggatgaaggagatcaagttccgcaatgatactcagtgagttctaggtggaggaggagctgggtgttaactcctgggttcctctccaaacacgtgcttctgaccactgtgggatacagttagcaggttgtgtaaggtctggggacagacacagggtcaataataaaaattgctgaaaatttatagatgtgtgcttatgtgtaaaacatctgttgtgtgcttcctgtaggattttttttttttttttgggaaacattcttactctgttgcccaagctggagtgcagtggcatgatcttggctcactgcaacattcaccttctgggttcaagcgattctcctgtctcaccctcccgagcagctgggactacatgtgtgcaccatcatgcccggctaatttttgtatttttagtagagatgaggtttcaccatgtcggccaggctggtctcgaactcctgacctcaagtgatccgcccgcctcggcctcccaaagtgctgggattacaggcgtgagccaccgtgtccgggcctgtatgacttcttgccaccccttccccaccacaatcctgcatgaaggttactattactatccttgttttgcatgagagaaaactgaggtgcagagaaggtggttttcccagaattataacagattgttttcttacagcacttggcagtgcctttaccacagtgtttatgcccttcacaagaaggggttgtgagcagggcagctgggctggtactgggcattttgaacttccactgagaggttaaatatgatctcttccacctgcttaagtgcatcttatgcctggcacaatgcctcatgcctgtaatctcagtaactcaggaggctgaggcgggaggatctcttgagcccaagagtttgagattgcagtgagctgtgattgtaccactgcacttcggcctgagagacacagcaaaaacctgtgtcttaaaaaatcatgttgttatatgtgtttattaggttattattattttgagatggagtctcactttgttgtctaggctggagtgcagtggtataatctgggctcactacaacctctgcttcctggcagttctcccacctcagcctcccaagtagctgggattacactacaactggctaatttttgtatttctagtagagacaggattttgccatttgcccaagcttgccaggctggtcttgaactcctgatctcaggtcttccacctgcctcggcctcccaaagggctgggattacaggcatgagccaccttgcccagtcatattaggttatttttaatgctggttggcattgtgagcttgcaagagaagatggagcatagtggtcttctcaaaccaccaaatgccacatgcagtcctgatagggctttggcttattgctgagtgctgtgtgggcagcatcttatttaatcctcatgacagcctcgtgcaccccatgagctatgatgagtcccattctgcaggtaaagagcccatgccccagaaggttaagggacttggcccactctgtggcatctaggaagtttggggctgggacttgtgcccaggtgtgtctgacccttcgcacctcctggatccgcggtgctggagggatgctgcggtttgtcctcttggataactctgcttttctcttcgccagcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagaggtcaggaggccttggtgtcttcaccagcatggtcccctctccctacctgagcaacatcttgtcccacaagctctcccagcattatctttacagggaccccacaccctgctctgcacccaggttgtctaatcagagggtgtcggactgcactgggcagactcttgccttgggccctggctggagctgagaacagtcagacatccagccctgtaagggccccttatgggtatttagagaaatagctttggggttcacagatgaagtccttgtattgggattctgcctctgggcagcagaatttatttccagaaagatgcttcctggtctgtaattcacaaacacagcaaactaccctgatgctcagtaggaacagagagttttgtggggagatctggcacagtggctcacacctgtaatcccagcactttgggaggccgaggatctcttgagcccaggagtttgagaccagcctgggcagcatagtgggactccatctttacaaaaacatttaaagattagctgggtgtgatggcatgtgcctgtagtcccagctactcaggaagccaaggtgggatgattgcttcagcccaggaggtggagtatgcagtgagctatgatggcaccagtgcactccagcctgggtgacagagtgagaccctgtctcttaagaagcaaagatgttgtggggagaaatttctggtggaattgccagctagcctattatttttgtgacttgatggcaaccaatatatttggctaaaactttgaaacctcatcagcatttgctctttttcagttggcacttccagaggtagaatgttgaaactgtaatgaggcatttggccaggcacagtggttcacacctgtaatcccagcactttgggaggctgaggcaggtggatcacctgagctcaggagtttgagaccagcctggacaacatagagaaaccccatctctactaaaaatagaaaacatgagggtatggtggtgggtgcctgcaatcccagctgctcaggaggctgaggcacgagaattgcttgaacctgggaggtggaggttgtagtgagccaaaattacaccattgcactccagcctgggtgacagagtgagactcttgtctcaaaaaaaaaaaaaaaaaaaagacattcattagtggattgtccaagttgtttttacctttttttttttttttttttttttttttgagatggcgtcttgctctgttgtccaggctggagtgcagtggtgctatctctgctcactgcaacctctgcctcccaggttcagcgattcccctgcttcagcctcctgagtagctgggactgcaggtgtgcaccaccatgcctggctaatttttatatttttaatagagatggggtttcaccatgttggccaggctggtcttgaactcctgaccccaggcgatctgcctgcctcggcctcccaaagtgctgggattataggggtgggtcactgttgctggcccaattaattatttataacgtcgatttgctttctaatgtgtaaccagtaggtgggggataaaaagtaaaaattcttaagtttaataaagtagttgttcctagatgtccatcagtaatgaagtggttaaatgaagtacatagatgtattttgtgaaatgttaatggttaaaatgaacagtagatagaaatgttgtggtagaaagattgccaaggctaggcacagtggctgatgcctgtaatctcagtgctttgagagacggacgcaagaggattgcttgagcctaggagttcaagatgagcctggacaacatagtgataccccatctctacaaaaatgaaaattgtaaaaattaggcctggtggcatatgtctgtagttccagctacttaggaggctgaagtgggaggatgacttgagcccaggagttcaaggttacattgagctatgattgtgccaccgcaccccagcctgggtgactgagtcagaccctgtctctaaaacaaaaatcattgccaagacataccactgaagtggggagagtaagtcatacacaggacaacatattgtatgtttccagtaatgcttaataaaaaattttcttgttttatgctcagtagatacatacatatgtataaagtttatgtttgaaaatggagagaacagctgggcgcagtggctcacgcctgtattcccagcactttgggaggccaaggtgggtggatcacctgaggtcaggagttagagtccagcctggacaacatggtgaaaccctgtgtctactaaaaatacaaaaattagccaggtgtggtggtgcgtgcctgtaatcccagctacttgggaggctgaggcaggagaatcacttgaacccgggaggcagatttacagtgagccgagactgtgccactgcacttaagcccgggcaagagagtgaaactccatctcaaaaaaaaaaaaaaaaaaaaattcagagaacaatggttgaaaagctctcccacatgttatggtgatgatgagtgaggaggagcatttggggatagtctggaaagcatactttatttatttttgagacagtcttgctctgtcacacaggctggagtgcagtggcgtgatctcagctcactgcactcactgcttgtcccccaggctcaagcgattgtcttgcctcagcctcccaagcagctgggactacaggcgctcaccaccacgcatggctaattttttgtatttttaatagagacggggttttgccatgttggcctgaaaattcctgacctcaagcaatcctcccatctcgacctctcagagtgctgggattataggcttgagccagtgcaactggcctttttttttttttttcttttttttttttttttttttttttttttgagccagaggtctcactctcgcccaggctgaagtggtatgatcatggcttactgcagcctcgacttactggattaatgtgattcttacacctcagcctcccaaagtgctgggattacaggcatgagtcactgctcccgggcatattttcatttagtgttctaaatacactgctatgttggaattgttttttcaataataaaagcattagtgtgtcactgtcatagctttttaaaaatctgaaaccattttgttagtcaagagaaacatcctgtagagttccaagtctgctaggcaaggtcctgtgggtttccctttatttggggtttctacctggagtgtttcaccccagtaggtcttttttctgactggtatctactgttgaacctctctccctgcaccccaccaaccctaagcaaggacttaaattccctttttgttttttgagacgtagtcttgctcttgtcacccagactggagtgcgctggagcaatctcagctcactgccaccctggcctcccaggttcaaatgattctcatgcctcatcctcctgagtagctgagattacaggtgcctactaccatgctgggctaatttttgtattttcaatagagatgaggtttcaccatgttggtcaggctggtctcgaactcctgacctcaggcgatccacctgccttggcctcccaaagtgctggcattataaacatgagccactgcgcctggctgaggacttgaattcctgaatcctttttctggcacagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggtaaggggagtgggaattgcaggattttctcggttcacaaagtgtttctgggtaagaatctggggtgggtcctgggggtgtgatgatttgcatcaggctcagagcctgatttgctctcaggctttgagcagagagtagactgggatgttcttggggatgggcattgagatcagtgaggactgggtaagaggcagtagtggagtctgatgaaatggaaaccccacccagagcgggtggctgccactctgcagctacgaggattggcccttcatctgcagctttttccattcttcaaagccagaaatcctctttttttttgttgggtttttttttttgagacaggatctcactctgttgcccaggctggagtgtagtgacgtgatcttggctcactgcaacctcttcatcgtgggctcaagtgattctcccacctcatcctccggagtagctgggactaaaggcacctggctaacttttgtattttaggtggagacacagtcttgccatgtcgcccaggctggtatcaaattcctggactcaagtgatccgcccacctcggctgatcccaaagtgctgggattacaggtgtgagccaccgcgcctggtcaaaaatcctcttgttgaatataaaacctcccaaatttgaaatgtcactgaccaaatacaaaaaagtaaaaagcgttctgtgggtttagtaatacatccaccgagagctagactcagcgtaacgtgtgctgcatgggcagaaaaaaagaatctcagttctcaccccagcccctctgctgacagcttccgatcaggccttttacagcagatattaataacagacagttaaggagtgctcagtgtgtgctggccagcctgcagccttcgccgcaggcccaggatgcaggtgctgtccccgtttgatgaaagtgaggctctgagttaagcagagtcatgaagcaattgaatggcagatggtttgggattcagacccaggcaggcaggctccagggcttaccctaccatctactaccttatcccttagcttgtcccctgggcatgaagagaccagtgagacttctagaattccggtgcagagcccttctgtttagttttgttgagatggagttttgctctgttgcccaggctggagtgcaatggtgcgatattggctcgctgtaaccccctcctcccaggttcaagtgattctcctgcctcagcctcctgagtaagcttgaattacaggtgcccaccaccatgcctggctaatcttgtatttttagtagagatggggtttcaccatgttggccgggctggtctcaaactactgacctcaggtgatctgcctgcctcagcccctgaaagtggtggtattacatgtatgagtcactgtgcctagccccagtctagagccattttgcatactttatttcattgttgtttttagagacacagtcttggtctgtggcccaggctggagtgcagtggtgcaatcatagctcactgcagcctccaactcctgggctccagtgatcctcctgcctcagcctcctgagtagctgggactagaggcatgcaactccatgcctggctatgtttccacacttcaatatgcatgtagcttacctggggatcttggtagaatgtacctcagatcaagtgggtcttgggtggggcctgaaatttctttctctctttttttttttttttgagacaaagtcttgctctgtcggccaggctggagtgcagcggcattgatcttggctcactgcagcctctgcctcctggattcaagcgattctcatgcctcagcctcccgagtagctgggattacaggcaggcacctgttaccatgcccagctaattttgtatttttagtagaaacaagattttgccatgttggccaggctggtcttgaactcctgacctcaactgatcgaactgcctcggcctctgaaagcactgggattacaggtgtgagctactgtgcctggccgagagattctgcatttctaacagttctcatgtgctgctggtgcatggaccccacttggagaagagaggctctgcagagcgggacccttgtaaagctggatcatcctgtctatagttcttgtatctatcacagatgccattatgttaattaactatatggattttctacaatttcaaaaggatttgttttgggtttgtttaaaaagactaatgtggctgggcacggtggctcatgcctgtaaataccagccctttgggcggccaaggtgggaggatcgcttgaaactaggagttcatgatcagcctgggcaacatagtgagaccctgtctctattaaaaaaaaaatttgttaaaggccaggcatggtggctcacgcccgtaatcccagcacttttggaggccaaggcgggcagatcatttgaggtcaagagttcgagaccagcctggacaacgtgatggaactctgtctctactaaaaatacaaaaattagccgggtgtggtggcacatggctataatcccagctactcaagaggccaaggcaggagaatcgcttgaacctgggaggcggaggttgcagtgagctgagatcacatcaccgcactccagtccgggtgacagagcaagactaacatgtaaaaataagtatttgttgcagtcatcacaaggacttgaaaaattggttgtcatacgggccttgggtgtgtgatgcggttaactacggaaagaaatagggtagcttttgggatccgaggaaaggcgtcagtgtccctcctgtcccgtggttttggatctagcgatgttaacgcacagacatgactataggttggtgagttacatgctcttccctttgcacacccaggcctggacgactccaccggggggacccccctcacacctgcggcccggatatcagccctcaacattgtgggagacctactgcggaaagtcggggtaagaccacactttcctggcgtttggtgccttcctgcctgtctttcaggatgtgtgaagggggttgatctagttccttccctctcttctttttttctttttttttagagacagggtcttgctctgttgctcaggctggagtgtagtggtatgatcacaactcactgcagcctcaaaatcctgggttcaagcgatcctctcaccttagcttcccgaggagcttggaccacaggtgtgcgccactatgcctggctgatactttcatttttttgtagtaatgtgggtatcgctgtgttgcccaggctggtcttaaactcctggcctcaagtgatcctcccaggttggcctcccaaagttctgggattacaggcatgagccaatgcgtccagcccctttcatagcagtgtggtgagttttaggtgtggctgctcctttagcatccctgggaatcattagagcttcctgtgggagttactgccagacactcagagctctgactcgaagccctgctctgaaccctatgtatgtctctttccttttaccgtttttcctctaggaaatttgggaaattagggtgatatgtgtgttttttccttaactcgaaaaattaaggagcacttggaaactgccttctcttttggccgggtgctcatacctgtaatcccagtgctttgggaggccaaggtgggagattacttgagctcaggagtctgacaccagcccgggcaacatggtgaaaccccctgccccgacttggcctctacaagaatgcaaaaattagccaggcctgatggtgtacactggtggtcccagctactcaggaggctgagaggtgggaggattgcttcagcctgggaggttgaggctgagtgagctgagattccaacactgcactccatcctgggtgacagcacgacgttgtctcagaagagaaaaaaactgccaccttttttttttttttttttttttttggtttgtttcttggggtttaagtgaattttgacactttgggagaccgagatgggtggatcacctgaagtcaggaattcaagaccagcctggccaacatggtgaaaccccatctctactaaaaatacaaaaattagccaggaatggtggtgggcacctgcgatcccagctacttgagaggcttatgcaggaaaattgtttgaatccgggaggcggaggttgcagtgagctgagatcgcaccgctgggtgacaaagtgagacttggtctcaaaaaaaaaaaaaaaaaaaatcttgaaagcctagggcaaagaatttggcctttcagcttttatgttaattacagggagggatccttttgtgcttaagtaaaaacataggtattctttgtagtttatttttaaaaatgatgcctagaaggccacataatttaactcctaccaagttgtcactgtacacagtgtatttgtagctacaacttaatagaagcttgcaactcatttcttttgtttttacttctggtttttggctgtctggtttgctattctagaagcaggtctgcatttcagtatttagcctagttggagtatagagaagcctggggtgctgtcagtgtccttttggtttcctcagggtctgttgtagccagaccaagtccttaccaaacttcttgccattctgcagaggtttaacaaggtaaaccaaagggtgaaggattccagaagtggatttcctacttcctacaagcggagttggataattggtaggttagtgatttttccagaaagctcccattttaaaaaattttttgtaattaaaaaagaattttttttttttttttaagccaagcatgattgtgcatagtcctagctattcaggaggctgaggtggaaggattggttgaggctgcagtgagccgtgatctttttccaggcagctcccaaacattttaaaaaatttttcgtaattaaaaaaaattttttgcattaaaaattttttttattaactgggcatgattgcggatgcctataattccagctgctcaggaggctgaggtgggagggattggttgagcctgggaggttgaggctgcagtgagctgtgatctcaccagtgcactccagcctgggtgacacagcgtctaaaaaagtaaaaaacaaaacaaaaaaaaaaactgagatgggatcttactttgtggcccaggctggtctcaaactcctgatgtcaagccatcctcctgccttggcctcccagagtgctgggattataggtgtgagccattgtgcccagccagctcccaaatacttaaggtgcttggttctgagactggcatatacgttggattcctcttggggtcccaccttggaattccagtgcacaacagtttgagaaccactgtctggggttcgttcttctgtacaggctctggtaagacagaatagtccttgcctataacttgagagataaaagtgtatttctgtccaggcactggagtccaaactcgcttcctgccggaacctcgtgtacgatcagtccccaaaccgaacaggtggcccagcctctgggcggagcagcaagaacagagatggcggggagagacggccaagcagcaccagcgtgcctttgggtgataaggggtcagtaccttctaataaacctctcgctggcggggagaacccgcctgccccaggcaagagacactcacccccagcccacagccatgtgtctttttaaattataggattatttcagcaaaccttatcctctcctctgctccctgcaggcagcattaggtggtgtcttgtggcttgaacaaagggctagagagagggtcttgttttgtgagacagggtctcactctgtcacctaggctagaatacgatggcaggatcatggctcaccctctgcctcccagctcaaacgatcctcccacctcagtcccccgagtagctgggagtacaggtgcgtgtcaccgtgctcggctaattttttgtattttttctagagacaggttttgccatgttgccgagtttggtctcaaactctgagcttcaagtgatcctcacccttcatcctcccaaagtgctgcgacgacaggtgtgggctaccatgcctggccaagaaggtcatttttatcatttgattctacagctgctactcacggttacactgtgagaatgtcctgtataaaagcccttatttgggccaggtgtggtgacgctcgcctgtaatcccagcagtctgggaggccaaggcaggtggatcacttgaggtcaggagttcaaaaccagtctgggcaacattggtaaaaccccatctccaccaaaaaaaatagaaaaatgagccaggcatggtagcatgtgcctatagtcccagctactcaggaggctgaggaaggagaatcacttgaaccctggaggcagagattgcagtgagccaaaattgtgcctctgcacagcagcctgggtgacagagcaagactccatatcaaaaagttaattaattagttaaataaaaataaagcccttatttggggaattgagcatcagtcatggctctgcttcccctgaagtttttttttttgttttgttttgttttttttttgagacgtcttgctctgtcgcctaggctggagtgtagtggcatgatctcagctcactgcaacctctgcctcccaagtccaagcaattctcctgcctcagcctcctgagtagctgggattacaggcgtgtgccaccatgcccagctaattttttgtatttttagtcgagacggggtttcactgtgttaggatggtcttgatctcgtgacattgtgatccacccacctcggcctctcaaagtgctgggattacaggcgtgagccactgcaaccagcccttttttttctttttaaatctgtagaacctttgagaaactggcactaacttctagcccagactatgttcctgaaaccagccacccgatgggacagtgcagatctgatctctaacagtgtcattaattttcttgcctaaagaaaatcagggccaggctcagtggctcacacttgtaatcccagcactttgggaggctgagggcagcggatcaattgagctctggaggttgaggccgcagtgagccgtgttcccagccactgcactccagcctgggtgatgaagcgagaccttgtctcagaaaaaaaaggggcagctttcagattcaggaattctgcaaggtgtgtgactaccatctctctgggccccaagccgtaggaatttgatgggtttgtagcagacacgtgacaggaaattaagaatattttccatggcatgcacataactttgagacctttacacgtggatttttaggccaggtgcagtgaagtggctcacacctgtaatcccagcactttgggaggcagaagtgggtggatcacttgaggccaggagttcacaagaccaaactgggcaacatggtgaaaccctatctatactaaaaatacgaaaattagccgggcatggtcgcggatgcctgtagtcccagctgcttgggtggctgaggcacaagaatcacttgaacccaggaagtggaggttgcagtgagccaagattgcaccactgaactccactctgggcaacagagtgagactctttctcaagaaaaaaaaaaaaattaatttttgtttgttttctttctacgagacagggttttgctgtgtcacccaggctggagtgcagtggtgcgaccatagctcactgcagcctcgtcctcctgggctcaagccatcttcctgcctcagcctcccaagtagctggggctacaggtgcacaccaccacccctggctaattttttttatattttatagaaacagtcttgctatgttgcccagactggtctcaaacctcctggctttgagtttgagaatacacctctgagactgtagtctgcttctcattgagatttctagaggtgagttttcagattaattttccaggcgatcttcccaccttgacctcccaagtgctgggggttacaagcgttagcaatcatgcctggcctttttttttttttggagacagggtctcactctgtcacccaggctagactgcggtggtgtgatctcggctcactgcaacctccgcctcctgggctccagcgatccttccacctcagcctaccaagtagctgggactacacatgcaggccaccacacccagctaatttttgtttgcatttttcatagagacagggtctcactatgttgcgtaggctgtaaaacaaacaaacaataggtaagagatggatttttctagtgggtctgagactgggcgttttgtgtgaccttggaatctgagagccaggtagccagtgtcctcttcttcatttcacaggagagaaaattgagaccctgtgagaccctgctcctgactcttgatgttcacccttataactctctgggccccggtgctagccagtttgtcacagctgttatgtcagcttaatttggtttgctctgtctgaaggttggggaagcgcctggaatttgggaagccgccttcacacatgtcttcatcgccgctgccgtcagcccagggggtagtcaagatgttgctttaggaaaaccacggaagctgaaggtcttggtgttggtgcggaagtcgttaccttttgtcgtctttttacactaggtttttgttttaagttagtttgagaaataagagcagtcaccatagttagttagctttgcggcccaagccaatgaccgaggccatcacctgtgctctggggtttgtccctgggaaatgtcttttcatccttacctgccaccgtgtgcattgcaaagagggacaaaaggggctctctgggaagggctctaagttgtcggtgatgaggctaccgtgttgtttttgagatagagtcttgctctgtcacccaggctggagtgtggtggcgtgatctcagctcactgcaacctccgcctcctgggttcaaacggttcttgttcctgagtcttccaggtagctgggattacaggcacccaccaccacacctggctgaattttttgtatttttaatagagacggggttttgccatgttgcccagtgtggtcttgaactcctggcctcaagtgatcctcccatctcggcctcccagaatgctgggatttcaagcatgagccatcgttcccatgccccattgtgttgcactaacccaagcggaggtcctgattggtcttttttttttttttcttttttgagacagagtcatgctcttgccctgtcttgtccaggctggagtgtagtggtgcaatttcggctcaccgcagcctccgcctcctaggttcaagcgattctcttatctcagcttcccaagtagctgggactacaggagtgtgccactacacccactaattttgtatttttagtgagaaacggggtttcaccatgttggccatgctggtcttgaactcccggcctcaagtgatcctcccgcctcagcctcccagagtgctggaattacaggcctgagccaccgtgcctggcccctgattggtcttgacaggtgtttttaatgtcccaagtctccgtaaatgtgggatggagcttctctcagaggctcttccccccaactcccaaccaggtggaatcgtcttccagaacaaaatctcccagtgctttgtggtgtactgaaatcatgtctaagaacagagaacttaacagtcacatgcctttttaaaaactggaataggctgggcgcggtggctcaggccggtaatcctaagactttggaaggccgaggcgggtggattacctgaggtcaggagttcaagaccagcctggccaacatggtgaaaccccatctctactaaaaatacaaaaaattagctgggtgcagtggtgcgtgcctataattccagctactccagatgttgaggcaggagagttgcttggacccgggaggtggagggtgcagtgagccaagattgcgctactgtactccagcctgggcaacagagtgagactccgtctccaaaaaaaaaaaaaaaggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccatggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaatgttgaacttgttgggcttctggtcaaagaggctttgtatgtttatactttaatgttttcccacagagtggtgaaaaactttttttaaccaagttaaaaaatatgaaaaaatctttttgaaaatttctattcaagccaggtttttagaaatgtatccgggatgtgtttgtgcgtcattcaaggcatattagcatctggtcacaagatggagtcctttgtttccatgtttcctgtctcccaaatctgtctgatcccatggagttggtggtatacggcatcgtttgtgttgaacagagcctttgcaggcatgtctgtctaaaacactcaagctgaaagaaggacagggcctacagcttgtttttatggcccttactctaagaatgatttattatgtttttaagggttgttttaaagaagatgaatattcggcaagaccatatgtagcctgtaaaggctaaaatactatctggctgggtgggtggtggtggtggtgtgagagacaaggtgttactgttacctaggctgcagtgcagtggcgtgatcatagctcactgcagcctggaactcctggctcacatgatcctcctgccttagccttccaagaggttgggagtacaggtgtgcactatcctgcctggcttactaacaacaacaacaaaaaaacaccttttttttatagagacgggggtctctctcggctaggctggcctccaactcctggcctcaagtgattttcccatctcagcctcccaaagtgctgggattccaggtgtgagccactgtacccagccaccatctgacgttttgtggaaagtgtttgctgactcattggacaagaccttgtgttttaactcaaaaaatcaaggaaatcctgtatttttcttaagatactggttttgatgagtcaagatgttcttcccagtcatgttcgagggcagggggcagtggcccttagaccacacatcaccttatttctctcccctgccctccctgctgagcggcccagtaacccccttagacagtctcactttgcatctctgctctgctctctggctggctgtggggttgtaggcaattgatttcacctctctaggcctcagtttctgcattcatgacgttaaccctgacttcagagaatctttgggacgatgaagcaaaacccagccttccccaactccttttcctctatagaaaacagctcaacagaaaagccaacgacattgtgatttataaccatttattagtgaaagtgtttttaagcacagtcagggtgtaaacagtgcagcattcctgctcccctccgtgggagcagcgtctccttttcaattcatgtgactacagaaggcacttggtgaactgtgcgtgtctgaggtgtggaaaccaggagagggggaaagaattctcaaaggcctgacgtgagaagttggaaaggtttgcaggttagggaatgaattgggagtgggggccggcggcacccatttcggtgactttctccccatttcatgtaaacagaattgccagggaccggttaccgtggatatgtttttctaaaaactcagtgtctgcacaatccattgatagaactggaggatgtgtctgtgtttcctgttgggtttttctcatctcttacatcatacaaacttcaatttttaccttgaatacaggggtagtaggggtggtggtggtggtggtggttgagacagggtctctgttgcccaggctggagtgcaatgatgcaattatagctcattgcagcctcgaagtcctgggctggagcgttcttcctggctcagcctccctagtagctgggaccacaggtgtgtaccaccacgcccagcttatttttaaattcttgtatagatgaggttttactacgttgcccaggctggagggtggtggtttttatattccttgtgtgaggggtgtctgtgatatttggaatttgagaatggatttagacaatgctaagtacagtctgctgggttttgctttgttctgggttgttgttgggttttttttgtttgtttgttttggtttttggttttcttgccgtggtgcaaaactgtagaaagttgcttattcactggccttggttccattgaagtctgcgtctcgagtgtccgtttcctcctcagaaccatctgcattttcaataactctacgtcctccagaccttctagaaggaacgaaagaggtctcgtttcctcgcctgtgggttgtaagaaaacacattatttagcaaagaaatcttcatggttgggatagattttttataaatctattttaaacttgtagctatagtcctattgcaatataaattttttttatggcagaaaacacacacggcacaaataagatgcagatattcaagttgaagtcaacaaatcattgccagtcttaaggcatgagtgattgaatttaatcagctgaaattggttgcgggggtgggtggagaaggtttttcaaagcaagacgatctgcttttcaatatgtcaggcttggtcatttgagaagccacaggattctggtctgctgtggtctttgatttagaataggaaaaaaacgccaaaaaccaagcaggggattttgtcttctgactttattcatagcccatggggcagagttgaagagagaacatactgtttttcttctgtatctcctcacccccattcgccttagaggtgagttttcaagatttgaattggaagaaggtgaaatggacaagggcagccttgagaaggacacagaggggctccctggttaaaaggcgagacagcaccccctgctggtgtgaatgttcatggactgagttttccccactgcagggactgctgcatctgttttgctgatcgtggaacataccgcacatggcgtaaaacaggtgcccagtgaatattagaaaaggaaattatacgtgttaatccaaggtggattattttattaaattgagatgaggtcttgatattgttgcccaggctggtctggaactcctgagctcaagcagttctcctaccttggcctcccaaagcgctggcattacaggcgtgggccaccacacctggccttcaaggtggatttaaaaaagaaatttaagagtctctctcacccaggctggagtgcagtggcatgatcttggctcactgcaacctctgcctcctgagttccagcagtccttgagcctcagtattgagtagctgggactacatgcacgtgcacactgccacgcctggctaatttttgtatttttagcagagatgggattttgccatgtgacccaggctggtcttgaactcctggcctcaaacgatccacctgtcttagcctctcaaagtgttgggattacaggtgtgtgccagtgcacctggcctctgaggtggattttagctccagccagtaggacacccctgtctctccttaatgctgccatctcctctctgcgctggttctctcttgagtttatcacctcgacttcacaggaagggctggtcacgtgaggggagactttgggtaggaggaagagagtgggcagaagaaggaaaaatcagatctgcctgctgccagccttcaccgttcagaagaaacacttaactcttttcagcaaccgcaacaaataattatgttgggctctggccatctggccctgtttgacctgaatcggaagacaggtcttattttaggacatcaaagaagagagcagacttttgctccccacgcaagggttggataagaagccataaggatgaacacaactcagtgaccaattctttagtcaaaaggaacaactcggctgggcatggtggctcacacctgtaatctcagcactttgggaggctgaggcgggcggatcatgaggtcaggagatcgagaccatcctggctaacatggtgaaaccgtgtctctactaaaaatacaaaaaattagccgggcgtgctggcgggtgcctgtagtcccagctactcgggagggaggctgaggcaggagaatgacatgaacccaggaggcggagcttgcagtgagccgagatgtggccactgcactccagcctaggcgacagggtgagactccgtctcaaaaaaaaaaaaaaaaaaaaatcaaggcccagagattcatgatcactgagaagaggaattcgcaaatgacccttttgttgacagaggatgggagagaccccggctgggaaagcccacctggctataaaggatgggacttcccgcagtgcagcgatcaggaataaatacttaaagctgcagccacttcaaagtaaacactcctagcccagcttcacagagaagcttctggacttgcagccctactagagaactctccatccttctctctctagatgtgacccttaagtctttttcttttttagcactgttttccaagcgcttgactcagaaggatgctcaaattcagcgcagaggagcagcagtttgactgttccctgtacgctccccacacagctctcttcgtcacagttttaactccaggttcaaaccctgatgggttggccagttgctgcgactcatgcctgtaatcccagcacttggggaggccgaggtgggcagatcactcgtgaggtcagttgttcgaggccatcctggccaatatggtgaaaccccgtctctactaaatatactaaattagccgtgcgtggtggcaggcgcctggaatcccagtcactcaggaggctgaggcaggagaattgcttgaacccaggaggtgaaggctgcagtgagccaacgttgtgccactgcactccagcctgggaaacagcaagactgtctccaaaaaaaaaaacaaaaaaaaatctgatgagctgggaagtagtccctaacctccacatcagtgctctaggcactctctttttggctcttggaagagtctatttgctaactggaaaagcttaatggataaatttgctcccttgacctaagaaatacattgtgccctgggccgttgaagctccttgcttggctgtcagcctgcaagatactctgttttggctgaagtgcttttcttggaactggtttcaaatcctagaccaaggttgacaccaactatacctgttacaggaactaagggacccccctaaaggttttcttaaagggtctgatcctggagaatctggaatttttttttgaaatagagtctcgctgtgttgcccaggctggagtgcagtggcgtgatcttggctcactgcagcctctgcctcccaggttcaagcgattctcctgcctcagccttccaagtaactgggactacagacatgccaccactcctggctaatttttgtatttttaggagagacggggttttaccatgttggccaggctggtcctgacctcaagttatctgcccgcctcggcctcccaaagtgctgggattataggcatgacccactgtgcctggcctagcatttggattctattcgtggactcagcttatccaaggcctcgggaatcatcttgagtgtaagcacctgctagtttgcaaggactcagtttcccactgaccagtgggttctgcacttcagcccaccctggaatttggcttatcctatgatcccaatcagctggtaggagagctgcttgaagtgtcctagaaactcatctgctcccccacaaaactggctcttaacaagacctcaccctgcgctttaagtattttggtagtgacagcaaagctgagattctccaaaaatgaagatggacacaaatgagggttggtttggcctctccatgaggtgaagtcagatccacatggcctaacttcacctgtgaaaagttggtcatgcttgtaatcccagcatttggggaggccaaggcgcgcggatcacctgaagtcaggagtttgagaccagcctggccaacatggtgatatcctgtctctaataaaaatacaaaaattagctgggcgaggtggcgggagcctgtaatcccagctactcagaaggctgaggtaggagaatcgcttgaacccaggaggcaaaggttgcggtgagccaagattgcgccattgcactccagagcgagactccgtctcaaaaaaaaaaaaaaaaaaaagcaaaatcccagagcagcagagacctcttcatgctttcttgggaagggccctgtgtgcatccttgagtcttgggtatccactccccagtccctgaacatgtacatgcccgtgaagcctccagaaaaggctctgccaggactgtgcttggctttgcggtggtcagcttccaccccgtgtgctgaaaatgcagtttgtagctagacatcactcaagccacgtgcagcccccggcatttgtcagacatcgcagtgagctcatttccttcgcagacaagcctgtgaaagctgaatcatgggaggactggttgccgcgccgcagttaccgtgaactttgtgatctctgacttgtgacccagaccagccaactagaagccaagtacgttctccaggaatgtgcccagatagtggaactgtcatattcattcagtgcagtgtcttcactggacaagggaggacagcactgctgagtgccctaaccacgtaagagtggcttttggcatgaaaggaagaaaaatccaagctacacacacagcctctgccatctcgtcaagatgcagtgataagggcgcacactgttgggtgtcatgtcacatgtgctgcccagaggcaggaaggacagtgggtcaagagatgaggtctatttgtcatcctgatcttggtttcaatgaaagctttgcacaaagatatccaagcctccagattttgcaagaatctcgtggaaatgtgcaagggtttaaaaattggggtgggcagaggggcgcattgggcagaaaagaaatggatactgagacaacacacagctgcgaagctgaaggcatgatacctggtgcatcactgcgaagtttcctgtggggggggccctctgaaacagagagagaatccccggaggttaccatcagcaaacaagaaggagcccggttaagtatattcttaattgttaaagacatttgcttcgatttaataattaaaggcactcttttttattttgagatagtctctgtcacccaggctggagtgcaggggtgcgatcttggctcactgcaacctctacgtcctggattcaagtgatccccttgtctcagcctcccgagtagctgggattacaggcaggccccacgtgcttggctaatttttgtatttttagtacagatggggttgcactatgttggtcaggcttgtctccaactcctgatgtcaatgatcttcctgccttggcctcccaaggtgctgggatttgggattacaggcatgaaccaccgcacctggcattaaaagcacccttaagtcaacgttgcagtgaatcacctgacgccaagagcatttggtgaggctggtagatgaaaggataagcagttttttgatactctgtcacccaggatggagtgcactggcatgatctatctctgctcactgcaacctccacctcccgggttcaagcgattctcctgcctcagcctcccgagtagctgggattacaggcatgcaccaccgtggctggctaattttcatatttttagtagagacggagtttcaccatgttggccatgctggtctcgaactcctgacctcaagtgatccacccacctcggcctcccaaagagctgggattacaggtgtgagccactgcacccggctcagttttttaaatggaaaggaaaatgtctgtcctttagagctacttttaagaacctcctataaatcccatgattgcatactggttcagggaagtaaaagcatttgagcaagctagtttgagaaatcagtgttggaacagaagccaagaagtcccaggcaaggaacctgcagccgcctgtcccttggtttatgattacttgctcttcattagctttcgggcctctagcaagagaggagaggtggaggccttgtacagctcttgccggaggtaactggcagtgtagccagtggtaggtaagtgggtctggctttagagagggcttgtgtcgagatgcgtctggctgatagaacttggtgaaactcgcactacagttccttcttggctgaggagccaggcatgcttaccaacctccctcagggctctagtgcctgattttatgtttttgtgcacccaaaagatgcagaaggcaggacagaccttccacctgcattatgtgtgtattcgtgtcggaactggcaaaaatggtctttttgttccactttgcccttggctgcccaagaaggctcaagtgtctggggcagaacccacaggaggtgtccagtgtgtgctaaagaatcactgggccggccgggcatggtggctcacgcctgtaaccccagcactttgggagaccgaggcaggtggatcacgaggtcaggagatcgagaccatcccagccagtatggtgaaaccttgccactactaaaaatacaaaaattagccaggtgtggtggcacgcacctgtaatctcagctacttgggaggctgaggcaggagaatcgcttgaacctgggaggcaaaggttgcagtgagccgagatcgcgccactgcactccagcctggcaacagagctagactccgtctaaaaataaataataaaaagaaaagaaatcactgggcctgagaaagggaagcagagacagcagtggggtagggagtcagagtggctgtatccccatcgctcagcccagccactcaggagaggcagggggactggttgccagcagagcacatctgagggtttttgttttttgttttttttttggagacagagtcttgctctgaaggctggagtatagaggcttgatcttggctcactgcaggctcctcctcctgggttgcaaaggagtgtcctgtctcagcctcacgagtagctgggattacaggcatctgccaccacgcctagctgatttttgtgtttttagtagagatgaagtttcaccatgttggccaggctggtctcgaactcctgacctcaggtgatcagcccacctcagcctcccaaagtgctgggattacaggcgtgagccaccgcgctttgccccaggagtcttcacagtgagaacagctctcctccactgacccctcaaccctgggagatgcttccaggcccctgctgtactttgggagcctaggcctggtttctctcctatccatgggggaccaacaagcgctcaccatgcagcgagtggggcttttccctgaaggcttggtgccctgcgccagctgctctcttccccttctcagaggggtttggacttttccctgtctcacgcagtggtccccaaactctagaggtgatttcagatggcttccgggcatgccatccgctaactgaactgggccctgagaaagtcatttcctttccaactctttttaaacaagtctaattatgatgtcagagagagtctatttggtgctaatggctgttgtcactccctttttagtggagaagtaggcttcaggtcttggtgatcaagttgtggccacaatagctagatattgaacttgatactatttttatcatattactttcatcgtaaccagttgatagaggtgatgctggtttaaaaatatagaggaggtatgtttatttgccgttatattcatgtatgattaaaactgttaaaagatcaagtcattggtattaaaggtagtaagaggctcagcacatggctgtggtggtatgagaatgaagcggggaaaatatctaggacccgagggataaaggttcactctgcctggtgctgtcctagacactggagattttttttttgagaccgagttttggtctgtcacccaggctgaagtgcagtggtgcgatctcagctcactgtaacctgtgtctcccaggttcaagcgattctcctgcctcagcctccctagtagctgggattacaggcacgccccaccatacccggctaatttttgtgtttttagtagagacggggtttcaccatgttggtcaggctggccttgaactcctgacctcaggtgatcagcctgcgttggcctcccaaagtgctgggattaaggggtgagccactgcacccagcctgggcaggattctttagggaaagttgaccagattctcccatagatgggatgtggggtataaaggagaccaaaacgttaagaaggaccacgaggtttgtgatgtgaattgttggcaacttcatcattttagctgctgagctggagagaggagccagtttgggggtgaagagtttcagtcaggacttggggtgcagcatgtttggtgtgagctgcctattagacatccatgtgggaacgggagggtggtctgaggttctaggaagaagctagggcttctcagagatgaactgaggagtcattagatatacatggaattctaaagcgccaagattagttgagacctctcacctagcgctggggagagatgaaaacaactaaggccgtgcagtggtccatgcctgtaatcccagcacgtggggaggctgaggcgggtggatcacaagatcaggagttcaagaccagcctgggcaacatggtgcaaccccatctctactaaaaatataaaaataggccaaaaatagcttgaactgggaggcagaggttgcagtgagctgagatagtgctactgcactccagcctgggcaacagagcaagactctgcccaaaagagaactaagttgataccctggggcggtctagtggcaagcaggtttcgaggtgagggatcagcagaggagaggaagagggacaaccccacaggtcgggggacaagcaggtgtggatggtgtcggggaagtccagggaagcaagtgaattaggccagaggcatgatggactgcgtcacgtgctgctgccctgtcaggggacctctggccattagtgtcacccatgggaggcttctgggagagtgatgggtgggggcgaggggaaccagcaactcttcacatacagtttttttttttttgagaccgagtctcactctgtcacccaggctggactgcaacctctctctcccggttttaagccattcttgtgcctcagcctcctgagtagctggaactataggcatgcaccaccacacctggctaatttttatattttttggtagagacagggtttcggcattcacatccagttttgtagtaagggtagcaaggtagacatggggctaagaggttattccatttgctgatggagcaaatgaaagagaaaaccttgcaaaataaggatttttggagctatgtgcttgagtgaacaagagggtcgggtccaatggaggtgttggcctcggttggtgccagagggttcagcatagaaatggaaaaaaaatagaagtgtacagaggtgcacggaggtaggatgatgaggcagtgggagcttgtgcacgtttcatgatcatttctgcttttgagttaagtaggaagtaaggtccccagctgagagagaatggggaggagcgatcataagttcaaagaaaaagtgaaaagcagcagagagtgagaagatgagggaggggtgtgggaggacccctgagcaaggcctgctctgtgggaaaaggtggagagtgggttttgggttttttgagacagggtctcactctgtccatccagggtaagtgcattggctagatcatggctcactgcagccttgacctctggggctccactgatcgtcccacctcagcctcctgagtagctgggattttaggtttgcgccatcccacctggctgatttttgtttgtttgttgtagagatggggtcttgctgctcttgaactcctgagctcaaagcgattcacctgccttggcctcccaaagtgctgggattataggtgtgagtcccgtgcccagccaagcttgagtttcatttgggttgtgctttcaccaaatgattgcagcaatgcaagagggggaaccggatgttgaggatgcgcgacgggggttactagacagctggtttggagctgggtcagaggctgatggcattaatggagtgaagaccccgttggggacagagccaaagaaaggtggcaccaggcagacaatgggatgcctgagggtcaaattgtgagggctcctaggagtactggttggcccggtagaagcagcaggatcacccagagggtcaaggaaccgagaggctgcgtcgcccacctggatgttgaaatcatggagaactgtgaggagtggtgtgggagacaggaagcccggagctaaaacctcctgggagccaatcgggatggatggacagggtggtggaagcagcccttgggagcaggggggacccccaaggtaccagaggcatgggagagaaaacagcccccactccagtgacagcaggaattctcagcggggtggcagtcgtaccctcccatctctagaggacttctggcaacatctagagacatttttggttgtcacattgcagggtggtgggggactactgcagccggtgggtagaggccagaaatgtaagcacctgctacttttcagggatctttttccttctgatggggaatgtcggacagcccccatacccgagaataatgcagcccagatggcagcagtgctgagggggagaaaggaggagcagagcatgtcaggaaggaggtgaagtggcggggggtggtgttgcagcttcaatggatgtcgtgaagactcagtgatgcaatgaaggaggggctggaggagacagtggggatagcctcttcctcctcctcagccggaggaccggatgggagacggtcgatcgttaaaggatctagaaggttagctgctaccaggcaaggcagggcccgggtctgatctcagtgcctggcccacactaagcttagtgattaaggagaagcaggaataaaccacagaagggagtggcggctgtgggcacaaggggcatttgcaggccgaaaggagcccgagcccccagtgcttttctctggcctgagagacggggtcctcccgggccacgggctcctcacctgagcttgctcttgagtgcgttcacctcgcggcccatggcctcgttgctctccgtggcctcatccagctcccgctgcagcttcctgcggttggcgttgatgcgctgggactcctcctctgcctcctccagctgcctcttgagctgcttgaccctggcattgcctttctctgcctgtcgcggagagttggaggggtggttaggggaggccggctgggggctgggggctcgagggaggctgggtggcaggggctacctgctccttgtactgctcggccatcttgcgctcgtcctccacctgcagcaagatttccttcagcttcttgtctttctgcttcagcgacttggtggccgcctgtttctctctgcaaacagcaaggaaaacaggtggtttcagcggagggtggcaccccttgtagctggtgtgtcacctggaggtggcatcttgagtgctttcctgagccccgtatctggactcctctcaagaatcagtcagatggtggaatagtattcagccatgaaaaggaataaagtatcaatgcatgccacagcatggatgagcctggaattcttgccaagtgaaagaagacacatagcagacaacatagtgtgtgattccgttgatatcaagtgtccagaatagataaattcatagagacagaaagtagattatggttgccagggactgaagggagtggttacagggcatggggtttctattttttttgcggggaggaggcaaggtcttgctgtgtgacccaggttggagtgcagtggtgctccaatgcctgctcttcaccctagttcatagttcactgcagccttgaactcctggctcaagcaatcctcccacctcagcctcccaagtagctgggactacaggcgtacaccagcatgctcagacttttaaaagtttttcatagaaacggagtctctggccaggcgtggtggctcatgcctgtaatcccagtactctgggaggccgaggtgggcagatcacctgtggtcaggagttcgagaccagcctggccaacatggtgaaaccccatccctactaaaaaatacaattacaagctgggtacagtggtgtgcacctgtagtcccagctacttgggagggtgaggcggaggttgcagtgagctgagatcgcaccactgcacaccagcctgggaaacagagtgagactatgtctcaaaaaaataaaaataaaaaagtcttgctatgctgcccagactggtctcgaactcctggactcaagtgctgctcccacctacctcagcctcccaaagtgccgggattatgggcatgaaataccacatatggcctggggtttctgtttgagccgatgaaaatgttctcaaaatgactgtggtgatcgtttttacatgtttgtgaatatatgaatagcccttgaattatacactttaaatgggtgcattgcagggcgtgcgaattactgaaaaagctactagaagagaatgggtgagaatccttagaatccaatggtaagaaatgtgctgtgatcatatgcctcattcgacccataattaagaaggcttccagtgtgtgtaccaaatgggctgccggttggacttttgttttttggggttttttttgtgtgtgtgtatgtgtgtggaagggtcccactgtgtcacccaggctgcagtgcagtggcacaatctcggctcactgcaacctccacgtgtcacgttggagtgattctcctgcctcagtctcctgagtagctgagataataggcatgtgccaccacactcggctaatttttggtacagacagggtttcaccatgttggccaggccggtctcaaactcctgacctcaagtgatccacctgcctcagcctcccaaattgctgggattacaggcgtgagccaccacgtccagcctggttggatttttgatctgtcagcatgctatccctgcagaggctgggaaaagtcatatgtactgctgggaaggcaggttaatgtcaggaggaccatggagatgctaagagcagctcacactttaggtgcttgccctaggccaggaaccagcagggcactttgctgtgtttacgttcagttctcacaacatacctgcactgtaggcatcacagagcttgcttcttacaagccagaactgatgctggaagaggttccctgacttcactatgactcctgctgtccatcacccccctgcaaactgggttcggaactccacacccgcatacctggcctcctgctcgacctgctcctccagctgtgcaatcttggcctccagcgccgcgatggtggacttgaacttggacttgacggccccctccatctcgtggagcttgctccggagctccttgttctgccgctcgagctgctgccgggcactctcattcttctgggccgtgctgcgctctgtggccagctcgttgctgagctgctcggcctggggaggagagtgaaggccatgaggcggactcagggaagcccaagagagcgcactgagaccatgcctcttcctgccttgtttggcctctgcacgagtcccttgatcccgggcaccctgtcctctccttcatcctgtaaaactccactcaagagcttcttccaggccgggcgtggtggcgcacgcctgtaatcccagcacttttggaagcagaggcaggtaaatcacttgagctcaggagttcgagacctgcctggccaacatggtgaaaccccgtctctattaaaaatacaaaaattagccgggcagtggtggcacgtgcctgtagtcccagctacttgggaggttgaagcaggagaatcccttgaacttgggaggcagaggttgcagtgagccaagattgcgccactgcactccagcctgggccacagagagaccctgtctccaaaaaaaagaggtgcttccacaagtgtcagtgccacccaggctgagcgagtgacttgtcccttgctttctctgtcctggagtcgcctggagaatgatgcctgttcaccctacaccacaaggggctgcaggttactggatggtccctagtgcccaccatggaactagtgctcagtgacatcaccaagggctcactggataaggtcagagcttcagctaggggaaaacgcaatgaaagagcatcccaaggcccggactccagggatggccgtgaggtacggggagccagccacgccgtggctggaaaatgagacactgcagcgtggagaggagtattctgaagacagcagcctgggcactggtgtaagggccctggatctctactctcaggccccaccaccctcttgtccctcaatccagggcctgcacacaggaagccgccacgcgtgtgttgactggtgcaggatcctgctgcaggagagacagtaggcagcgtgactgtggtgtccaggcggccctcacctgctgtgtggctttgcggacccggtcgctcatggcctccatgttgccctgctcctcctccagctcctcctccagctgggcgatccgggcctccaggcggcgcttctcgtcctggagtgcgttcctgggggaagggcggccatggtgggggcctctaccctcccccgccttaaaagatgccccctccttggagtcatgcctcaggggtattgccctcatcatctaatgggtgaaactgaggcttggagaagattagaagactcatctgtagttacacagccaggaagtggacagccgggactcaggccgggtccgtgtcagcaaagctgggattgggatggggaccagcacactcctccctgactcttcctggcctccccttctccccacacagctacttattgggaatgaatgaaagcagccacacccccaaacaggcatgaaagcgctgacggaaaacctaaccaccatgggtctgtccccaatctcagaggacgcttcgtcagcagcagcattgaaatgggggtccagggccaggcacggtggctcacacctgtaatcacagcactttgggaggccaaggtaggaggatcacctaaggtcaggagttcaagactagcctggccaacatggtgaaaccccacctctactaaaaatataaaaattagccaggcatggtggtacacacctgtagtctcagctactcagaaggctgaggcaggagaattgcttgaacctgggaggtggaggttgcagtgagccaagattgtgccactgccctccagcctgggtgacagaatgaaactctgtctcgaaaaaatttaaaaaataaaatgggggtcgaggatgctgcctgtccccccatcctctgcttcagagccctcttcctccattcagtttcctaccttcccgacaggctactggccagctcctctgccagttcctccttctcgaggtccgcttgtttgcgagccctctcagcggcggcgaggtcctaggtgggagggaggaaggctgttgtctgccagggaaaggccaagccccaccaagagtccaccctgacaactcagccacccttgaaagtacatgttcttcctctgagctcaggggaggccccgtgaatacatagaggagggaagcgtgtgtctttctagacaggtggaccccagaggaggacgaaatgaaatctgggaatgcacagactggagctgccaaggggtgctaccgtgacacccgcatctgaggctctcctagcaaggcgaggctttacctcttgtagctgcatgaggtctgcttccaagctcttggctttcttctcattctctttggctgtggcaaagatctcatctctggaggcacgggcatcttccagctctctttgaaagtccttcatctgagcctgcatgagtcaacagggaggacaagctcagatgtccttactcccccaagttctgctgcccagttcagctttgcacacccaccccttggattttctgcagttgaccacaaagaagttcccattgcacgagcatggctctcagttccaggtggctggtggtgcgctgggagcaccattctgggtgggctccacagacctgcctgagaagctgagcccctgatgtgatctgagggcagtggccaaatacctaataatgctgccctacccagggcaggagacagccaccaaatcctgaatggttccagaaaaaccccagctgaacccacaccaatggcaggtgcaggcttgcttcctggagcccgctctgctgacttcggtggcctgaggggaactgtgccctccctccacccatgccccaagctcctagtgtcacccacctgcagtttgcgtagctgcttgatggcttcctccctccccttgatggcagagtcggcctgaagctccaggtctttcaggtccccttccagcttcttctttgctgcagctgccagggcacgttgctttcgctcgtcttccagttccgtctcatactcgtgaagctgggcgaggaatagagatgtgtgctgccccacttgcccctgggaggtcctttggctcacctaggcagcacatcactgcaccccttccccagcacagcccccttgtgaggtgggcatctcatccccagttgcagatgagaaaacggaatcacgccgggcgtgggtggctcatgtctgtaatcccagcactttgggaggccaacaggagaatggatcacttgaggccaggagttcaagaccagcctggccaacatggtgaaaccttgtctccactgaaaaaaaaaaaaaaattagctaggtatggtggcatgcgcctgtaatccaagctactcgggaggctgaggcaggaggtggaggttgcagtgagctgagattacgccactgcactccagcctgggcgacagagcgagactctgtttcaaaaaaaaataaagaaaacgaagtttccacaccaaccatgagagtggtgataggaatgaaaaaggccacccgacctccctctgctggcctccccggcagcacgcacctgtctctgcagttgcctcctcttctcctcattctgctcgtcccgggcttggagatccctttcgaactggcccttgagcgcctgcatgttgacttccagccgcagtttggcgtcctccgtggcttgcagctcgtcctccagctcttccagctgcgtcttcatctcctccatctgggtctccagggcccgcttggacttctccagctcatggacctgccggcagagcgggcagccccattctatgaggctcaacttcatgaagacgattgagaaacccaccgtgagcggcacctcaggagatcagggaggtggctttggcctcccacaggatgcatggccgggactcaagatgacccctgagagttcagaccccagccttatcctcggaccccccaactcagacccatcctcgactgccattctcagcccctcccagcccctgcaccagtccaaaaacctccttccatttccgatgatagttcgctatgaaaaaggccaggagctagcctcgcatggactggtgaatagcacagagggtgggcaggcgaaacatggacgagaaaaaccacccagagccacttacgttcttgcccacgtcatccttggagctgaccaggtcttccatttcggctttgagcattttgttggtccgctcgagttcctctttggcttccaaggcctcttcaagggcccgagccagggacagggccttggtttccttctccctggcttctgcctcagctctgtccctctcatccgcgtatttggaagagatgtttttctcctcggctaacaactacaacacaagacccagaggtgacttctaggcatatccggggtcagcgtcactgaattgtaaataccgggggaagccctgtgtcctgctgaatgtattgaggtgcaggtgtaagcagtgtaggttagctatgggagtaatttatataatcatctggcgttctgacttctacatcaaccttatgcagagccagaaatcagctgacttgtttttttttgttggtttgtgtgtttgtttgttttagatggagtctcactttgtcacccaggctggagtgcaatggtgcagtcttggttcactgcaacctccgcctcgtgggttcaagcgattctcctgcctcagcctccagagtagttgggattacaggtgcccaccaccacacctggctaatttttgtattttaagtagagatgtggttttgccatgttgaccaggctggtctcgaactcctgaccctcaagtgagcctcctgcctcggcctcccaaagcacggagattacaggtgtgagccaccacacctggccaaatccttgtgcttcgaaaccactagacctgcccacgttgcttagagcacactgaggtcaaagtgagatttaaagctgccagaagctagttattagtttgtttcatggccacaagtagctattaatatcttacaaaagtatcctaagagcctcagtagggaaatggtaagcatgggtggccctgcacacatatctctctgcttggagaagcaactcagagaacattccatgctcacgttaatctcatcttcagagagaacagagcagattataaattgtaacatccaaaagccaaacttccagtattcagcaaagacagggacctctaaatggcacagtcaacacaaaaatcccacactatgtgtgccactgcactacactctatgtgacaggaaaataaaagcaacctcaggccttcaaccagataacgaagcattgaagatgagctgacagcccagaggagaggtagctgatgggaagaggagaaactgggatgttatctagaatcctgacactaggaggtcagtcagggaggggtagggaacctgcaggcatctggcatttagcctcactgtacaatcctcattttatttatttttgagacagggttttcactccatcactcaggctggggtgtagtggcgcaatcttggctcactgcaacctccaccccaccctgggttcaagcgattctcctgcctcagcttccagagtagcagggattacaggcgtgcgccaccacgcccggctaattttggtatttttagtagagacaaagttgcacgatgttggccaggctggtctcaaacccctgacctcaagtgatccacctgcctcagcctcccaaagtgctaggattacaggcgtgagccaccgtgcctggcctctcaaactgatttttagaataaccctgagtcacttgtaaactaaatcatatttactaaataataatgtatcttaaaagttggtatttaggggtttgggtcatacaggggtctccatttatcgtacaattaagatttgtgaatctcatcacatgtaagttttaccccaaaagaagcaaaattgtgtttaaaaataaactctaattaatatgcaatgttgaggtgtggaaggggaaatgtactgacatctgtaatttgctctgaaatgtacccaagagataaggcatgatagatagaattagtctttataaataaatatgtgggccgggcatagtggctcatacctataatcccagcactttgggaggccaaggcaggcagatcatgtgaggccaggagttggagaccagcctggacaacatggcaaaaccccatctctactaaaaatacaaaaattagccagacatagtggtgtgctcctataatcccggctacatgaaaggctgaagcaggagaatcgcttgaacccagtggtggaggttgcggggagctgagatcacaccactgcactccagcctgggtgacagagctagatcctgtctcaaaataagtatctgataaagttcatataatacagtgtcaatgactgaatccaggtggtggccttaaaggtgttcaccgtacaattctgtcaactttgctgtgtacttggaattttacagaatgaaatcttagggaagagtggtattaaaagtatagaaactgaattacttggaatactactcaataggtattcagtaaatacatttagtgaataaataagcacctcattccttcttcaggctagaaactaaggcatcaccatgtgtgcaggtgaccctcatggtgctggtacccagaaaagtcacagtcatcaaggcttctttgccatccttactgtgacctggtagcgttaatgctccatggtcgcccaagacaagataagacagcctcccatggctccccacagagtggagaggggatgcaggcacaggccagagccacgcgtcatactctgcagagctgattccccaacccagcgtccatggccagagtgggggacaccccacgccctctacctgatcaaatttcctctgcttcttttccaggttggacacgagttgccgctggttgtccaaatcaacaaccaggtcgtccagctcctgctgaagcctgttcttggtcttttccagtttatcataagcggccgccttctcctcgtactgctgggtgaggttctcgatctccttctggaacctcttcttcccctcttccagagcttccacggtgctggcaaagtcctgcagcttcttcttcgagtcggagagctacaaggacagcgtccagggtagggtgagagggggaccatgagtggcccctgtccctggccccacagactctgagaagcgaagaccatgtctcctcgttggagaaacccaatagcaggggaagctggggggtcaagcaccatcgcaccaacactccaccgcgatctgcctgcgggggatctcagcgcagagaagttgagaggacccatgaaggaagcaaggacacggggcaggcacctggatgttgagagtggagatgtggcgctccaggttctgcttggcctccatctcctcgtccagctggtcttgcaggctgttccgctcctcctccagctggcgcagcttcgtagacacgttgagcttctgccgggtttcttcttgaagcagctcctgcaaaagggatgcaaagaggtcccagggacctgccccgaggaaggccaccccccaggtcccctggatgatgtggcaggacactcacctgggtgtcctggagctgggaactgagggacgccacgtccttggccagcttaatggccttcccctcggcctcgttaagcatccctgtgacgctctcaacttcattctaagggtgccaagagactggttagtcaaagcctctagaaggggatcctcgttgaaaggagccctttttactcaaaacacatgggctagtacttgaggtgttcactgattgagaaaatacccgtgaggtatgggactctgataaaaaaaaaaaaaaacacacacacacacaaaaaaaacagaatctgtggcttgaagggaactccgtcacctatgagttgggaccctggccctagactctgtggttctaagaacttatttgagccccaatggtattgactgggacctgatcccactaaatggatcctagatccctgccaaggttggtagagacaaagcagcaggtctgagagtccagacgaggtgctctggctggtccactctctaaggctggagaagggagaccaggatggtacttgaacgtcccagggatgctgtcccatcccttccttcctcactcctactctttgaccctgatggccaaagccagagacgcaggccctaaaggtaaaaacgtcctctctgtattctctggcttttactccctagtgtctctgcataagtccctttgaggctgttagcctacccctccatctcttccattgacaaggaggatatgaatgatcttgacactgcttatatgagggcggcaaaagccctgctctcaactgcatgtgagaaaaaaacatctcacttaattcttccctcgccccttggtccctggctgtggacatgttaaacatttgtgaaaactttggccacgtccccatgagtggcaaggcagggtaaatggctatgccaagtgaaagaagaccaaagacaaaaagaccatgtcattcagcagcttaaaacccctcaacagcttcacattgcccagagtaaggatcaacatacatgtaataggttctcaaaagccctacatcatctgggtacaagctccccctccaaccccactctgtactatctccccctacccccaaccccagctgggcactccagctctactggctgtatgtctctctcctaatttttctacttaccacagggcctttgcacacgctgttccctctgcctggtagacttatccatgctccttagggaagcctttcgtggctcctcctcccccaggttaggccccctggttatttacacttgggcatcatgtgccttccctttgctgcatcatttgacattcatttgtgtgattattcatgtctttcccttcccttcccttccccttactcggctggagtcctactggggcagcgacagtgtctcttcttccttgctgttggatctcaggattaagcacagtgcctggcatacagcaggtgctcaataaatacttatcaaattggaaaaggaagggttttttttctttttttttttttttcctgagacagagttttgcccttttagcccaggctggagtacaatggtgcggtctccgcacactgcaacctctgcctcctgggttcaagctattctcctgcctcagcctcccgagtagatgggactacaggtgcccacgaccacgcctggctaatttttgtatttttagtagagacttttcaccatgttggccagactggtctcaaacccctgacctcaggtgatccacccacctctgtctcccaaagtgctgggattacaggcatgagccaccgtgcctggccagaaggtttttttaatatttaattgaacagggagatcatcgcctctcctccaggaacgcaactagaggaaaggacttgccttgcagcaagagagacctcagcgagccgggaagaggctcctccccacagaactgggcaccacccagcactgcccaccacaccaccgcgccacctcctcacctgcagcttgtggactttgtcattgagctccgcccgggcccgctccccatcgctgcacttggactgcagctcctgcacctgcgcctccagcttcttcttcttatgttccacctcctgcttggcctggcccaggacccgcagctccccggccaggtctgcgttctctttctccagcgtctgcttattcttgtctaggttcgccttggcctggcgaaggaagcagaggggagggataacagggaggctgtggccgggagaacgtttcaggccctgccctttcctccctcagagaggtccaggaaggcacacaacagggggcacacaatcaccagtaagagatttggggtttttttgttgttattttttttttgagatggagtcttaactctgttacccaggctggagtgccgtggcacaatcttggctcactgcaacctccgcctcccaggttcaaactattctcctgcctcagctgcccaagtagctgggattacaggcgcccgccaccatgcccgactaatttttgtatttttagtagagacgaggtttcaccatgttagccaggctgctctcgaactcctgacctcaagtgatccacccatcttggcctccctaagtgctgggattacaggcgtgagctgccgcacccagctgatattttggattctattttcctaaagctcatgggttgcaatctggaatcccacaagcggtatccaacctgctgacatgtcccctttgaccctttcactacttttaaaaaaatgagttgccgacattttaataaatgtcacataaaaatctggattcccagcttctttttcaaaaaactttaatgtttgaaggcatgccatggcagctcatacttgtcatccccagcactttgggaagcaggcagaaggatcgcttaaggccaggagtacaagaccagcctgggcaatgtagtgagacccccatctctactaaaataaaacattagctgggtgtggggggcacacaccagcaatcccagctactcaggaggcggatggcaggcttgcttgagcccaggaattggaggctgcagtgagctatgatcacaccactgcactccagcctgggcaacaaagtgagaccctgtttcagaaataagtagctttgggaggccaaggcaggtggatcacttgaggtgaggagttcgagaccagcctggccaacatggcgaaactgcatctctactaaaaatggaaaaattagccgggcatggtggcgcacgcctgtagtcccagctactggggtggctaaggcacaagtattgcttgaacctgggaggtggaggttgcagtgaaccaagatcatgccactgcattccagcctgggtaacagagtgagactccatctcaatcaatcaatcaataactaacattctatgtggtgactgtggtggtggtagttacacaatacacatttgttaaaattaatggagcagtaaaatggataaattttactacatatgcctcagtaatcctaaacttaaaaacaaaaacaaaaaaccaacaacaacgaaagatctggaaacagagggtcttgctttccttcaaggcaacaatctgccacatctaagtagcggctggctctgcaggtggggcagtcacctttcaccgcccccgtccttcacaggtgtcgtgtgattgacactgctacttctgtcctagttaagggaaacttattttatggaaccagctcctgtaggcatgtgagttgccctacaggaaaaaaaaagtgtgttggggccaggcgcggtggctcaggcctagaatcccagcactttgggaggcctatgcaggcaggtcacttgaggtcaggagtttgagaccagcctggccaacatggtgaaaccccgtctctactaaaaatataaaaattagccgggcatggtggcagtcacctgtaatcccagctgctgaggaggctgaagcaggagaattgcctgaacccaggaggcgggggttgcagtgagccgagatcccgccagtgcactccagcctgggcgacagagtgagactttgtctcaaaaaaaaaagcgtgttgggcaaaagtaggacgcggtgaggggcttctttccaggttgtagagaaggggaaagagaagcgcaagtatcccgagaggacgagacccaccactcagtcttcccatagtccctgggaggtgctggacgttgaccggtcagccctggatgcccgtcctccctccaagacatgactaagagctgccagacctcagatggggacagggagtctcttggtggtaacaaagcagtgaagcggggaccctaggggacatgggctcccagaaaccttagcccagcctaagaccccagaactggggccaaaccgcacgagggcctggggagcccaggtaggagctgatgttaaacgtttcccccacaagcagatggaaccaggtctctacatcagaattcaagttgttagaggcaaaggcctctgtttccctgcacctgagatgggcagaggtttgcacctctacctgctttgtgcgggtcagtaatggacatgccgtctgctggtggtcttaataactgcgtcttcccaaagaggcctggctgggaatgggcttggcttctagctcctgttcacgtctaatgaaccccaagcatggggagggtcagtgattctgtctggggcctcactcttccaaccataattttttttttttttttttgaaactgagtctcactctgttgcccaggctggggtgcagtggcacaatcttggctcactgcaacctttacctcctgggttcaagtgattttcatgtctcagcctcccaagtagctgggattacaggcgaccgccaccacgtccagctaatttttgtatttttagtagagacggggttttgccatgttggccagactggtctcaaactcctgacctcaggtgatctgcctgcctcgggctcccaaagtgctgggattacaggcgtgagccactgcacccagcctaattttatgtatttttagtagagatggggtttcactatgttggtcaggctagtcttgaactcctgacttggtgatccgcctatctcagcctcccaaagtgctgggattataagcatgagccaccgcgcccggcctttgggggcagtttctaatggtttagcactatccctttggtgctgccctcatgagatctggttgtttaaaagtgtctggcagctccccattctctctcttctgcctgctctggtcatgtaaaacatgcctgcctccccgttgccttccaccatgatggtaagtttcctgaggcctccccagaagcagaagctgctatgctttctgtacagcctgcagaaccgtgagccaattaaacctctcttctttagaaattacccaatctcagggtggtgcagtggctcacacctgtcatctcagcactttgggaggccaaggcaggtggatcacctgaggtcaggagttcgagatcagcctggccaacatggcaaaaccccatctctactaaaaaaaaaaaaaaaaaaaaaaattagccgggcatggtggtgtgtgcctgtagtcccagctacttgggaggctgaggcaggagaatcatttgaacccaggaggtggaggttgcagtgagccaagatcacgccactgaactccagcctgagtgacagagtaagactccactgctcaaaaaataaacaaataatccaatcttgggtatttctgtagagcagtgcaacaacggaccaatacactagtgatagaaccaaatgcaaattccccaaaatttttaggcaatgctgcacccacttaatctagcagaaccaaaagcttccactgaaggggatgtggaggagctgcaacgctgagggtaatgtaactcaggctttcaggaaaacaatctggccgaaggtcgcaagctaaaaaacttaccctggggaatgaagcacaggcactaccccaaaggagagaagagcacccaagattcagcattcggtactgctatttaccagctcccactcccatacaccgcaaagagttccaacaacgggagagtgatttgacctagtcattctcaaattatgccggagagagctgttctgccattgaaatcaaataatgacaagtttcctccagtcttttttttttttacaaaagaaaaatcgctatgttgcccaggcgatctgaaagtcctgggctcaagcaatcctccctccttggcctcccaaagtgttaggattacgggaggcatgagccgccatgcctggccttcctccagtctgcagagaaattaaagtggatagaatgatcccagttttaagtttcatttaaatctccccgaaagtgttgttacacctttgcttatccctgaagggcagtatattgataggccccacccatcctataggccttcagtcctgtagaggccagaaagtggggtctaggaccagactgtttgggtgcaaatcatggctctgtcacttaccagcagtgtgaccttgggtaagtctcttcacctctaggcacctaggacctcagtttctttgcttgtaaaatgagtttaatagtacacgtctcacagggtggttgtgaagattaattgacatactgtatgagaagcatttctattcattcttttttttttttctttttttgagatggcggctcactctgtcgcccagactggagtgcagtagcacgatctgagctcactgcaacctcttcctcctgggtccaagtgattgtcctgcctcagcctcccgagtagctaagattacaggcacatgccaccacacccagctaattctttatatttttggtagagatggggtttcaccatgttggccaggctggtctcgaactcctgagctcaagtgatttgcccgccttgcctcccaaattgctgggattacagacatggtgagccaccgtgcccagcctatttttattgtttgattaaggtctcactgtgtcgtccaggctagagtgcagtggcatgacagggctcactgcagcctcaacctcccaggctcaaacgatcctcccacctcagcctcccaaatagctgggaccacaggaatgcactaccaggcctggccaatattttattttattttatttttttgagatggaatcctgctctgttgctcaggctggagtgcaatggcatgatctctgctcactgcaacctctgcctcctgggttcaagtgattctcctgcctcagcctcccgagtagctgggattacaggcatgcaccaccgcgcccggctaattttttgtatttgtagtagagatagggtttcgccatgttggccaggctggtctcgaactcctgacctcaggtgatccacccagtttggcctcccaaagtgctgggattacaggcttgagccaccacgcctggcctacttttttaaaattttagtagaaacaaggtctcactatgttgcccaggctggtctccaactcctgagctcaagcgatcctcccgcctcagcctccccaagtactgggattacaggcgtgagccacctcacccagcctgtatgggaagcattttgtaaataaatataagctgctatcatcatcattagaatcttatgtaacttgttttttgtctttatgcagaccctgacctgtagtaatttgaggctgctgatgtcactcttatgtgtcatcaccaaaaagcatcaccaaaaagcattaccctcttgaactgctcaagctgctctgtgagctcctccaccgcctgtgcgtgtttctgcctcatctcctggacctgagcctcatgggaccgcgtctcttcatccagggccttcttcagcaccgtcacctcctgctccctcttggcccttggtgggaggaacacagtgaatggcagttgggtggagacagagggtcatctcagtgccgtgcaaaagaatgagagctcttccaggacccagagctgcagtcctcatcaccacccctctctagctgtgtgaccttgggtcattcacctaacatctctggacctaaaatttcctcagctgcaaaatgtggagcatatcacctgcctaggacatctgtaatgactggcaaacaaatacacaaagtaatagaattgaaaggatgtctgtgaactgcaaaattttgcttaaatattaatgttggctcttatttaatgagcagttactatatgccaggccctgagctaagttttttatatacatcatctaatcctcagagcaacccaaagaggcaggtgtgttattatttccattttacaaatgaggaaactaaggctaagagagggtaagcagttttacccatggtgtcacagccattgtgtgatggagccagaattagaagctaaaccttgaccttgagtccatggttttgtttgtttgtttttgagatggagtttcactcctgttgcccaggctggagtgcgacagcgcaatcttggccccctgcaacctccacctcccgggttcaagcgattctcctgcctcggcctcctaagtagctgggattacaggtgcccaccaccacgcccggctaattttatatttttagtagagatggggtttcaacatgttggtcaggctggtttcgaactcctgacctcaggtgatccacccgcctcagcctcccaaagtgctgggattacaggtgtgagccaccgcactcagcctggttttttgttttgtttgtttgtttttcttatcgagtcttgctccgtcgtccagactggagtacagtggaatgatgtcagctcactgcaacctctgcctcccaggttcaagggattctcctgcctcagtctcccaagtagctgggattaccgacgcccaccaccacgcccggctaatttttgtctttttagtagagacaggttttcatgatgttggccaggctggtctcgaactcctgacctcaggtgatctgtctgcttcagcctcccaaagtgctgggattacaggcatgagccaccatacctggcccatgcactgggctcttctgtatcaaaggccaagcggcaagggagcagaacgctgtgctctatgtgcatgtgacactgcacaaaacccaaagtgggggaagtaaaccccagggtatatggtgttggcacagctagcatagctatatgctatgatacatgctatgccaacaccacagattgcatcaaaatacatttatgtgtttactgaatgaatcaatgacctagtttcactagagtcaggattcgtgatctggcaggcagtttgttattgtttgttcatttgaagtgaatcttcaattgaaaaccaatctgatcaattttatttttaaaatttaacacaaaagtgatacacacacatacttgggaattggagcttggggactgactgatacacacacagacaggaaggaatttctcaagaatgttaactggtgtgactaagggtgatttttttgttttttgtttttttttgagatggagtctcactcactgtgtcacccaggctggagtgcgatggtgcgatctcagctcactgcaacctctgcctcccagattcaagtgactctactgcctcagcctcctgagtagctgggatttacaggcatgcgccaccacgcccaggtaatttttggatttatagtagagacagggtttcaccatgttggccaggctggtcttgaactcctgacctcaagtgatccacctgtctttggcctcccaaagtgctgagattataggcgtgagcccgaccctaaaggtgatttttttttatgtctgcttttctatagttttcaaattgttctctgagtatatccaagcttaccaatgaggatggttttgaatgcagcctgacacagagtcataaactttcttaaaacagtatgagatgttttttccaatttgtaaaatttttttagttgatcagctattattagtgttagtgtatcttatgtgtggcccaagacaaatctttttcttccaatgtggccaagggaagccaaaagattgtacatccctggtatatactactcttctgatgagaaataagatgatgagggtcgggtgcagtggctcacacatgtaataccagcagtttgggaggcggaagtgggtggatcacttgaggccaggagttcaagtccagcctgggcaacatggcaaaactccatctctactaaaaacaaaaaattagccgggtgtggtggcacatacctgtaatcccagctactcaggaggctgaggcatgagaatcgcttaaatctcagaggtggaggttgcagtgagccaagatggcacaactgcactccagcctaggcaacaaagccagactgcctcaaaaaaaaaaaaaaaagaaagaaaaaaaagaaacagccaaccatgcttctataagttaaagcaaaccgcggccaggaaggtaaatgcacaggggctgatgcacgatttgctttgggtttgtcccctcttctgcccccatcccattggtgcagtgggatagcaggatggtgggattgatgggcccctcacctgagctcctgctgagtggctgtgctgtccagtgtgtcttccagctctgtctttagggcctccagctcctcgccgaggtctcgcttctgcttttcagccttgttcctggcggcccgctctgagtccaggtcctcctggaggtctgagatgtggccctccagctcccggatcttcttcagggcattgttcttctgagcgatttcatcgtcaagccttccagggagagacccagcagaatgaacccccaggtcccttggtttcctctcttacaatgtggccaaaaacttttctgggaccagacagttatgttgcagagacatcaaacaccttctatccatgtccccaggtctgcttcttgacatgccagactatatgagattaacataggatgtgagtgccaaggtctgacatcaaaacaggttgtacatgtgcatgggtgtgtgtacgtgtgtatgcacgtgtgtgcatgtgtgtgcaagaatgcaaagcattgaccccagactggcaaggtacctggtcacagtagggactgtgtagatgctttctgaatgttggacagttcttcttccctggcaactgtctgttctttctgcatttgctcagtgactgagtacccgccccatgcacagcatttggccagccactgcttgcgggggatattcagactggggctctgcatctggtggaggtggtgaccagagatcaaggtgggctgcaagaagccctgttaaatggcagaatgctgcaggagaggcaagcactttgattttactgtacttgtgaaagggcagcaacaagagagaaagtgaaatagttgggttggggtgagactgcagagggtggatgggctctgagggtgaggctaaggaaactggattttccctagtaagccagtgaagttaggtttttgttttgttgttattattgttttgagacagggtcttgctctgttgcccaggctggagtgcagtggcatgatcatagctcactttagcctcaacctcctgggctcaagtgatcctcccatctcagcctcctgagtagctgggactacaggcacacaccaccatgcctggctcattttttaactttttgtagggacagggtcttgctatgttgcccatgttggtctcaaactgctggcctcaagcaatccccccacctcggcttcccaaagtgctgagattacaggcgtgagccactgcatccagccagcaaagttttgtgagcaggttcctgccccagagagatgctttcccttcatcaccgtagcactgtcaacatagcacaaattggccgacaaaagagccaggccaggggatcaatcagaaagctttgaggcttaaatcccagctctgcctcttagaagcaatgacattgctcctgttgcgttacccctaggaggctcagcttcctcctcaaagacaccggcagtacacctggccaggtgtctgcaaaggtattgcttgaaaagaacttagcaccgagtgagcaggtaaataatcattcatagtggctgctgcagtattagcattagtgtaaatccagctaagagccaggaagagggaaaaaccagaggaaatgggtgggggacatttagaaggactggcagaatctgaaggttgctgcttgctgtgggtcggcagaaacaaaggaggagattggtgttcacaaaaaagagggcccttagagggaggggctggggaaaggaaggtcattcccgccttagacaggggtgtttgagatgacggtggaaattgactcattgggcaatcggaaattcagaagggggtctagatgagaaaagcctggatgtcgaagaggcagcagcaacaccatgggagtaggtgagatcaactgcaaagacatgatgtgtttgcagggaagagaagaaagtcgaaggtgaggatctgggggagtgaacagggtcgagaaggcttgtgggaggcctggcctgggaaacgaagttcatgccaagggcctggggccgccttgaccaagacagccactgcgaatgagcgaatgagcaggggcccaggggatacatggacacacagcaaatgccccttgccagccccgctacctggccagggccgcctgcagctcctcctccttcttggccagctgcatcttgagctctgcgatctgcgcctggaggtcagcgatctgctcgtggaagtcgctggcatcaccctccagcttccgtttcagcttctccagctcctgtcggctcttctcttccttctttagccgcactgcaaaaaccaaggtgctcttcaggaaggggaggccccagagagatgcccggaaatgagccttcctgcccaggcattttacccggaggagatgaacacatcccccaatcagtaaccatcatagtcacggtctggaccattatctcccgatgaacagcaccttatattgtcataatattattattagttgagatggagttttgctcttgttgcccaggctggagtgcagtggcgcaatctcagctcactgcaacctccgcctcccgggttcaagcaattctcctgcctcagcctcccgagtagctgggattacaggcgcccgccaccacgcctggctaatttttgtattttgagacagggtttcaccatgttggccaggctggtctccaactcttgacctcgtgatccgcccacctcggcctcccaaagtgctgggattacaggcgagagccaccgcacccagcccttttatcatattattagtgcatgtgatgactaagggtgatttcgagaggtggcatagagttagttgtcactcatgggatgatctgccatcctcaaatttcctttctgattttcctgcttttaaaaatacccattcaagcccaggaatagtggctcatgcctataatcccagcactttgggaggccaaggtgggaggactgcttgggcccaggagtttgagactagactgagcatcatagtgaaaccccatctctacaaaataaaaaataaaaaaaaattagctgggtgtggtgatgcacgcctgtagtctcagctgctcaggaggctgaggcaggaggatcactggagcttaggagtttcgggctgcagtgagccatgatcgcaccactgcactgcagcctgggcaacagagcaagacctcatctctaaaaaaaataataaaataaaataaaaataaatctcttggtagctggtttaccttccagttctgaaatcatagattcatgcttgtttttcagcttggtaagattcttggccttttcttcctcttctgcaagatttgtcgttaagtcactaatcctctcctcaaggagttttcgttcctttttggggaaagagaaagagatagctttaggatttttcttttctctagaatctatgtttcacttttagtgatttccatgtaaacagttgaaagaaaaacccacattataacaaaatacaactagagttttaaatggtaaagagaagtcccataacaatttccaaaaactggccatttctcatctcgtgccagtttgtccctcatattgtatggtcagctaaaggtaccctccttccattcctgccactggccagctcttccctgccccagggcctttgcacagtgggccaaccagctgagatgctcttctactcccctctaactgctccttcatctttaagtttctgcttaaatgtcacctcctccaggaagtcttctatgaatacccttcctctatcccccactgctgtattctttttttttttttgagacagagtctcactctgtcgcccagggtggagtgcagtgttgctatctcagctcactgcaacctctgcctcccacgttcaagtgattctcctgcctcagcctcccgagtagctgggactacaggcgcccgccaacacacccaactaattttttgtatttttagtagagatggggttttaccgtgttggccaggctggtctccaactcctgacctcaggtaatccacttgcctcagcctcccaaagtgctgggattgcaggcatgagccaccgcacccggcctgccgcactcttaaaatatggtgaacgtttccttcagagccctgatcaccatggtaaatgacgattatttgccatctcactacagtataaaccccacaagggaagggtcctccttcaccatgcatacctgcatctaacacagagcctggctcacagtaggggccaagctgacatccagctcaaagaactaaaagcaggtggggctggttagtgactactgactacggtgaccagcttgtcctggttttctaagggcttttctgctttgagaactgaaagtcccaaatccccaaaatctccctgatcctggtaagcctgttgtttttaatgcagaaacttgattccacttttttttttttttgaaacagagtcactctgtcacccaggctgcagtgcagtggcacgatctcagctcactgcaacctctacctcccaggttcaagtgattctcctgcctcagcctcccaagtggctgggattacagacactggccaccacacctggctaatctttgtatttttagtagagatggagttttaccctgttggccaggctagtctcaaactcctggcctcaagtgatccacataccttggcctcccaaagtgctcggattataggcgtgagccactgcacccggcccctactcacttttgatagtttattgttctgatcatccatgaccaggatctcatcctccagtttcttgatcttggcctcagccgtgaccttctcaagttgcagcttctgcctggcagcttcctcctcctccagctgttcttcaaggtcctttgttgtggagggaaaagagtaacagctttggttataacagatttactctcgtggtgatctggggactaatgaatacaggggctaggcctgaagatgcccagaactctgtagcctcctaaaaggaagaaataaaggcctgagcgtggtggctcacacctgtaatcccagcacttttggaggccgaggtgggtggatcacttgaggtcaggaattcaagaccagcctggccaacatggtgaaaccccgtctctactaaaaatacaaaaaaaattagccaggcatggtggtgggctcctgtaatcccagctactcgggaggctgaggcaggagaatcgcttgaacccgagaggcagaggttgcagtgagctgagatcgcaccatcgcaccccagcctaggcaagagagtgagactctgtctcaaaaaaaaaaaaaaaataaagacctgggtaagctgctctgcttcatggaacctcaacctcctcatctataaaatgagcacagtaggtaccatggtggttttaaaatctatccacaagttctttgcgactccaaaaaggtggagcctaattctcctccccttgagtgggggttagatttgcttctaacaacaacaacaaaaatcaggaagaagtgatggaatgtaacttcagagattaggctataaaaggcattgcggcttcctttctcctctctcagatcactccttctgggggaactctgctgccatattggaaggacactcaagcagccctgaggggagaggccttcatgataaggaactgaggcctcctccaacagctgtgtgaataagccaagtagaagtgggtcctccagccccagatgagccttcagatgactgcagcctcagccaacaccttgactgcaacctcaggccggaccctcagccagaaccactcacctaagccactctcaaattcctgactatgcaatactttttatttttagctgctgagtttggcatgttttgttatgtagcaatagctaacaaatacaattatcctccattcaggcttgctgttaggagaaaaggggttagcacatgcaaggcagggcaatagaacagagtgggctcactgtgttccagtcccaatcccagctgtgtggccttgatcagatgaccaaccctctccaagcccccgtctcatcatctgtcccagcagggacacatatccctggatgcacctccacaggcctgtggtgagggtcaagtgatttgctacccaccacgggctgcccctgtgacaccttaccagcatctgctgggccatcttcttcctttcagcctgtagctgctggcccctgtcttcctcctcctccaggcgggcctccatctcatgcagtatctcctccagctcctgcttcttggccgccagccgcacccgcatctcctcagcctctgcatacagctctgtctctgcctgcagctgttcctgtagcaggttcttctcctcggtcagctgcacgcaggtggtggggaggaggcgggtgagccccacggggccaagtcctgttccccagcaaccccagccatgcatccatacaggtacctgcgagtgcttctgttccagctccttaagctcattctctgccttctgctgccgctccttggtcttctgcagttcatcctccttggcctgcatctcctcctcctgccgtgtcacctgcagcagtggcttcacctgcacacacacggttagcccatcatttgtttttgtggcaaagggatatgttgtcataataaattcgatcagtggttccgagccagggacaatgttgcccccaccgatccccactaggggatattgtctggagacactgctgattgtcacagctggggtggggggtgcctctggcatccagtgggtagaggccagggatactgctaaacaccctacagtgcacaggacagcccccacaacagaattagtcaccccaaaatatcaacagtggcaagactgaggagctctaaatcagagcaccagaaaaggtacaaagtgaaaggaaaaagtctcatcttccccactttagaaccatcccaacagagaactactgctgaaaagtgatatttccttccaaggacaaaagggagaaaaaaaatctttcatatcccacccacctccctatcaaagtcattattaacattgtttacatttccttcctggctctttttctatgtttaaaaaatagacttaagaccatgctgcctagttgtagaggctgcttttattatttaaaattatatgatacagacaggaacagtgatgcatgcctgtaatcccagcattttgggaggccgaggcaagcgcttgagcccaggagtttgggaccagcctgggcaacatcatgagaccccatctctacaaaaacaagtaaccaggcatggtggtgtgtgcctgtagtcccagctagtgaggggtctgaggcaggaagatcgcttgaaccctgcaggctgaggctgcagtgagccacgattgtgccactgcactccagcctgggtgacacagtgagaccctgtctccacaaataaaatttttttaaaaattataagatatgtattaccccatgctgttacatcattcttacaactttacatagccatcttttaagttaatttatttatttagcgatggtcttgttttgtcacccaggctggagtgcagtgacacaatcatagctcactgcagccttgaactcctggcctcaagcgatcctcccaccccagctccagagtagctgggactacaggcacatgccacagtgtccaactagacagctaggtagaagtcttttttttttttttttttagcagacctattcagtagccaaagccatcattttaatagctgaaaacattccattgatagatgaaccattattgaactcatcattcagctaggactggacactgaaattctgctattgtaaataaggccataatgaatgcccttaactcttgattttcttttctctttttcaggtggagtctcgccctgtcacccaggctggagtgcagtggcacgatctcagctcactgaaacctctgcctcctcggttcaagtgattctcctgcctcaatctcctgagtagctgggattacaggtgcccaccaccacacctggctaatttttgtattttcagtagagatagggtttcgccatgttggccaggctggtttcgaactcgtgaacccaggtgatcctcctgccttggccacccaaagtgctgggattacaggcatgagccaccacacctggctaagacgattttcttaggatagtttttcagaagttggttcagtggggacgaacatttccaaaaagcagcatctgctgtccttccctgggctgcctcctaactctttgttttcaagcccctgcctggcacaaggaagcccctgctatgtactccagcagcttgcttcatgcacttatcacagtttgccattatgtatctgtctctgtgattatctgtttattgtttactccccaccaattcggctagaatattcatggaggtcagggaccatggtgtgtgttcacagctgcacccccagcacctagcatgtgcctgggatacagcaggcactcaatgtctgtttgcttggtgaaaaagccttgcaccagtggatacactcaagggcatataaggagaagcctagtctattgcaacagagcatgtctttgtgccatggggacaatgcaaccagtgccactacaggaaccagttgagtcctctggaggccctgactctgccagaaataaaaaataatatgctatggccagatgaggtggctcatgcctgtaatcccagcactttgggagcctgaagcaggagggttgcttgaggtcaggagttcaagaccagcctgggtaacagagtgagactccatttcaaaaaatgcaaaaagtaaaaaaaaaaaaacctgcagtattgatacatgcaacagtctggatgctctctaattccatgtatagaatatttgttttatttttttttgagacggagtctcgctctgtcaccaggctggagtgcagtacagtggcgcgatctcagctctctgcaacctctgcctcccaggttcaagtgattctcttgcctcagcctcctgagtagctgtgactacaggcgtttgccaccacgcccagctaatttttgtacatttagtagagacagggtttcaccatcttggccaggatggtcttgatttcttgactttgtgatccacccgcctcggcctcccaaagtgctgggattacagccgtgagccaccgtgcctggccttttttttaaataaaaaaaaaaagaaagaagagacagagtctcaatctttcacccaggctggagtgcaggcatgatcttggctcactgcaacctctgtctcctgagttcaagagattctcctgccttagcctcctgagtatctgggattacaggtgcctgccaccatacccagctaatttttgtattttaagtagagacagggttttgccatgttggccaggctggttttgaactcctgaccgcaagtgatccgcctgcctcggcctcccaaagtgctgggattacaggcgtgagccgccgcccccggcagcattcttgaaccatcaaaattacagaactggagaacagagtggtttccatggctacggaggaagtgggtgtggctataaatgggccacacgagggattccagtgcggatggaaatattaatactttgtgttaaggtcctggctatagcctatgtgccaaaggacagggcctcctcgggccagagaaccgccaatgctcaaggtctgagttcgagccctccattccacacccacttgcgaccacctcctgtcccaaatgtgaaggctccagagtgaagaagcagggctgggggcccctgggaagggggctggggcagagcactcactttggtgaaaagcctccaccactgccagttccgcagcttgaggtaggcggcgcagttcctctgaatcaccttcatggcggtcagctgctgctgcctcttggcaaaagccctagggaggggggaagagaaggtgcgggggtcatgaagccacaccctgctgtcaacagagccctgccctgcagcatcctgaacctgcacagggacatgccccaatctccccaactcaggttcttccagaaaccctgtgtgacacatgtgttgtctggctgcaaacaacttaaatcatctacaggacagagcctttttcagtggacaaggaagacccagggctcacaacatgccctggacttagctgagatccaaacaccactcagaaaacacaactatgtgcatcattcctaagggggctcccgtactccccagctgcactagctgtttcttttttctttctttcttttttttttttttttttttttgagatagagtttcgctcttgttgcccaggctggagtgcggtggcacgatctcagctcactgcaaactccacctccggggttcaagtgattctcctgcttcagcctcctgagtagcttggattacaggtgcccacaaccatgcctggctaatttttgtatttttagtagagatggggtttcccatgttggccaggtgggtctcaaactcctgacctcaggtgatccacccaccttggcctcccaaagtgctgggattacaggtaggagccaccatgcccagcctacaccagctgtttctgactaacttatttatttatttgtttattttcagagacagggtctggctctgcggcccaggctggagtgcagtggtgtgatgatggctcactgcagcctcaaattcctgggcttaaatgatcctcctgcctcagcctcccaagtagttgggactacgggcacatgctaccatgcccagctaatttttaaagttttttttttttggtagagataggggtctcgccatgttgcccaggctggtctcaaactcctgggctcaagcaatcctcctgcctcggcctcccaaagtgcctgggattacaggtgtcagctaccacacccagccctgtcaaacctattctctcctgggttgttttaggaatttcacactgtgaccctgaaccagcactcttcccgtttaagggctatcgatagattgagaaacgatagaacagtgaacgtaattctgtcttccctgcttggctgccatcttggacacaggaaaactttaagaataaaattgccccagttatccaggaaggacagcaacagggaacttagtaacgaaacttgacaagttaggtctgttgcgggagggccaagagctcccaaagctggccttgaccatcttgggtccatgtgtcaatgaatgaacctgacacatcagggtcctactggtgagggtgtggtctctgcccaatgacaacacacaccccagacagagagcgaccccacctgtccctgcagtccctggggtatgactttcattaaggaacccgaacccttccccggctcccagtcttcacagaacagctgggacatcacaccctccaaaaccctgccttataaatcccactgggacacggggatctagacaccgtcaagtcctctttcctcaatggtttatccaattctaacatgtctaggctgggcgcagtgggtcatgcctataatcccagcactttgggaggccaaggcaggtggatcacttgagaccaggaatttgagaccagcctggccaacatggtgaaactttgtctctactaaaaatacaaaaattaggccagtgtggtggtgggcgcctctaattccagccactcgggaggctcagacacgagaattgcttgagtccaagaggcagaggttgcagtgagttgagactgcgccactgcactccagcctgggcgacagagagagagagagagactctgtctcaaaaaggaagaagaaaggaaggaaggaagggagggagggaaggaaggagtgagggagggaggtaaaaacaacaacaatcatttctgacctgagaaccacgcactgttctaagctctcgtcatgcgttatcttagtgacacctcatgaacagctctctgaggtcaaaatgattatgctcagtttccagctaaaaaactggaagctcagagaggtagagtaacttgcccaaggttcatcagcaaaaactggggcatccacgatgagaacccaggtctaaaactcgttcccttcctgcactcgtaacttggtacatttatttaaagtagaagcatttcttccccttcaagaaaaggctgtcattcagtcaatgatgcatcttaaacaggtggcctcttagaatcagggaatcagaacagaaaggcccctgtttgtgattcgcgtttgaggtattaggatgcaggaaagcatctttactttctggccaagtagccacgacacatcgcctggaaggccatgatgacatcggtgatcttcaaatctcgctcctcctctaggtgggccaggacgccagttcggaagaagattttgctctgccctatcctgtataagttggggtcaagttccagggctttgatctgcaaaaggaaggaaaggaagagctcctgatttccactgtgccatttggccagtgatgacatgggtaagaacggtcccaccaagagcagcaggtggcttgcggccagaggttgggaggtctctggtggacttctgggctcaccatgagaatgcaggcctgcttcccgtccatgaagcctttggggatggcattcgccgccaggatctcgtagcttgaaacacagagcagaagtcaccccgggtacctccagcatccattcctccacccagtcccgctcaccccctgccctacctgggccagaccttgggacttaccgttggcggaactcctggaagacgatccggttggggaagccctgccggcagatgcgaatgccttccagcaccccattgcaccgcagctgctccagcaccaggaacgcatccagcttgccggactgcaaaggtcaaagagggcagtggatccctggggccagaaaccatggcgcagcaaagccccaaacctcctacctggatgacccacctggccaggccatgagggtaccaacagaagcacccaaggagggcttagctgagggccgaggggcaaagcagtgcccccctctgggttttcatctctttgcttcggcaatggctgcctcatgatctctctggttcttggtgacactagcatcgcctggctggaacctggggcttcctcctcatcacctcgtctccctcacttcctgtccatcagcagtttgattgcttctagctcccaaatatctcccaacccccccacttctcttcaccaccattgtctccactatcttctcctgcctggacaaccacagaaaccacccacctggtctctctctctggtcttgcctctcccctcaatccctttgtcctttttattttttgagatagggtcccattctgtcagccaggctggagtccagtggtgcgatcatggctcactgcagcctcaaactcctgggctcaagtgatcctcccaaatcagcctcccaagtatttgggaccacaggtatgtgctaccatgcctggaaaatttttaaaaatgtttttgtagatatagggtcttgctatgttgcccaggctagccttgaacacctggtctcaagtgatcctcccacctcaacctcccaaagtgttgggattataggcatgagctagcatatgcccagccccctcattcacttcctaaaatgtaaatctgaccatgatatagccctgctttaacacccccaatggcatgcctagagagagaaggccaagctccagaaagaacacaaggagcaccacgatctagcccctgcctacccattcagcctcaatcctacctcacaccatctgattcctacctcatgccatcacacatttgcaacatgaaatgacctatttagcattttctttccttttttttttttttttttaagatggagtctcgctctgctgcccaggctggaatgctgtggtgcaatctcagctcactgcaacctccgcctcctgggttcaacagatttttgtttctcagcctcctgagtagctgggattacaggcgtgagcaacacgcctggacactatctagcattttcttacctagttccttcacttctcacctccacactcttgcttagcctgggccctctgcttatcctaggccccctgcttatcctaggccccaccctgccttccatgtcaccaagttgatggccacacattcttaacgttcaagttcaccagaagctttctctgagtcctgaggctgtgggaggagccctggctctttggtgttctcctaactgaccacattccatcaccatcatcagctgtatgtttacctctccccgtgtctcccataacctcagcactactggcatcttgtagggattctgtgctgggggttgagggaccatcctgtgcattgtacaatgcttagggcatccctggcccctacccactagatgctgactaacagccccctcctggttgtgacaaccaaaaatgtctgtagcatgtccatatagaggacacaatcgccccaagctgaagatgcctgcaccagattatgagaaacccacagggaagggctacaatttttctaacactgctccccagcacccaggacagggcagagcccagtgaatacttcctgggataatgaatgaatgagtggctggatgacctgcacagcaactccacaactgaaaagtctctggatgcatcctcccttcctccttttcctccagggatggggaatgggtctgagattcagatagccttccccacatggaaaatggggtcctcggggtaggtgggggcagagggcgccctggggacgctgtgaccgcttgggacagccctggcttctgggagccccagggtctgggcggcgggcctcaccctcttctcgtggttggggatgatgcagcgcacgaagttgggcgtggtgttgcgtagcgtggtcatcagcttgcccagctgctccttgtacagctgccccactgtgcggaacatgcccttcttggtcttggaggcgctgggcagcgagctctccgtcatcttggccatctggtccaggcccacgatgcggtccactatggggcacagccagggtggcatcagcctctggcccacccacccctaaataggccagaggctcagccccagccccacccaccaacctgcccactccaatctttccttccatcaccaacgcctccttcggcagtcagggtttccaagtattgtctattggggaaatcctgagagcacctgagtggcagaaagaacaaattccctgtgatggagtcacgctgacctaggagtcaagcctgctctcgctgtccactcactgactagccttggcttggcactatcctgtgcctcagtctccctttctacaaaagggaggtaataataccgtctaccttctagggcaggggtaaaaaaaaataaggcacagaaggcacttattccctgccagcctccaatctttcatccaccaacaaatagttattgaggaccttctgtgctccaggccctggggacactgctgtgaacaaaaaaagacccggccccctcaccccgcttatatcacagggaaggagacagacagagatcacagatgttaagtatggaatatcttgagtagtgaggtgtgcgtagaaaaataaaaatagggtaaagcggagagagagtgaagagggtgctctcttagacaaggaggtggtgggctctgctaagttgatatttgagcagaaaccagcaagaaatgagtgggtaaccatgtaggtatccacggaagaaatattctgaggcagaagatacagcacacactccgagatagcctggcacatcagtaagtgctcaacaaaaagtaggtattattattattattattattattattattattattattatcattattttattttattgagacggagtttcactcttgttggccaggctggagtgcaatggcgtgatctcggctcaccacaacgtccgcctcccgggttccagcaattctcccgcctcagcctcccagtagctgggattacaggcatgcgccaccacgcccggctcattttttttatatttttagtagagacagagtttctccatgttggtcaggctggtctcgaactcctgacctcaggtgattcccctgccttggcctcccaatgtgctgggattacaggcgtgagctaccgcgcccggccatcatcatcatcatcatcatcatcatcatcatcacctccaaggttctttttctaccagcccagcaggtcctgcacatgccaagcccaacccacaggccatggatggcaccatttcttcaccttctactcagattctgtgtaacaatcttttttttttttttttttttttgagacaagctctcactctgtcgcccagctggagagcagtggcacgatcttggctcactgcaaccttcaccacccaggttcaggtgattctcctgccttagcctcctgagtagctgggattacaggcacccaccagcacacccggctaattttgtttttattttttatttttagttttattttttcaagacagagtcttgctcttttgcccaggctggagtccaatggcacaatctcagctcactgcaacctgcgcctcccaggttcaagcagttctcctgcctcagcctcccgagtagctgggattaccaccaccacgcccagttagtttttgtatttttagtagagatggggtttcgccacgttggccagactggtctcgaactcttgacctcaactgatcctcctgcctcagcctcccaaagtgctgagattacaggtgtgagccaccatgcgcagcctcatgcttgtctctctgcttgtctttgagagtctcatctctcccacaagactgtgggtcccgcagaggagggactacaggcttcatcatgtgtcctgggatgacacagacccagggtgcgatgttgttccctaggcccagagcctggcatatggttagggcacagctggcccctcctggagccctttttttagcatgcttaaaacaaggggagaccagtcctgtaagccccaggcccatgggccctgtgccaagaataaaacctgctgtggacactgatggccagggacaaacagcaaaccccctcccctcatcatcactccagcagctcttcacagggatcatctattcactggttctcaaagggagccggagtgtggtccctagaccagcagcatcacctgggatgaatgttttcaggcccgccccatccctggccccagacctgcagaattagatcttagggtaggcccagccatctgggttttaaaaagccctccaaagagggccaggtgcagtggctcacacctgtaatcccagcactttttgaggctgaggtgggcggatcacctgaggtcaggagtttgagaccagcctggccaacatgggggaaccccgtctctactaaaaatacaaaaattagccaggtatggtggtgtgtgcctgtaatgctagctacttgggaggctgaggcaggaaaatcactggaacccagaaggtggaggctgcagtgagccaagattgcaccaccgccctccagcctgggtgacaaagcaagactctgtccctaaataaataaacaaagccttccagggggtcatgatgcctgcttgagtttgagcatcactggtctaatttaaccctcataatacctctagtagagacggcaactattattgcatctcctgttttactaatgaggacaatgaagcttaatgacatcaagtgactcatccaagaccacagagctaggaggtggcagagacaagatacagtgaagtccttctgactctggacagggcagtctaactccccgtgcctggcatgctgtttctcctctattgcctgagccctgacctcaggacctcaatcccctcgggacatgtaggattgaggggctcagggacccccactcaggaagaaattgtttcaacgagacatcaccagcccatgccaatgctcttccttcccctgcccccatgtaaaggcctcccctcctggggcaggtgtgagagtcgggggacttgggtgttcaattctccagctcaaagcagaacatggacccgagcagagaaggccttaccgtccttccacaggtcggccacaaacttgtcggaggaggcattgagcagggaagtcacgttgtcattcagcgggtccatattcttggtcagccaggcactcgcattatagtccacctgccaaggacaccctgctggtcagaacccctgggaaactagaaacttagaaaccaaggccaggaccccagccctcccattgtccttccagatcttctgaggtcagagaggaaatgacgtttatgaccaccatgatgggactccacaaacaccagtgaagagaccaacagcccagggacctgtgcccacgtagtaggacatcagccagtgatagccattgctgggaaagcctagtttccattccatattctcctactaacgctgctgtggtagcctccctcctcctaagccagcacagtacctgtgagttatacactattaagagatttcatgacggcagatgccctcctgccgacatgcaaaactcccccctcatcatcttcccaatcatcctggtttagaaattaagcatggcagccaagcgtggtggttcacactggtaatcccagcactgtggaaggccaaggtgggtggatcatttgaggtcaggcgttcaagaccaacctgaccaacatggtgaaaccccatgtctactaaaaatacaaaaaaaaaaaaaaaattagccaggcatggtggtgcacacctgtaatgccagctactcgggaggctgaggcaggagaatcgcttcagcctgggaggcggagattgcagtgagctgagattgcgccactgaactccagcctgggtgacagagtgagactctgtctcaaaataattaaataaataaattaattaagcatggcatcctattttccactctctaatgagcataatttgtaactcagagatcctgatatatggatatacagaaaaaggacatataggctttttacattcctgactcaaacaatgacaatgcccaaagccgtaatttttactatggtgaatattaaatgaaaggaactgataatacagctttgctgggttatcatgggatgtgggttatcaggataataggtaggcttgatctgagagaagactgaaaataataataaaaaaaatccactgatgaagtagggaaaagaaaagtgttgtctctatatgcttaaaggaacatatacccccttgaatataggctaggagttgggaaacttttggtgaaggcccagatagtagatatttttggcttggcaagtcatacaatgttttgtttgtttgtttgttttggtttttgagacagagtggttctctgttgcccagtctggagtgcagtggtgcagtctcagctcactgcaacctccaacttcctgggtcaagcagttctcttgcctcagcctcctgagtagctgaggttacagttgtgtgcctgtaatctcacagctggctaatttttaaattttttttattttttatttttagcagagacgggctttcgccatgttggccaggctggtctcaaactgctgacctcaagtaatccacctgccttggtgctggggttacaggcgtgagccaccacacccagccaagtcatacagtctttgtcgcagctactcaactctagcactgtagtatacaaaagcagccagccatagacattatgcatacaaatgggcatggctgtgttccaataaaactttatttacaataacaagctgtgggccagatcggactctgttgccaggccctggtagagagcattgtttgtgcccatgatgcagtggaggtactgaggagtcaatagaatactacaattctgcaagccagactaagctatgtcctttgtacattatccaggactcttgagagccacagggcaagggcctatacaataacagccaaggcatgttgatgatgatgatgatgatgatgaatacaactatcatagatttccctggccagagcaggctggcaatagcaaactcaagaccgtgacatgggagatttttgttgaagccaggtgtggatgtattagtcaccccattccagttggccccgcctgttgggtataacttgtagcaggaaggatttagagtctatacaagaaaagcaggctgaggccaggtacagtggctcgtgctcataatcccagcacttcaggaagccgaggcagggagatctcttgagcccaggaattcaagaccagcctgggcaacacagcaagaccccatatctatacataatttaaaaatttagctgggcggccaggcacggtggctcatgcctgtaatcctagcaccttgggaggccgaggcgggtggatcacctgaggtcaggagtttgagaccagcctggccaacatggcgaaacccttctctactaaaaatacaaaaattagctgggtgtggtggcaggtgcctgtaatcccagctatttgggaggctgaggcaggagaatctcttgaacccggagggagaggttgcagttagcagagatcacgccattgcactccagcctggatgacaagagcaaaattccatctcaaaaaggaaaaaagattttagctgggcatggtggtgtacacctgtagtcccagctacttgggaagctgaggcaggaggatcgtgtgagcccaggaggttgaggctgtagtgagctatgatcgcaccactgcactccagcctgggcgacaaagcgagaccctgtctccaacaaaaacagaaagaaataactgtctggacgtcacggttggaaaacatgagagtggctacagctgatgccttacagatgcgtagacaaattacgaataggacttggttgggattcgcttagcagcagatggctttgcagtttccaggcagcccaaggttctgccactctcagactgtctctgcgctgagcagccactgggggtcccctgagacagagtcccctgggccctgtggctggtaccttcccagcataatggatgatggagaactcagtcttgtccttgagctgcttgggcttctggaacttggggtggctgccctgctccgtgcacagcttctccacgaaagacttgtccgtggctttggggaaccagcattcctcgtccagcagggccagcacacctggagggttgttctgtgggagacaagtagggcttgaatcagagagaacacccaacctcaggcattccatgaagagctggccaactatacacaacgcatgggcatccgccgagatctgatactgtatttgcccacatataaagatgagtttatgacccccatgcttccaaatctaccttcaaattaccctgtgcccaatggaccagtaacagggatggaaggcagaacataatgtttgctgccgccccctagtgggcaacacgcaggcaacatcatgaagagttcataactcttttttttttttttttttttttgagacagagttttgccttgtcgcccaggcagacggtgcagtggcgcgatctcgactcactgcaagctccgcttcctgggttcacgccattctcctgcctcagcctcccgagtagctgggactacaggcgcctgccacggcgcccggctgattttttctatttttagtagaggcggggtttcaccgtgttagccaggatggtctccatctcctgacctcgtgatccgcccgcctcggcctcccaaagtgctgggattacaggcatgagccaccgcgcccggccgagttcataattcttgcaaatgaatttgttgcttgacttgaattcacctagggttcctgttagaaaagttttttttggagacagggtctcactctgttatccaggctggaatgcagtggcgcaatctcggcttacagcaacctctgcctccagggctcaagcaatcctcccacctcagcctcccaaatagctgggaccacaggcgtgcaccaccaggcccggctaattagtagaaaccctgtctctactgaaaatacaaaagttaggtgggcgtggtggtgcacgcctgtagtctcagccacttgggaggctgaggcgggaggatcacttgaggcagggaggtggaggttgcagtgaggcaagattgtgccactgcactccagcctgggcaacagagtcagaccatgtcataaaaaaaaaaaaaaaaaaaaaaaaagcaatggcagagaaggaaagggaagggaaagagggtagggaagaaaaaaaggaagaaaaaagaggatggaaggaaggcagaaattaaagaaaatacctttgatatgaaaatgtgggttaatggaaattgtaagagttcacaaggattcagcttacagcctttcaggactgggtgatggattgggtgggggaatgctatgtgcatggggagagtgtggggtccacgtcggctccacagaggccacacacgtgtacaaggtgtgacggagccccgcacgcccacgtgcccctcaccggtcgctcgatgagctcgatgcagggctgtaggtccagcccaaagtcgatgaagttccactcgatgccctcgcgctggtactcctcctgctccaggatgaacatggtgtggttgaagagctgctgcagcttctcgttggtgtagttgatgcacagctgctcgaaggagttcacctgagcacatggcgtgggggcggggcgtgagcatcttggtatgaagtcagaagacaaggagccccacagaagctccacccgacagcgcccccatggcccgcccacatcctgttctgccatcccagcacccagacagggctgaggccccaaaacatgctgcctagagtccaccagggctggtgaagttgatatcacatggccctcacacaccttaaagatgcttatctcctccatctgcacaaccatctatggatggacaaacctcgtaaggcacgctactgcatgtacagatgtggaaacattttacagatgtgaaaacagaggcgcagagagaaagtgactcggtagtacacttctttcgggacatctatcaatcttaaaacctcctggctgggtgtagtgctcatgattgtaatcccagcacttagggaggccaaggcgggaggatcacttgaggtcaggagtttgcgaccagcctggcaagcatagcgaaacctctctccactaaaaatacaaaaattggccaagcacagtggctcatacctgtaatcccagcactttgggaggccgaggctggtggatcatttgagatcaggagtttgagactagcctggccaacagggtgaaactctgtctctaccaaaaaaaaaaaaaaaagtagccaggcatggtggcactaatcccagctactcgagaggctgaggcaggagaatcacttgaacctgggaggcggaggttgcggtgagccaagattgcactactgcactccggcctgggcaacagagcgagactctgtctaaaaaaaaaaaaaaaattagctgggcacagtggtacactcctgtagtcccagctactcaggaggctgagacaagagaattgcttgaacccaggaggcggaggcagcagtgagacaaaattgtgacactgcattccagtctgggcgacagagcaagactctgtctcaaaaaaaaaaaaacaagacaagacaaaaaaaaaaccttccctttctctgagaactttcttcaaacccatgggtaaaggatccaatatccatgtttctactacatgaggtattgcaagctcctgcaaacagttcttggcttggaggtgaccatgtagcccaattcaggtgagtaagagtcagtgagacttaattccaagattttggttggaactgttagaaaagagatatgtgctttttttttttttttttttttaccaggattactgagaggcagtctggagctgtggcagccatcttgcccccgtgaggggagagcctgcttgagaatggagccaatatggaggaaggcagagagagagagagaacgatggcgggagatcagaccctgcctacgggatccagctacatgtctggccttctcagttccagaaaccaatgcatttcctgttggatttctgtctcttataccctcaatgatccacccttaactagacagcctcctaccctacagtagccatctacatgcctttctccaaaatcatgactcctccaagaaaaagcccatctcagacaaccaagaccatggctcttaggatcccaccgagctgtacctcaaagatctcaaatccagctatatccaggatccccaggaaggaagccccttgccgatgggtcttgtccagggctttgttcacgcgggtgagtatccagcggaaaaggcgctcatatgttgccttggccaaagcctctacagcaaagtcagcctgcagagggcaaccaggggaacccggttattctcaatgggctccattttcacataagccaggctggtggtgaagatttttattcttggccgggtgcagtgactcacactgtaatcccagcactttgggaggccgaggcaggtgggtcacttgaggtcgggagttcaagaccagcctgaccaacaaggcaaaaacccttctctactaaaaatacaaaaattagccaggcgttgtggtgcatgcctgtagtcccagctgcttgggggactgaggcaggagaatcgtttgaatctgggaggcagaggctacagtgagctgcgatggcaccactgcacccccccctgggcaacagagcaaggctctggctcaaaaacaaaaaacaaacaaacaaacaaaacctgacatgggactgtgaatattctagtattgaataaatgagggataaagagatggatgggtggatgcatggacagatgaatgaatgaatgaatgaatggaatgacagctggatgggtgatggatggacggacagatggacagatggctgggtcatggatggatggacagatggatgagtgagggatggagagatgatgggtgagcagatagatgggcagatgaatggatggatggatggatggatgaacagacagatgaatgagtgggtagaaagatggatggatggacagatgcagaggcagaccatgggtgaatggattaatgaatacatgaatgagtgaacaggtggatagatggatgaatggatggatgggtgggtgcatggatggataagtgataagtacatcattacctgttcttttgtctgagctttctgtaccacatctcgcccaaccttgatacgaggagtgaggatggatctggtgaaatctgtcacattaattcccatgaggtggcaaactttctgagcagctggatggagaaaagaaacatcgtgagtgcatcacaaaagaaatagcttggcaagaagacacatcgcatgggatatttgtgatctgtgaatacagcgggttctcttggggaaatgggacccgctgaccatgaatatagcttgaagtgtcctaaaggctgctgtcattagtggtcacactccccagtattttgctgagaggcaatgattggggtgggctgaagcaggccccagttgggggtttagggtcaggtagttctagtttcaagtccctgtcccttcacacttccaagtcatgtgactttggaaaagctctttaccctcccagcatcttgcttttctcagctttaaaaagggtcagctcttcggtaccttgttggtacccaggactaaataaggtaaagtatgtaaagtccctgagatagatagatttatttatttatttatttgtttatttatttatttatttttggagacagagtctcgctctgtcgcccaggctggagtgcagtggcgcgatctcagctcactgcaacctccgccttccgggttcaagcaattctcctgcctcagcctcccgagtagctggcattataggtgcctgccaccacacccagctaatttcttttgtattttagttgagatggagttacaccgtgttgcccaggctggtctcgaagtcctgaactcaggcaatccgcccacctcggcctccctaagtgctgggattacaggcgtgagccactggcccttgagatttatttaacagttacttagtaagtattaaatagttattaatagtaacatttattgaacagttactgttcaataaatatttctttcacccttctaggatatgtgttgcagcattgtttgcaatagcaaaatgctagagtcaacctaaatgctcttcttttattttgagatgcagtcttcctgtcgcccgggctgaagtgcagtggtgtgaccacgagctggtcccttaacatgaaaatagcattacatgctgctttgcatgtgcaaggcagagtaaatagagtgattttaggatttttttttccccatctcttggcaagagcactttttcatttctctttccctgaggtctttccttggcatccggattccattaatttgccagatttagggactctaatacataacaaacacctgagaatgaaactgccactgcaaaattataactgagacactgaacaagatctgacctaacggactccaccttgcttctaacctccaagctccactgaaccatttgtgggtgtaagccgaattaacttggcaggaacttagtttatagtttattttttatgttttggacacagagtctcactctgttacccaggctggagtgcagtggcacaatctcggcgcactgcaatctccgcctcctgcgttcaagcagttctcctgcctcagcctcctgagtagctgggattacaggcgcctgccactacgcctggctaatttttgtatttttagtagagatggggtttcaccatgttggcgaggctggtcttgaactcctgacttcaagtgatccacctgcctgggcctcccaaaatcctaggattacaggcatgagccaccacgcctagcctcttagtttatagtttaaaacacaagaaccctttcccaaaacaaacccccttcttgcctggagactagactgcctttgtaggaataacaaattagcccaaaggtttgaaattatggtttaggagtcctgtaactggaggctacaagagtctgaccctccctaaattgctcctggggataacatcactattgtaaaacctaagaccagtacttgagatatttttgcggaccctggcaccaggtggatcagctgacaccacccagatcgagaaactggctcatctgatcttatggcctctgtccaggaactgactcagggcaagaggacagcttcgactccctgtaatttcatctctgacccaaccaatcagcacccccaactcactggcctccccctaaccacattatgcttaaaaactctgatccacgaatgctcaaggagattgatttgagtaataataaaactctgttctcccatgcagccggctctgcgtgagttactcttactctatcgcaattcccctgtcttgattaattggctctgtctaggctgtgggcaaggtaaacccagtaagcggttgcaacaggtttgatcaaggtgggctctagggagcgggaaaaagcaacacaatatacagcctgggctgggaaataagaaacctaagttttgctctcagctcagccaccaacaagcatagtggtagccaggccagcttctcaaaacacaaaatactgtttatttgtgggtaggtttatcagatttagggggaaaattacaggatgctcagttaaacctgaatttcagataaacaagaatactcttttggtataatcacggtccaaatgttacaagggacataattaaaatttaaaaaaaggtttgttgtttacctaaaattgaaatttatctggacatcctgtattttatctggcacccctaattctcagggcaattgaggtctgtctccccaagacgaccacagataccgtaagaagagctattcttgtgtcatttcctgctgtatcccagtggcatattgcaggggcttgagaaatatttctttaacaaaacaattaagtggggtattttagaagagatggtccctcgggatcttgtctggtcactattaggggtaggacgtgatgactcttgcctgtaatcccagcattttgggaggccaaggtgggaggatcacttgagctcaggagttcaagatcagcttgggcaacacagcgagacctcgtctctattaaaacttgtaaaattttgtatttaaaaaaaagaacaaataaataaaactattaggtttgtttttttttaatccctgcgctctgattcaataactttccacatagggtcttgagcactgaaaagtttgaaaaagtgagtgataagaacctagtccaactgttgttaaaatcccagataccttcaccttgaaaaataaccagtggttaaatgtcacctcccccacccccccaaccccaaagtcattggtcatcaggaaaaagtggcaagtacctgtgttatctggcatggacgcctggtctgtgtttctttccttcttgaagacgatatttccaagctgcaggaccgatgataccaccttcaatatggctgaggtggggagagaagggcagagcagacacaaaggtcaatgccaaggtaccctggagttttggagcctaaagccactggggacccagagccagcttacatctttcctctgaagaaactagattctgagctcaatattttcatatggttgcttaaaaccttgcattacaatggaatgccacgcagcagggactggcaaattacagcccatggaccaaatctggcccactgcttgctattatacataaagttttagtggaaaacagctatactcattcatttacatattgtctgtaactatttgcatgctacactggcagagttaatgagttgcaacaaagatcgtctggcctacaaaggctaaagaatttactatctgaccctttacagaaaaatgtgttagcaacccctgccacagaacagtgagaatgaatgagctacaactaccacaaatcaaaactgatgtattggggccagcatagtgactcatgcctgcgaccccagcactttgggaggctgaggtgggagaactgcttgaagccaggagcttgatacagcctgggcaatgtagggagatcctgtctctaaaacaaaaaaaaaaccctgacatatcttccagacacaaataccgaacaaaagaggacagatggaaacaagaacatactgtctaagtccatatatagaccgtccattcaagaagaggcaaaactaatcgatgctgttagaagtcaggataatgattatccttaattgagggaagttcttagaaggtgcatgtgggagcttccatggggctggtggcattgtcttatttaaaatggattctagttacacagacgtgttcagtttataataattctttgcactgcacgctatggcatacacaattttctccatgtaaatcatatgtcaataaaaggatttttgaaataaaaaccctgtgcttcttacatactcttctgggtgtaacagatgcccatgttgggatgaagaagatatacatttgtttccacttgttgtccaggtgtctccaaacaaaaacgctgtgttcccagaatacttggaacctttctgactccatactcaggccatgttactgttaaaatagtttctatgtctgaaatccccataagaccatgagtttctggagagtggagggcctgccctaatcatctttgaatttccaaagcctattccaaggtcctgatacacatgggagggagggagagagatggatggatggtaggtggaaggtggatggatggatgaatgaataaatggatagaggatgggttcatggatgaatggacggatggatggatgggtgggtagatgaatgggtgaatgatggacggatgagtagaggatagatggatgaatagaggatggattgatggatgaataattcatggatagaggatagacggatgatggatggatggatagaggatagatggatagatggaatggacagaggattgatggatagacgatggatagatggatggagaattgatggaggaatggatacagcattgatggatggatgatggatggatgaatggatggatggacagatgatggatggatggtagatggatgaatggatggatgatgattaatgcaaattcttggcttagcttaactcaggtacaaatcacccagagttctggcttcaaatcagtcactatgttccaggaacaaagcctagagatcccagacttctctggttcctcaggccaaaccagacattacaaggcccttcacaacagctattctcacgccatggggtccctggcccagctcagcaaaaggacccagctgctgaccacccatccatttgctcccacttactatggtagaaagccttctccccaaaatgaatgaagctgctgttgacagggcttggaaacacacttccttttaaccataacatctatgaaagagtctttgtaaactatgaagagttgcactcacagttttaaaagtgtcaatttaaactaaagattcctgaaatgcctgcacagcccaggcgagccggccaactcagggtttctcaatcttgtcactgcagaaattgggggccagataattctctattgtggggagctgtcctgggtatcatgggaagtttagtagcatccctggcctctaaccactagatgtcagtggtggttaccctgacagagttgtgacaaccacaaatgtcaccagatactactcaatgtcccctgggaggcaaactcacctctggcagagaaccactggtctaaatgaacaaagccaactaatgaggactgtggggacccaaggaggccacaaacccatctgaaggggccagcagctactccgtcattgccacaggggatataagccaagtgttgctggaacttctgatttttctagataatggaaacccagagtttttatgtgaagtgtacccatgttttttggtgtgtgtgtgtgtgtgtgtgtgtgtgtgtgtgtgtgtgtgtgtgagactgagtcttgctgtcacccaggttggagtgcattggtgcaatctcggctcactgcaacctctgcgcttcccaggttcaggggaattctcctgcctcagcctccagagtagctgggattacaggcgtgtgccaccacacccggctaatttttctatttttagtagagacggagtttcaccatgttggccaggctggtctcaaactcctgacttcaagtgatccatgtgccttggcctcccatagggttgggattataggccacagtgcccggcctacccatatttaaactttaggaaccaatttctaaaaattttgaaggttgtagtggccgatctctcctgtgggctcaggaaccattggtttgcactttctggtatagttaaatgtaattccagaaatgacaaaagaatgccaccactcccaggccataagagatgaaccttggggcagaattagcagacagcaaagaagtaaaccagtgaggagacacaacacagcaagggtggtgacggctggcagcatcctggtgtgctggtgcaaagcacgcgctctgcagttagagagtcctgagttcaaatcccagctttgcttcttataaatctcattatctctgaatttccaaatcctagttccgggtccagatacacatggggagggagggagatggatggatggcagatggagggtgaatggatggatgaatgtataaatgtatagaggatgggttcatggatggatgggtgggtagatggatggacggatgggtgatggatggatgggtgatggaaggatgagtagaggatagatggatgatagaggatggattgatggatgaatcatggatgaatagaggatagagactctacatgagtctcaataagtcccatgagcctcagtttccctatctgcaaaacggagatggtaacagtagtacctgcttcgtgaagtttaggtcttgtaagatgctgagcaagggcctggcctagtaggtgataaagagtggaagccacctatattaggttgaatgttggtctttctaaaatatgtccacctggaacctgtgaatgtggcctaatttggggggttacatttatttttttttcctttttgtggataccggggtctcactatattgcccaggcaggtctcgaactcctgggctcaagctatcctcccgcctctgcctccctgagagctgggactacaggcgtgaaccaccgcgcccagcctgaacgtggcctattttggaaaaaatcggtcttcgcagatggaatcaagtacaagatctcaagatgagatcatcttggattaacctggtgggccctacatttaatgtcaagtgtctttatgatggacagaagagaagacccacagagtagaatgccacatgaaggatgaggcagagactggagtgagacaagccaaggaaaagccaggaacagccagagccaccagaagccaggacagaggcaaggaacagatctccctcagtgcctccaggaggaacaacccctgccaacatcttgtcttttaaaaaaaaaaaaattttttttttttaaatttttagtagagaaggggtcttgctatgttgctcaggctggtcttgaactcctggcctcaaacgatcctcttgccttggcctcccaaagtgctgggattacaggcatgagccattatgcccggctcctgccgacaccctgatttcagaaccctggcctccagaactgggagagaataaattcctgttgttttaaggcatcaagtttgtgctaattttttacagtggccttacacctctcttcttgctgaggaataagaaacaggactttccaacatcagacatgtgtaccaccagggatacacaggatggacaatttaggtgattttattttttatcttcaaaatacattagaagcagtataaccaggccaggcatggtggcgcatgaggatatcttgaggccaggagttcaaggctgcagaacccaatgtggtggggaaaatcctggtgtcccctggtcacttggagcctcatgaagctccagcctgaagcctgacccacccccttctccataggccccttgatggagggtttggaagtagctcttggtttataaatggggttggtgtacatttaggactaagttggttcctatgagagttcgtcatttgcacgccatcgtctgaatgcttgctctgtgtaccatctgctccattatttgcttaatcattttctttaaatttacttccttctctttccttacatttgttttaatagaaaactttctctatcttcagtgacaaatcatcttcacttgccataaatagatggcaattataaatataaatacaaggaaaacagtattaccaaattctagctagatgcttggggctgccgaaggtgctgggcctggagtctggtctctgtggttaaaggggaaacaagtgccaaagtacattgagaacactggggactgggcatggtggctcatgcctgtaatcccagcactttgggaggccaaggtgggctgattgtttgagcccaggagttcaagaccagagaatactggataacatggtgaagccttgtctctacccacccctccaaaaatcaaaccaaaacaaaacaaaaaaccccaggccaggcacggtggctcatgcctgcaatcccagcactttgggaggccaagatgggtggatcatctgaggtcaggagtttaagaccagcctggccaacatggcgagacccagtatctactaaaaatacaaaaaaaattagtggggcatggtggtgggcgcctataatcccagctacccaggaggctcagccaagagaattgcttgaacccaggaggcagaggttgcagtgagccgaggtcgtgccactgcactccagcctgggtgacaatagcaagcctccatctcaaacaaaacaaaacaaaaaccctaaaatcaaaaattagccaggcgtggtagcacatgtctgtagtctcaacgacttgagaggctgagctgggaggactgcttgagcctgcaaggcagagattgcagtgagctgagactgcgccaccgtactccagcctaggtgacagagtggtgtgatctcggctcactgcagcttcgacctcctgggctcaagcaatcttcctgcctcagtctcccaagtagctgggactacagtgtgcaccaccacacccagttaattttttgtattatttgtagagaagggatcttgccatgttgcccaggttagtctcaaactcaagctcaagtgatctgcctgccttggcttctcaaagtgctggaattacaggcgtgagccaccatgcccagcaaaacaatttaaatggtctcattgttttctttcacaaggacagacaatgatttaataaaccctctattaatcaacctattttagtttgttccagtttttttctatttattttttttgtagagacagagtctcactgtgttatccaggctggtctcgaactcctgggctcaagcaatcctcttgcctcagtgtctccaaatgctgggattacaggcatgagccactgtgcccagcctgttccagttttttattatttaaataaaactatactgaacagtgtagtacatcaagaaaaaaggatttggtaaattcctggcacacagcaaatacttaaccattgttcattgttatttaaaagcaagattagaagcaaaactgacccctgtcccaaatgaaatgaatcattcttggagggcctatgtcattcagacaaggaggctatcagcactagattctgatgtgggaccctggccaagacccacatacaccatccatttgtcaactgacccatacagcctaattttccagaccccaagttatcttcggaggagctgcccctccccttatgcagcatttcagcaacctcagtgctattctggggctccaaacgggcgtaggcgtgggaaggaagggaaactttccacagttctgtcctggtgttcctgaaagagattaaccttcaacactgaggcacatctaacgcagaaggaaaatcgtttctggaaacacagtgtcccgaccaagaatttctttctgagctgtcctgttctcaagacccagtgtgtttcttggccattggttggatgattttgatcaatatcaattgatcaccagagcaacccctccaggaaaagcctgagtaaatccactgcctcgatcactccccctcccctaaaccctgcccacatgttcctgatgaggccaacatctctaccttcagctccaagaatccattcttagggaccataatgaaaccaccctgcgctttccacaaccctgcctatgctgcatagctcaggaatgtgcatatcaacctaagccaaccaatcagagtcaatgacactccattcaggaacttaagccgggaatctactctgttctttggacataaacccaaagaatataagggctggaacccagctatgttgctgtcaacaaactgcatcctatagagaaacaatgtagtcgagagagatagaagacaagaaattaggttctagaaaaatcttttgaacacctagatctcactgtacctgaagcttgaattcctgaactttttttttttttgagatggagtctagctccatctcccaagctggagtggagtggtgtaatcttggctcactgcaacctctgccttccgggttcaagcaatcctcccacctcagcctcctgagtagctaggactacaagtgtgcaccaccagccctggctaattttttttttgtatttttagtagagacagggtttcaccaaattgaccaggttggtctcgaactcctgacctaaagtgatccgcccaccttggccccgcaaagcgctgagattacagacctgaaccactgtgcctaacctccctgaacttctcaacattctgagttagtcactttccctttggtttaagccagctcgggttacttgcaaccctagttatacagccacttttctacaacacaaacaaaccacctagaataaaattcattttcctccttttttttttttttttttaatggaaggtggggaattcagagagcagaaatctgtcctgaccagagaagagttcttaacaggttccactggtatccaggcaagctaccctccagactcaaggtgtgaggcttacatagctgctcctcctcgctgaaacccatgattgccatggcctccacggtttcctggaacatctcatcatcctgggctgctgggatgggcacaaagccattggagaggaaggtgtagttgttgaagccctccaaaagcaagtcacctagaaggagaggaagacaggtcagggtcaataagacatacttctaatttcaacatgagaccgagatctggtcaagggtctgggccatcataattcctttccctttatcaaggcttgaaccgtttaaagccctcacgcatcgtcacgtagacagcctcaccaaccactgccagccttacacagcggtgcaggttgtgcactgctccagtgactgcagctgatatccagccttggttctgcttgctaagccacaatccctggcacgaagttacatttacctggaggaagggatgcctttacctcaattgtctagaggcaccctgccttcagccttcagagacaaagctgtcagaagagttagatcaacctttactcttttttttttttttttttttttgagacggagtctcactctgtcgtccaggcaggagtgcagtggcgcgatctcggctcactgcaacctccgcctcccaggttcaagcgattctcctgcctcaacctcctgagtagctgggattacaggcgcccgccaccacgcccggctaaattttgtatttttagtagagatggggtttcaccatgttgaccacactagacttgaactcctgacctcaggtgatccacccaccttggcctctcaaagttctgggattacagacgtgagccaccgcacctggccttattcatgtatttataaaatttttatcaaattcaaacaggcacatgagttttaaaaatcaattactaccaaaggtttataatgaaaaatagcattctcctgtcacatcccttctccaactctaccttactccataatacctgcttttatctcttttagctgctttttatctggcagttaccactatctctctgtacaataggcttgctatatatactagcctattataatgtatataccattatgtattacatatcataggccaagggttccccaacccataggccatagaccagtaccggtccatgttaggaactgggccacacagcaggaggtgagcagcaggtgagcaagtgaagctttatccgctatttgcagctgctgcccatcgcttgcatcactgtctgagctccgcttcccataagatcagcagcagcattagattctcataggagcgcaaaccctatcgtgagctgcacatgtgccctccttataacactctaatgcctgataatctgtcactgtcccccatcaccccccgatgggactgcaggaaaacaagctcccaatgattctacattatggtgactagtataattatttcattgtatattacaatgtaataataaagtgcacagtaaatgtaatacacgtgaatcatccccacaccatccccccaaccctgcccgcccagtctgtggaaaacttttcttccaggaaaccagtcctcagtgccaaaagtaacaggtgcttttggcctattggaagaccagaggcaaagcacaatcgctgtaataggcgatttctggatatgtcaagtttagatagtatctagtgacttcctgctatggtaggcaaaaatgcagctttcttatactacctttcctttcctccagctatttttttttttttttttgagagggagtttcacctttgtccaggttggagtgcagtggtgcgatattggctgctcactgcaacctctgcctcccggattcaagcaattctcctgcctctcgagtagctgggattacaggcacccaccaccatgcccaggtaatttgttgtatttttagtagagacggggtttcatcatgttggctagtctagtcttgaacccctgacatcaggtgatccacccgcctcagcctcccaaagtgctgggattacaggtgtgagccaccgtgcccagccacccccagctatttttagttgaatcaatatataaggcttatatcacaggttggcaaatctggtcccctgttgtttttgtaaataaagttttattgaaacacagctgctctgatgtccttgtttatttctcatggctgctttctcactaggcaacagagttgagtagttgcaacagaggccatctggtccttaaagtctaaaacgtttactactgaccctttagcaaaaacagtttgccaactccctttttatgacattaattagatattctgtgtcaaactgtatcctatgattacatttcctttgttgttgttcagcttctcccccacccccaactttataattgcctttctttctcctgcaccatttgcttttattataccctccaatacatcaaggatcctcttccagatcaatctttaattaggatggattcggttatacttttggagagacgtcagcaagatatttttctttcaaaatcaaggtcttttatgggtcaagtcacttggaagctgcttgataaactcgaggttaaattgactgaaggcaccagttaactcaaacttttggattaacttgaaatgcctgattcaagtcacgaggattgaggtctttgccaagacttcattatcccgagtttggatgcatttagcaatatttggttctttctaaaagcctaacatctttccagttctatcatctagaatacaaacggcccctgggaatttagttctgagccctatacttgcccatttctggaagaccagaggcaaagcacaaaactggaacccaaggtaccaaacaaccaaactgttttcttgggtgccaaataaaaggaaaaggaatgtcaacatttttccctggcccattccacagggtcctgcactgtaactgctaatataccatgtttgctggtacataaaaaatccattcagcattccccctttaccaaaaattgctccacctcatagcctatgttcctgaaagccagccattaaggaaacttatttttattgtttgagacagagtctcactctatcgcctaggctggagtgcagtggtgcaatcttagctcactgcaaactccaccttctaggttcaagtgattctcctgcctcagcctcccaagtagctgggatgacaggcgccagccaccacacctggctaatttttgtatttttggggagacagggtttcactatcttggccgagctggtctcaaactcctgacctcaggtaatccgcccgcctctgcctccgaaagtgtgggattacaggcatgagccactttgccccaccctggaaatttaaataatggataatgccaccccctagtagctgaggtctacaatacactccgacacagcgaagttctgagctcacacagatccttttggtaactgtcttaaccaaaataactaaccttgggccacaaaagagatgggaagcaaagtctgtattgttcccatagaatttcagactcaaaacttattactaacatgtagactctactatgtacagatagtcactgatccattccttttttaagctatgcgatttgtatatatttttaagagttagtaaacagctgcaggtccagaactcataacttcctactggagtttggtatacagtgtattatatttacataaaaaaacttttccctacaacagaggtcagcaaacttctgcacactgcctgtttttgtaaataaagttttattgtaacacagtgatgcatctgcactcactgatttatgtgttgcctatgttcattggtttatgtgctgcctgtgctcattggtttatgtactgcctgtgctcattggtttatgtgttgcctgagctcactggtttatgtgttgcctgagctcactggtttatgtgttgcctgcactcattggtttatatattgcctgtggctgctcttgtattacaatggcagagttgaatagctgtgccagaagccacctggcctgcaaagcctgaagatttactatctggccttttacagaaaaagtcttgacccctgttctacaaagtcactggcaaaacatgtataatgaaaaatgcttagtcctgctgcccctgcaaattccttataaaaccagaatgcatcttttatatttgcaagttttataaattggcaagtaaggcaaatgtctttctccctttccttgaaggcgtagattgtgtctagttggacttgatgctctctggtctaatgagacatgaatcattaatgatctaatgtctaattggagttgatggctactatgtcacatagtaggtgctcagtaaatgagaatgactgaacacaagccacactcactcattgggaggagatgaagaactgttcatatgtcactcacagacatggtcctttctggcaggatctgagactgttttaatagccaatcccttaaccccggattctgatgaaagggaaggctcaagccatccaatcacatgtcattgctagtcacttacttctcatcttctccttggctccagcaatcatgtagtaaaagatgtggaatgtcctctcgtctctggcttggcgaattgcccgtgatttttctagcagatctggtttggagggagttagggattctggggatactgcgggtgttcctctggtcttccacctccatccctgtcacacccaattcacatgggatgactttccagttctacccctgggatcggtaatgtctaactttgaccattgcccctatggacaaatggaaccgctgggtgctgccagcagacttcagatgcaaaaaaaagggaggggaatagagtgaaaagaaaaagcataaaaaggctccaggaagaaggtaatggtaacgagatgttcccctaacagccatcaccagcaaatcttctttaaaatgagctgtcttcagacatgacagaatacaaataatgacaccatctatgatcctatgatttatgattcattcctgtgtgaaatgattgatataaattgtctcactgaagcctcacaaagtatgctaggaaataagtgcaactattatcggtgttttcaataaggggaaactgaggctcagagaagagaagtcctttctcaagatgatacagctaacaagtggcaaagctgtcttccatgccctctgttccaagagtggggtctgacgggatggaggcgagagagaccgtaaacacgccacactaattaatttcaggagagcttctccgcgatgcggggtggcaggagggagagcagaggggagggcaggtgagggtggcatggagatcacagggtccggggtgatgggagagggcagctgggaggctgggctactgtactgggtggatttccacagcactaagcatgatggtgcgggatgatggggctagatcagcagaccttgtcttcttcaagtcctaaagccagctagcagtgcccgggctaccacagcccatgtccaatctggaaagcagtgattctcagactttctcatggtgtacatgggtatacacacgcacacatacacacacacacacacacacacacgcacgtatgtttgagccagagtctcgctctgtcacccaggctggagggcagtgtgtgatcttggctcactgcaacctctgcctcccggatccaagcaattctcctgcctcagcctcctgagtagctgggactacaggtgcatgccaccacgcctggataatttttgtatttttagtagagacagggtttcaccatattggccaggtggtctcgaactcctgacctcaagtggtctgcccgcctcggcctcccaaagtgctggaattacaggcgtgaaccaccgtgcctggctgagatgtgtgtttctaaagagctcccaagtgatgctgatgctgctggtttggaaacatactttgagaaccactgatctaaaaggaaggctgaggccagaaggacggggctatgcctggggctcgctctaaacacaggaaatgaattgctgagaggtgtgtgcagggctgcaggacaagagggccctggctctggacttgaccgaagcctgacagccctcctagctgcaggatgggaatcctggctggtttgggcagattaaagtagaaacgtagaaaacattgagttaacgcaatagccaccacctatgagatgctcactttgggcccagtaccgtaccaagggctgtgcatattattatgcatattatttcatttaacccctgcaccagctccagaaactaggtgcaatcacccccattttaccgaggcaaaactgaggcccagagagcttcagtgattttcccaaatccccacagcttagacaagtacagtggagaggaagctactccacaacccaccctcttatccagggcacataacgtggaaaaatgggaccactaggtgctgctagaggacctcaggtgcagaaagaagctaagtcaggcccccaggtcctatacattgccaagcacgtgttccacaggaagcctgagccctagggccgcctgcaaagctcctgaggctgatcagtcactgaactctagacctggttgttcccccacgtccagaaatttctaacttggctccacttcaccgctcaggttcatgaaagagatgctctacttgttccttgcgataccagcattcttctgggtaaactctgttttcatcaatttcctacctaagaagtggagccgatcacagaccaactctctaagaggacgacaggtccagaatttggcctcggacaatggctgaataaggatgaagtgaagatcatacgatagacactacgtagccagcccttactctgcacctcgcatggtgcctagagctttatatgagttcattcactctattctcacatttctatgaggcaggtaccattcattatcatccccattttgctgatgaggcacagagaggtggagtaaccagcccaaggtcactcagctaagggacagatcatttgagcatcacatgcagcctaggctgcttgtttagggttcaaaccaggggtccggtccacacatgtataaccactgcaccacaatgcctgctgttaaggggagatttgttctggaagaaacctaagaggctggaaagatagaggtggctcttggactctcccagcctctgggcaggagattggtagggggcaggggtacccatttggcccaggctcagggaaaggatacaggtctcaatgttggctcccacgatgtaacccgtgacgtcgaagttgatgcggatgaatttgccctgccaacaggaaaacacagttcaggctttgctgcccaacttcagccgttaaccccatgctgtgggcaagcaggaggcagatggtacagaggatgggaggtggggcggggagattcttgcgaacactcagaaccccacaggtcaagttgtcaggcggaaccaacatctgctgagctgaaaccaccccaggcctgacagcaacagaacgtgtaaaacatgttcacagatcaatttcattcggcttttgcaatgaccgtagtccatcatggctatccctatttaaaaaaacttatttatttattagagacaaggttttgctctgtcagcgagggctggagtgcagtggtgcaatcacagctcactgtaaccttgaactcctgggctcaagcaatccccttttccccatgacctcaccctcccaagcagctaggactacaggcatgcaccaccatatctggctaatttttaaatttttttttgtagagataggatctcactgtgttgtccaggttggcctcagactgctgcactcaagcaatcctcccacctcagcctcccaaagtgctgggattacaggagtaaactaccacacccagcccactatccccattttaaagctgggaaaactaaggctaaaagagatcaagtgacttgtccaacgtgacgttgctcctgagaggtagggccctaagcagaaagaaggtttttccatattcaggggctagagggctccctccccagaccccaccctgctccaaaacatccacatcatccaactatggattaaaccttttctgtgggacaggtgagtatgcattggccacactgcccaagcaggccctgtgtaggatgtcctttaggcaggaatggctcatgttcctggccctagaggctcaacaagtatctccaaagatggccctatctacctgcctcagctaagccatgaaaccaaggatggaacccaatcctccatctgttggcatgaacccttttcctgtttcctcaacaggtgagacaggatttcatccttttcccccatcatgacataacatggtgggaagtgttggcgtgtgtggacacaatcccctaggcttgctcagtccttgacaaaaccttcaaactttccccattgggaaacatgcagtagagtgatttgggatgaccatatcccagatggagccagggagagccggctggtcacaggcaaggcccaggcaccttcttcactctccttcccaagatggcagggacgccagtgagtggaggatgtttttagggatttgtcttgcacgtgcttccatttatgacaggctagaaacattgcacagaattggaacatgcaaacgcagtgcttctcagtggaggcggcacatctgctatggagattttggaaatcggtggaagccattatttggcttgtcacatgttgggggggggccgctgttgttagtgaacagtggggccaaggatattttgggagtcctgcaatgacctggagagtctctgatgccaatccttgtctatatcccttatgactcttccaatgtctcacctgccactcatggaggtaaaaatctgtttgtaattagccaggcttagaacctaacctttatgactttagatttttacgcttttttttttttttttttttttttgagacaagagcctcactctgtcgcccaggttggagtgcagtggtgtgactttggctcactgcaacctccatctccccgggttcaaggaattctcccacctcagcctcccgagtagctgggaatacaggcatgtgtcactgcgcccagctaatttttgtatttttagtagagacagggtttcaccatgttagccaggctggtctcaaactcctgacctcaggtgatcttcccaactcagcctcccaaggtgctgggtttacaggtgtgagccactctgtgcctggtctagatttttatgcttttaaatgaaagcattaacaagtgtttaaaatgttgttctaatacaagaatatcccatctgtgtgactctagagaagattgttctttggttcagcgcttcactgagagtcagttgccattctggaaaatcccatgccaacatcatcagtgcctgaacttgacccttttccttgtatttgtagctgtcgccgtggatagacctaagtgtctgtctcttactgtgtcttctgttggtgtggcctggcccgagcattgatatgctgaaatgcactttatttatttatttttgtagagatggggtttccccatgttgcccaggctggtctcaaactcttgagctcaagtgatctgcccgcctcagtctcccaaagtactgggactacgggcatgagccacctcgcctggcctgaaatgcacactttcattatgaattgtcttatgttatttcttcttcatattccagttagggcattatgctgatgtgtattcatctaatacgtgtaggaggtgatactatctatgattctaatttcgggcgaggaaaggagacattatgtaattgtttgttactaaaatgggccttggggatcacagggtcagggaccaccatgtgcatttgctcagcagagcagagctttctgcaaagagtctttcacagggccccatctcagcgagcaacagttcagagacccccttctcctggaatgcagaggcaatttttccttcatcttttctcactaaaatatctttctgaccctcctacggagacaaccgcttcttttgcacaataaaaccattgttgtctacctatcatcaaccatccactttcagagttcccctgccctgttgggctcaggcaaaaactttttgctttggagcctgggggagtgtgcatgggaaggtagtaccccctgcctcacttactctctgttattcagttggaagaaccagcttcatgaaggctggaaccatatctgaactattcatcgcaatcctgtgagactcgctgagtgcctggtatacagtaggcacttaataaaaacagcaaatgagaaaaaaacaaagagaatggtggtacatgtaaaagtgcctaccagagtaattgtacacagtaggtacttactaagtatttcttggaggaggtgtgtgcctggtacacagttggcactcaattcatgttttgttacataaaatggtatcggatataagggtctagcccataccaggtgctcaatacctaattttttaaattttattttaataatagagatgggatctcgctttgttgcccaggctggtctagaacccctgggctcaagtgatcctcccacctcagcctcccaaagtgctgggattacaggtgtgagccaccgcaccaggccaatcaatatttgttgagtgaatagtgaataaattaatgaatgaatgagagagtgagaggcaggagcccttgcaagattgtgagatacagcccatctctccagggtcagatgcccctcccacctctgcacgcaaacactctgcagccccaggcaggagatgacaccaaagcttttctggaaaatccatgtggctttgctacttacgaatcgtgaggagttgtcgttcttcactgttttggcgttgccgaaagcctccagaatcgggtttgcttgtagaagctgcttttccagctctccctaaaattcattcacatctagttattggagaaagcaacctaggtcctgacagttctaccttggatggatgttgtcacaaaactctgcccttaacccacaggttctctcctatctcctacctcctcttagaccctgatgctaatgttcagatttacaggaggatttcagaagagaagcaactgtctgagctctctaatagctaggacatctgctccctaggaaggtcacttttttcaagaccagggcctgctcatctgtgcaacatcactgccactcaaagccactgccttgcacaatgtcggtgatgtcatttacatcatgatgaatggtgccccccggagttgtgcagtgcaccacctgtcccactgtacatggcagtcgtgctgctgttcatgtttaacaagcagccttcttcaagttaaaccactacaagcctccttctaattattttagtgcaattttttttaagttgcaattttttctttctcaggactggttttctgaagtcttctacagcagacaagtaaggaatgcacaaaacccaccaggaatcctcttagcggactgcggaataaagcttcaaagcaggttgcctgagctccattcattgggttaaaggaagctgagactgtacacagcccaccggccccctctgccgggatgcctttgcacaaacgcggtcacgtgattaatcatggcaggaaagggccaatgtggtaagttaagctgggaaagcaaacgagctgctcttggcctagccctaaaacatggcggctgcagttgggccccgaggcctccaggccctggattctgggagtttttctccttgtcctcccctcctgctttcccttccttatttttccaggcatcagggctgggctggacaggagccgggaaagtgtctagaggggacaaggatgggcatggcttcctcctcattcctccgcatgctaggaaggcatcagggtacctggtctacaggacaaagcaggaagctgctatttgtttctgttttgatttgtccacacatcctcctttttgtagctcccagagaaagatgaagcaaaagcctcatccgcatacaaatctcagctacaagtggaatcaccacagctgagactggtggaaatttacaaggagcaccacgggcatttctttgttggtgggaagacgactaaaggaatcacttttgttcacataaacttggggtctccatgctctctgaaaaaggctccctttctagaatggggattctggcaggtaaggttgaaaagtcttggcaagagagctttaaatcgggggacctggttcaaaccctcaattttatagatgatgaaaccatagccccgaggagttaactgactcggccaaggtcacacaaaagcagatcccaaataagaactgtaattctccttctgatctgcaacacagtcacccagggtctaactaagatggattgaatgatcttttcgggagccaaggaagacacctgtgggtttcttctaggctgggacccacacatcagccccccaagctctgtgttagagatgagtttacatatgcacaggtccaagcaggaccaggttatgcgttgcgtagctggggccttaccgcgccaccaaagctagtgcatcgcgacctccaagactgtttctggaggcttgagtcaagcaaccagcatgcaagagacagacacgcactgcacacgcatgcacagggacacactggtgcaccagggacagggctgagggaagacacttagggatgatggcagggagagaagagggaggcatgccacagctgtgccatcgactgtccatcgagccagggaagctttggggcctgacagtcctaaaacactcagccagatgggacagacatctctgtctaggttgttccagtcaagggtaccaggagcggatgctttgaagggtgcaggggttcattctgaaccggagaaatccatttcaggctggagcgcaaccctggggactccaataggcgtcccgtgggtggtaaatgcacccccacacccttccctggcatcagacacccacaggatggtattttggtgcatttactgatttaagttgtgaaactctagggcctaccccatttctaccaccagctacgggactcggtgggtgcaagaggatcatgcagatctaagttcactccgtgcctcccctacacaccaggaaaacactctcagttactcacgtaggcaaaagatgggccttgctgtggttgaacaacacagtataaaacaaatgtcagcgttatttccatcacatggacatcaggggctggagaatatatgactttgatccccccaaacagcctggagtctcccagacagactggtcagctccttttccttgatactgtttcttttctctctgtttagctgcaggaatacgatcacagctcactgcagtctcaacctactgggctcaggcaatcctcctgcctcagcctcccaagtagctaagactacaggcatgcacaccaggcccagctaattctcttgatttttttttttttttttttttggtacagacagggtctcactatgtcacccaggctggtcctgaactcctgggctcagaccatcctcccaccttggcctcccaaaacacagattacaggcatgagcccccatgctcagccattccctcctttttctaatttcttagagatccagacatttcaaaggttttcataattactggggccacattaggctccttaaaacagtatccagtgagacaatgtctgagatgtgtttacgcatgcagccaaaacaagcagcacatagtaggcccttgataacgatgagttgttagaaagtattatctcctgtgtttactctttagggaaagggaaggcagtggaaactgtgtttaaactgccacacagcctctggggccattgttcccactcactatggctggaaaccaacttgccagagacaattctaggatgctgaatcttgagtttcctgcatttgtttggagaaggaaagttctccaaagccacgaccagcgcccatcctagatctccaagggcctccagacaagccggccatggtggctgccccagagtcccctctgaggacgcaaagtgacatctggaatggcgaacactggagacaccccatgccgtggtcagatctccatcctaccatcttcccacccacaaacctgcagacggaggcaccggccagtcctagcggccctaccacgtgccccctcctgtgggatagatggggcagggctgacacacgaggaggaagagaaggatgggccctagaggtgatgactctagaaacctgctcttcttttcctcccaagctcttagtcataccgtgtcatcatctgtttatttgagggattctttgacaactacatgctcttccacaggtctggaagctcagagaagagaataacagcatctctcagacttatccccaggtccccaccccaagtggttcctggcatacagtaggtgctcaatccacagttactgaatggcattgcactgaagcccacgggccgagtgataccagcatctccatcccagggacagggggacacgtggaggaatccgggaacccaaaaggtaccttaacccctgggacgttacagagattcatgaaaggagtgcttctcaatcaagggcaactgtcccaccccagggaacatctgacaatgtctagagatatttttggttgtcacaactggagggaagggggctgtcggcatctggcgggtcgaggccagggatgttgtgaaacattctacgagccacagggaagcccctccaaggaagagttatctggtccaaaatgacatcagtgccaccactgagaagccccgacgtggaggaagatctcgctatggaaggaaagggcttattctcatttcacaaaacgggcccccttctggagggatgcttctagctgagccaagaaatcacccacactcaacaggcctgctcgccaaaaagacggtccctctttgagtcttcaggggaggggtagtcagatggggcctgagttcttgcaatgatgttctgtttgtatctcggttgggctgcaagctggagaccggttggctaaatcatggcctctgattgggaactgccactcaccgtgatacttgtgtctttcttgcccttgtgggaggaggccaccacggccaggtactgaatgaccttcttggtgttttcggttttcccggctccagactcgcctctgaaagacacgggaacatcatctatgcacacgttccatggtgacctttccgcagttccatgagccaggcaggacaataatgatcatcaccaccatttcccagagggtgaaacagaggctcccagaggggaagtaacttgcccaaggccacatctctggtagtgagcggaactgggtccccagcctaggtccaatgcccaatctattccttccaagaggacatagaaaagaattcagatacaaagagtgaaaaggtgggccggatgtggtggctcatgcctgtgatcccagcacttggggaggctgaggtgggaggatcatttgagcccaggagtgtgagaccagctcagcaacacagagagacactgcctctagaaaaagatttaaaaattagccaggcatggtggcacatgcctgtagtcccagctatttgggaagttgaggcaggaggatcactcgagtccaggagttcaagaccagcctgagcaacacagcacaaccctgactctataaaaaataagaaaaattaaccaggcttggtggtgcatgcctgtagtcccagctactcaggaggctgaggtgggaggatggcttgagcccaggagtttgaggccacagtgagccatgatcacaccactgcactccagcctgggtgacagagcaagacctcatctctaaaaaaatagagtgaacaagaaaaccttagttttcttacataggtccaaacaggtttatttggaattatctacttttttttttttttttttttgagatggagtctcactctgtccccaggctggagtacagtggcacaatttcagctcactgcaagctccacctccctggttctcctgcctcagcctcccaagtagctgggactacaggcacccaccagcacactcggctaattttttgtatttttagtagagacggggtttcaccatgttagccaggatggtctcgatctcctgacctcgtgatccgcctgcagacatcattagcattgctagaaatggaaagaccaggcacaaggcagccttcaagaaaggatgtaagtgcctctggagtaccaggacctaaagtttaagaagctcccttatggaaagaaaaatttaccaaaaaaccggttatcccattggtcactgggcagatgcaagcccctttatcctctgaggaatcccaccccatgtatcaggaagctggctgatgatctcagccaagtatctaagaataaacccagttgaagtaattcacactaaagtgtaaatgactgatatgtttagatcagcacgacatggtttgtcgtatcaaaaaagtatgtcctcctggaatatgaaggtagatcttttttttttttttttttaccaagatggctttcgtgcactagctgcctgttttggccaccagaaatcatcacaatggaaccgctccatccagatactgcctctatgttccaccactcctagtgaaagataaggacagtgccttgaccaaaacttcacttgtttatcgtcttcttctatttttcagtttacttttgttttttgtgtttcctttctttgccttatctcttttattttctgagctcacttaatactctaaaatataagagagttttttttttaagttgaaaaaagaatttgttcaccccgaggtcagcccaaggttctctgtgctgaaccagtgccaccaaagctagtacagtctctgctcttcttcctaattaggaaataaagaaattaattttctctgccaaaggcccattaataacttggctcatggcttaaaaaagaaatagaagaaaagaaaaaagaaagagaaagaaaaaaaaagtgccccaaattgctgtgcctaatcctacaggtcccactgtccagaaatcaagtgtctgatggccaagaatgatgaaacatcttgcggtgactttgtgtggtcccttcccttcctagaggccttccttcccaatggccacattatttcacatggcctcagaggcagtttatgaaatggggaccatgaaggcattaccccatttccccagaaggggaaactaagaccagaatatatgtgtgtgtgtgtgtgtgtgtgtgtgtgtgtgtgtgtgtgtgtaaaagaggagaactggccaggtgcagcagagaactggccacgtttataatagcagctactcaggaggctgagttgggaggatgccttgaggccaggagtttgagagaagcctgggcaacatagcaagatcccatctcttaagacagagaagaattggcgtttgtcattggggggatatagggggaagggtccctttgctaaatgctctacatgaattatttcctttatcctcttcctgcttccatgttattatagaaggaagagtcttgcccagagtgggtaagcaattttccctaggtcacacagcaaagaagggatacagtcagaatggaaagtcaggtctctgattctaatgcagtcagaattccttttactacatttcaccaagttgttccatgacacaggcccaaccctctagggacttgctttctaaggccagaagaagggcaggggaaggggaattgatatttgttgaaggcctgcacagtactaggctttgggctcacagatcttttcatttactctacccagcaatctaatgagagagttattaattatccccatcacccatccggggaaactgaggcaaagagaggtttgaagtaaattgctccagcccacaattgctcctgctttcacacagataggaaatggaggagaagcaggatttgaacgtaggtccacttgacaccagggcccatgttctgcctcctacccttttattttaacaaatcagcaaagagaaaagacagagtgaagtcccagccccactccactggaattctgccatatattccaggaggctttacttgccccaatcaatgaaccaagccactcagtcattcacacctaagtatgaattacttcaatcaggctaacgtcagaaccttgcttgacttcattctaaagtgaaggggttggattctgattaaagcaagagaaaggagagaaatttttggatgtaggaaaccacttgcgtaggtggtcatgaacctattcagatccaagacaagaatcaggacagcagtgtgcacaaacaacatgtgtggatcacactcttcatgctgacaaaccagtgctcctagactgctgctgctcacttctcctttcccacaatagttccttcctttccaccctggccttgaacctctctcacctcctcccttttacaacaaagacatcaccgggtgtggtggctcacgcctgtcatcccggtactttgggaggctgaggcgggtggatcacttgaggtcaggagttcaagaccagcctggccaacatggtgaaaccctgtctctactaaaaatacaaaaagtagctgggcatggtggtgggtgcctgtagtcccagctacttggggagctgaggcaggagaatcccttgaacccaggaggcggagattacagtgagctgagctcgtgccactgcactccagcctgggcaatagaatgagactccatctcaaaaaacaaacaaacaaacaaacaaacagacagacaaaaaaaaaaacaaagacatcaatgtgccctatccgtggctatggtctcccactttgcctgggatggggagtgggacataaactctgggcatctaccccttcccatgttgctgctgggctccactgtttccaagttctgttgagaaaaataaattgccctgggaggttctgccaaagaaaacatcccaagctccaggctcgtgggcgtctgaaggttgatgtgcttagagctggttctagaaacattcatagcttggcttttctgacccctgacctctaggggtgaagatgccttcctggtctgagcaccctaaactcctttcttatttcttggggaatttggtactgagctccctcttcccggagaaggaccagactcatgaccacgttatggcctcctggccttgtaactaccccagtgccaagtccttttaatcagtccagccccagcagctgggaagaaccacccaatggccacttaatcccccagccaggctggcttcatgagtgtgacctgtaccgtctcacagggaccaccctgtgcttcatactctaatgttgccatctggaaattcttcctaattctttataaacgctctgcattttttttcttttctttttttttttttttttttgagactgactcttgctctattgcccaggctggagtgcagtgtgtgatggcggctcactgcaacctctacctcccaggttcaagtgattctcctgcctcaacctcccaagtagctggaactacaggtgcccgccactatgcctgggtaatttttatatttttagtagagatgggatttcaccatgttggcgaggctggcctcgaactcctgacctcatgtgatctgcccgcctcagcctcccaaagtgctgggattccaggtgtgagtcactgcactcagccagcattttcattttgcaaaattctacaaattctgcagctggtcctggctcccagggtcgaatattgccaagtccattgcagcctgtggtttgccactggtaggaaagccaaattgtctctgatgaacctcacagctattcagtccctggtctttatgtgactggcaaagcaccctggcattttgtactgtacaactcctacacgtcctgcaaaaccccaggcagaagcaacgcctctctcccctatagcatcaattggcagaatagcataatgggctccaggaccaggttgctcaagttcaaatccctcctctgccagttacctgggtgaccttaggcaagtcatttagcctctccatacctcagtttctttaccccattataaaatgggtataataaaaacacttaccttgtatgatttttttttttttttttttgagacaagatctcactctgtggcccaggctggagtgcagtgatgcaatcatagctcactgcagctgagaattcctaggctcaagtgatactcctgccccaatctcccaggtagctgggactacaggtgcacaccaccacagctggctgatttttaaattttctgtagagacaggggtctcgctatgttgctcaagctggtctcgaactcctggtctcaagtgatctctagcctcagcctcccaaagtgctgggactacaggcatgagccaccatgcctgaccttttatatgattcttatgaggattaaatgagtgaacatttatataaaatgcttagaacaatgcctggtatgccaaaatgttagttattattacttttgttttttgagacagagttttgcttcttgctcaggccggagtgcagtggcacaatcttgactcactgcaatctcgaactcctgggttcaagtgaccctcccacctcagcctcctgagtagctgggatgacaggcatgtgccactacacctagctaattttttgattttgtggggtctcgctaagttgcccaggatagtcttgaactccaggcctcaggcaatcctcctgcctcggccccctaaagtgttgggattacaggtgtgagccactgtgcccacctattattacttttataaccactgcttccacagaagttatatattgtttgtataatgattttcagcattcatcctatcattacaatataaataatattcacattttcccactgtttaagctaggagttagcaaactctttttgtaaaaggtcagacagtaaatattttagactttgagggtcacgcattctttgtcacatctgctcagctctccactgcagcacaaaagcaaatacgtaaacaagtgggtgcggctgtgtttcaataaaactttatctggaacagacagacaagggcctgatttgacccactggttaaactttgtccttccttggcttgagtcccttagcacgttctcatccatttcatttatttattttattgttatatatattttttgagatggggtctcactgtgtcacccaggctgaagtgcagtggtgcagtcttggctcagtgccaactttctgcctcccaggctcagtgaaccgagatcctcctgcctcatcctcctaagtagctgggactacaggcacatgccatcacgctcagctaatttttgtttttgtagagagggggtttggccatgttggccaggctggtcttgaactcctgagctcaagcgatcagcctgccttggcctcccgaagtgctaggattacaggcatgagccaccatgcccagcctgtcatccattttagacgaaagtttaaactcctccccagggcctggaagcacccccttacctctctctaattttatgtgaaaccaccctcctcctcttactttagccccctgatcacacagctctatctccagccaggcccatggcctctaattaaactgattatactggatggattacatgctagacaaaatacaactcaggcctaaaaattacatttattcagctttcagtttccttcctttcttgtcttccttcccttcctttccttccttcctgtctctgggtcttgctctgttgcccaggctgaggtgcagtggtgccatcatagctcacttagcctctaactcccaagctcaagtgatcctccctccccaacctcctgagtagctgggactacaggcatgcaccatcccacctagctaatttttaaattttttgtagtaatggggtcttactgtgttcctcagtttggtctcaaacttctggcttccagccaccctcccgcctcggcctctcaaggccctgagtttccaggcataagccaccacacccagccaattttcagtttcttttcttttcttttttttttttttttttttttgagacagagtctcgctctgtcacccaggctggagtgcactggcgtgatctcagctcactgcaagctccgccccccaggttcacgccattctcctgcctcagcctcctgaatagctgggactacaggcacccgccaccatgcccggctaatttttttgtattttttttagtagagatggggtttcaccgtgttagccaggatggtctcgaactcctgacctcgtgatccacccgcctcggcctcccaaagtgctgggattacaggcgtgagccacggtgcgtggccaattttcagtttcttttcttttcttttttttttttttttgagacagagtctcgctctgtcacccaggctggagtgcagtggtgcgatctctgctaactgcaagccccgccccccaggttcacaccattctcctgcctcagcctcctgaatagctgggactacaggcacccgccaccatgcccagctaatttttttgtatttttttagtagagatggggtttcaccgtgttagccaggatggtctcgaactcctgacctcgtgatccgcccgcctcggcctcccaaagtgctgggattacaggcctgagccacagtgcgcggccaattttcagtttcttaactgcataaccaaacagttggctccagcctggcttctcttaagcaccaactacgcgtaaaagctcagccctgctgtcaacttgtaggtccttcaagtcactttggctgaatttcacaacaagcaaaataaaattgaatacagagactgaagatgttggtggttctgggctgactggatgcatttgcaaataaaagtctgatcgttttgggatttccttcctaacaatggctaaggcctccttctccagcactggctgtgtgtgggcagtgtgccaagtccttgctaacgctgcattccaggagatggagatacacaatagccaagtaaacaaataatcaagatagttcgtggtggagatatcattgctacatctgggtgatgtgactgagaagatcgaggggaagggaggagaggggaggctgtggatggggaagccagggagttgctgagccttgaaagttacaagagagccctgtgggaaggatggagggaagggtgggccaggcagggcaaacagtatggacagaggtccaagggagggaaatgctgggcccaggtatgagacagaatggctcccagcatggctggagggccacaacagaggaggacagcaggaagtgaagagggaagagcagatcacactcagtcttccaagtcacagtaaggaatctgagttttattctcatgggtgcaggaaaccatttcacgaggggaacgggactttagaaccagtgtggggagaatcagaactgcaggatgggctgggcgaagtggctcatgcctgtaatcccagcactttgggaggctgactgaggtgggtggatcacctgagatcaggagtttgagaccaggctggccaacatggagaaaacccatctctattaacaatacaaaaattagctgggcatgatggcataatactcgggaagctgaggcaggagaattgcttgaacccaggaggcgggggttgcagtgagccaagatcgcaccactgcactccagcctgggcaacagagtgagactctgtctcaacaaaaaaatcaacaacaacaacaaactgcaggatgggccaggctcagcggctcatgcctgtaatcccagcacttgggaggccgaggctccccgggtcacctgaggtcaggagttcgagaccagcctgaccaacatgacaaaaccctgtctctactaaaaatacaaaattagccaggcatggtggtacatgcctgttatcccagctactcgggaggctgaggcaggagaatcacttgaacctgggaggtggaggttgctgtgagccaagatcacgccattgcactctagcctgggcaatgagagcaaaactccatctcaaaaacaaacaaacaaacaaacaaacaaactgcaagatggatactggattgcaggaaggatttttaaaaaatagtgagcactttcactacaatagcagctgatccttacaaagtgctcaccatggggcagtggcctgtttctcagttcttcacatgtagtgactcatttcatccttccaacaacccaatggggtgcttattgttcccattttacagatggggaaactgaggctcagagaagtgaactgacttatttcctggagcatacaactaactagacgatgatggggccagaattcaaacccaaggggttaggttctggaatccacactttatgacagcatgctaatgaatatttattcaatgaataatgagtgaatattcttataatgtatatttattaaaggaaggaagcaagcaagcaatgggagcagggagcttaagagactgctacagaggccctggtgagaggtgacgggaccctgaactaggaagaggcggtggagtcagaggaatggacagagatgagaaatatttcagcatcataccgtccaaggcaggaaccgctatctaaattaactaaaatcttaaaaattcagttctgcaatatacttgccactttttaagagctcaattaagtgaacttttaagtgaactttgtgctcatcacaaagttcttttggatagcaccgttttagatgaaacagcacctgctgatggcatgggtgctggaaatgagagcagggtggcctcttcttcatcttcacagcctctccataagctcagctcagagaggtcaagtgacccgtgcatagctacatagctaggaagccatctgaaagtcctactctttcctgcacctctctgttaccacacttaattcattcactcaacagagggcagttgagctacactattttggttcctggggagatgacatgtggctcacacatgggtttggctcctaggggatcaaatgcctctgtggctagctgaaaaacagcccccacaagaatgtccatggcctatcctcagaatctgtgaatatgtttgcttgagatgaggagactgtcttggatcatctaggtggggctaatataaccacaaaggtactgggccttataagagagaggtagggggaccagagaaagagatttgaagataccatgctgcaggatttaaagatggaggaagagaccatgagccaaggaatgcaggtgacccctagaagccagaaaactaggaaaccaagtcggcaggttgttttagcatttatatcctcatagctaggtagcattatatctctagatccagactattcattgtcaaacatcaaatgtgtacatcctaccatggaatatgagaattcagttcccatctaatcctcttccctttccccacagagccaagtccatcacagggagttattctggttagataaatactccaaacttgcacagctgggctccttagtccaatgtgattacttctccttccatcccaacttttgttttttcctggagtttataattgcctttgttttattgtttccaggttttctatctatatcaaccccaaacttattaattgtttcaatcttctctcaatacagttcattgccatcctaccatccatcaccatctgaaattctaattactagtttttaattgtccttccagataatttcatgcaaataggaaacatatgcacgtccatgcaatcctgctctttttaaagacacacacggttacattatgcatatgctggtttgcccctgtgttttccactcaacggtattatctataaagagcgttctctctcagcataaatagatcagcctcactctttgtagtggctacctggaaatgctatattttatttaaataacctctgttgattatagctttagttgcttccagaccttcaaatatatatatatataaatataaatatattaaatataatacatattatatattatgtaaatatatatatgcacagtctatcctcattatttatatattctatattttcaaattcaccgacctgctgaaagttatttgtaaccccaaaatcaatattcatggcacttttgtagtcatttgtgaacatgtgcagagtaaggaaaattcgattcccccaatgcacacgttcccagctcaggttgaacaggggaatgctctaccttctagtttcaactctcatactgtaaacaagtgtcctttctgtagtgtatttagtgccacctttttttgtatttttgtggctttttgttagttattttgcagtttaaaatgtcccctcagatgtgctcccttcggcagcacacatacaaaaatgtccccagcatagtgctcaagtgttggctcatgtttccaagcacaataaagttgtgatacccattatgtaataaatacacatcagataaacttcatccaggcatcagccacagagctgctggctgtgagttcaatgtcaatgaatcaacaatatatattaatatatgttacttgcatataaatacaatagtgaaaactctctcaatgattctaaaattgagttactatcttctgcctatgtacctaggtcttcaaagaaacagtgataccaatcaccaaatatggcactgatgtgtttgtggcttgataaatgtgaaatactaaagtgacagtttaacatcttccctatcaacacagatggctgttatgcaattagataagattctgcatataaaatctttagttcaagtcctggcacagagtacatgttcaataaatgctagttttttagaaggaggagaggtatggaaccaaatgatagcaggtgtcattaagagtttaagtttgcctgcctccgcagaagaccatatatcacaaatgtttagtgagcatctacatggtgccaggtataaagagaggcacttggaaccatgaacaaatcaaagatctctgcactcatggatcttttctttcataggttggatctcgactacagattaaaaaaaaaaaaaaacaaaaaaaaaacagaagaaaaagcagttccacttacgtgcatagaatggactggtcctcccgatctgcaaacagaaagaagaaaaaagagccatgaattaaaatgagctctgagctaagggtctggacttggctcctcccagggccctcccattctaaagcttctccatgctggcctcattggaagtgacaacaggtcagctgggctcattgcccaggctacaggggccacgaccaaagccaaaagggcagccccaaagtcccagaggcagccccagaaagatgctggagcctgactgatccaggagtcattagcatccagccacatcagctctggaggtgtcccgggaggcccaccccacccagattaggttagggaccaaacgcagatgttggatctatacagattggggtcccccttagccacttctccgctctgtggccttgggcaaatattcttaaactccatgcctcagttccttcatctgtaatatagtattgtgcacatttgtgtttttttgtaaatccagcatccatttcctcttcttccagaagcatcctgtggtccttgaggtttcccccatcacccctaccgtcatgtacagtcttagtgggactgcctcataagtaccttcaacaaagaggtaagaatgtgttccaggctgcattggtcagactctctggcctaaaactccaagctcagtcaaggacagggaagcacagcaggtggacagagccctgaggcagacttcctttctgcccctgggcccaagcagcccagtttctgtcatttacctagcctgattcctagtgttcccactgcaactgtgagctcctccatactcccctacaaatccctttcctctactagatgacagagtcagtctctcttgtttaccaccagagaaacccaaaagatacagaggtcatcaaagaactagatgtgattaagcagacattatccatcaccttctactcttaaagaggcctctgaggtggagccaggctctgaagacccatttccttcccaaagagagatctgagaacagttaccaatacgttcaatggtcacctaacaatgtagaaatcccagcatcatatctgctggtagacaatgccacagtggcaagcatttcttaaatccactccctggcttcagtcctactagttcagtgctcagctctcacaagcttcatttcatcaaaaatctcctaggcttggttttacattgtatctctagtactggcacatagatggtaggtgctgaattatgcttgttagatggatggattgagggatggatgagtagatggatgggaagatgagtggacggaaggaaggaagaaaggaaggaagggtagatgggtgaatggaagggtgggtagatgggtaggtagatggatgggtgggtgggtggatgaatagacagatggacgggagggtggataagcagatgagtaggtgagtaggtgggtgggtggatgggcagatgggtgggaaaatggatggatagatgagtagatggatgggaggatggaagaagaggtggatgggcaagtgagtggaaggaaggaagaaaggaaagaaggaaggaagaaaggatgggtggatggaagaatggatggataggtaaatggacgggaggataaatggatgggaggctgggtgaataggcagacagatggctggatggaaggatggatagatggacaggtagagagacaggaagacaaatggatgagtgggtgggtgggtaggtggacgaatagatggatggaaagaaggaaggatggatggatagataggaagaaagaaagaagaaaggagggaagggtgtgtagatgggtagatgggtgggtatatagctggttggacggatggttggacggaggagggaaggatgagtgagtggatgagagagtggatgggtgggtgaatgggagggaggacagagtgtataggccggtaaatgagttggatggatggatggatggatggatggatggatggatggatggatgggaatatgaatgggaggatggatgggactgaagaaggcaaggtgaaagagatgactctttcttccatctgtaatcttaagagagaactgattggatgtgggcacgttcctcagattctatgcccaactccaatcagttctctctctcttccctcggattatagatggatgtttgggtggcctggttgaacgaaatcctcaagacaaaaggcctaaagactagtcagctctggggtttcaattctggtgtgtttatataatggcacatttaaaaataggcaggccgggcgcagtggctcatgcctgtaatctcaccactttgggaggccaaggagggtggatcacttgagttcaggagttccagaccagcctggctaacatggtgaaaccccatctccactaaaaatacaaaaattagttgggtgtcatggcacacgcttgtaatcccagctactcagaaggctgaggcaggaaaattgcttgaactcaggaggcggacgttgcagtgagccgagatcgtgccactgcatgccaggctgggcaacagagcaagactctgtttcaaaaacaaataagatataaatacataaataaaataggcagccattgaaaagaaccaggcagagctttgtggatggacacagaaaaatatccaaaatatattaagctaaaaataaaagatgaggtagcatagtgttataccttttgtgttttaaaaagacagatatataggtaggatgcagtggttcatgcctgtaatctcaacactttgggaggctgagatgggaggatcacttgaggccaggagttccagaccagcctggacaacatagcaagacccagtctctacaaaaaaaaatttttttttaattagctatgtgtgatagacataccccttgtcccagctacttgggaggctgagacagtaggatcccttgagccaaggagttcaaggttgcagtgagctgtgattacaccactgcactccagcctgggcaatggagtgagaccctatctctaaaaacagacctgggatgggtgcggtggctcacacttgtaatcccagcacttcggaaggctgaggcgggcagatcacttgaggtcaggagttcaagaccagcctggccaacatggtgaaacgctgtctctactaaaaatacaaaaattagctgggcatggtagcatgcacctgtaatccaaggtactccggaggctgaggcaggagaatcacttcaacccaggaggtggaggttgcagtgaggtgagatcatgccactacactccagcctgggcaacagagcgagactccaaaaacaaaacaaaacaaacaaaaaaaaccaacaaacaggcctgagcctgaagtattgagaaaagggacaggaggaagacctactttcacccattctacttctatcctggttatgtttgtgctatgaacacatacaatcttttcctcatcccaccaaaaatggtcaatagaaaaagagtcggtattgttctttatgaaaccatcatgaccacaaagctaaaaaaagacagaaaagaaagagccaccgcattaggatcccactaacagctccgatctcccgagcactcactgcactgcaggcgtatgctgaacttctgtgttgaagtgacccactgaattctctcagcagctcctggggtgggcactggcattgcctccattttacaaataaggagagtgaggttcagaagtgaggcaacttgcccaaggtcactagggtgggttgaactgtgactcccaaaagctatgttcactcagaacctcagactgcgatgttattgactaaccaattgattgagatggggtctcactttgtcgcccaggtgggtgtacagtggcgtgatctcagctcactgcaacctcaacctcccaggctcaagcaatcctccctcttcggcctcccctgtagctgggactataggcacatgccagcatgcccggctaatttttgtattttttgtagagattgggtcttgctatgttgcccaggctggtttcacactcttgggctcaagtgacccacctgcctcagcctcccaaagtgctgggattacaggcgtgagccactgtatcccacctgtgattttatttagaataagggtcttgcagatgtaattaagggaaggatgttgagatgaggtcatcctggcttggagtgagacctaaatcaatggtgtccctatttataagagaaaggaggccgggcgtggtggctcacacctgtaatcccagcacgtgggtggatcacctgaggtcaggagttcgagaccagcctgggcaacatggtgaaacccatctctactaaaaatacaaaaaattagccaggcatggcggcaggcacctgtagtcccagctactcgggaggctaaggcaggagaatcacttgaacccaggaggtggaggttgcagtgagttgagattttgccactgcactccagcctgggcaacagagcaagaccccatctcaaagaaaaaaaaagcaggaaaaaagcaatcaaactttaatctctccattatactctggagacagacagatacccgtgcctttagcttccacccagggggagaaattcactcgaggacagagcaaaatgggaaaccagtttaattttttttttttttctgaaatggagtctcgctctgtcacccaggctggagtgcagtggctcgatcttggctcactgcaacctctgcctcctggtttcaagcaattcttccacctcggccccccgagtagctgggactacaggtgcgtgccaccacgcctggctaatttttctattttttgtagagacggggtttcaccatgttggccaggctggtctcgaactcctgacctcaggtgatccgcccgcctcagcctcccaaagtactaaaaagtgattttttaaaagagggtgaaggatagaagaaccaggtaccctgtgattagaacccagacagagagaacctcctgggaccggcccagacaacctccactatcttaaggaaagattttgagatggacagacagatgggctgtgttgatccactacttcagggagagaggcaggctttcctggcagccttgtgaatcctaggcccagagcaggagagatttataggctcagatgctcacagggcccccaggagagggagcgggctccaggagaaggcctgggagctgccagcgcggctccgagctgggggctgctgggagacctctggcctgacgttcccatcaaaaacacaccacttccaggcgtgggaagcttgcagggtgctggttacgagcagaaggactccatgtgggtgctgtctgccaacccgtgtggagcacagggaactctgagatcctggaaatttttatctgattccttccccaagcctgagcttgtgttggactcaaaagcagtgttctccaccgtacaaagcagtttcactccctccttgctttgcacaagtgatttcttctgcccagtgcacccaccaccacttcttctctggcctaatccattctctctctctctctcttttttccttccattgaggtaaaatttacactacataaaaagaaccattttaaagtgaataattcaagccaggtgcggtggcttatgcctgtaatcccagcactttgggaggccgacacagctggatctcctaaagtcgggagtttgagaccaacacggcaaaaccccgtctctaccaaaaatacaaaaattagctgggcgcggtggtgcacacctgtaatcccagctactcaggaggctgaggcaggagaatcgcgtgaaccagggaggtggagtttgcagtgagctgagatcgcgccactgcactccagcctgggtgacagagggagactccatctcaaaaaatagtaataaagataaaaaaataactaaagtgcataattcaggagcatttagtacattcacaatgttacgtaactaccacctttatctagttctaaaatattctgtcacccccaaatgaaaccctctacccgttaagcagccactcccccataagcccttgcaaccgccaatttgctttctgtctctatggtcttacctattctagatatttttgcataaatggaattataacatgtgcggcctttcatgtctgacttctttcactcagcatgtggctgaagttcatccatgttgtagcaggtcccagactttatgcctatttgtggctgagtcatatcacattgtacggatggatcatattttgtttatccattcaacagttgacggacatttgggttatttccaccttttggctattctgcatagtgctgctatgaacattcctgtacaagttttagtttgagtaccttttcaattcttcgggtacataccctaatctgtatctgaaacatcgtcttgggagtcaactcttctatgataccttctctaactctgcacttttctagagctgagttggagacctttccacttgacctcctacctgcaggatggccatggaccgtggtgcatgttgtacactgcataactctatggagaaactatttgcattggtcatttattgtattgcattgtgtatttattgtaataatctttcagcagatggaggaaaagtgctttgagaaaacggtgcctttctctaatataaacatgagtgtcacatggcctagtggttcccatggtccacaggttctctccattttagtaattatcatcattgtgatccttacttaataaatgtctcaaaacattctggcggaaaaaggtacagatgatatggaatgataataggccatctatccatgatatggcattcagagtttttcttgtttttcttttccatattggtaaaaattatggactttattcataatatccaaaaaatagaaacaaccaaatgttcatcaatgggtagatggataaacaaaatgtggtctacccagacagtgggatagtattcagccatgaaaagaaaggatgttatggccggcggccatggctcatgcctgaaattccagcactttgggaagctgaggcaggtggattgcttgagcccgggagtccgaaaccagcctgggcaacatggtgaaaccctatctctacaaaaaaaaatgcaaacattagctgggcatagtggcacaatccctgtggtctcagctactcaagaggctgaggtgggacaatggcttgagcccaggaggtggaggttgtagtaagccacgactgcaccacggtactccagctggggtgacagagacagaccctgtcttaaaaaatatataaatagtatgaatccatgatacaacgtggatgaaccttgacaacattatactaagtgaaagaagctagccggctgggcacggtggctcacacctgtaatcccagcactttgggaggctgaggtgggcagatcacgaggtcaggagttcaagaccagcctggccaatacagtgaaaccccgtctctactaaaaatacaaaaattagccaggtgtggtggcacgtgcctatagtcccagctactcgggaggctgaggcaggagaatcacttgaacccaggaggcagagtttgtggtgagccgagaccacatcactgcactccagcccgggcgagtgcagtgagacactctgtctcaaaaaaaaaaaaaaaaaaaaaaaaaaaaaaaaaaaagaagccagccacaaaaggtcacatatgattccatttatatgaaatgtccagaataggcaaatccatagagacagaaagtagatttgtgaattcgtggctgccaggagctgcgggtaggaatatggagtgacaaaaaaatgtgcacaagatttctttgggggatgatagaaatataaaattatattgcagcaatggctgcataaccatgtaaattatgagtgaatttagacagttatgcagacatagctgcaattttaggtgtgaactgtatccttaaaatgaatttatttaaattataccgcataaaccttttttaaaaatgatgttcattttataccacctctgaatgattataaatctgacttcttccacttcatgcagctctattaggtttccaacaattacaaaattgttcattttcaatgcttttcccctgaaccaatgagctcctgaaggtacaaggaacaatgcctgacacacagtaggtgctcaggaaatgcttgttattttgaattgctctctggctcagagaggcaaccaaggtagaagcaatggaaaatgcatattcacgtgttcacatattcattcaacaaacgagtcctgagccaggtaccgaaagcacaaaagtcaataagatctgcttttttttttcttttcttttttaagagatgaggtgtcactctgatgcccaggctgaagtgcagtagcacgatcatagctaactgcagtctggaactcctgggctaacagatccttccatctcagcctcctgagcagctgggactacaggtgcatgccactacgcctggctaatggtttttttgttttttgttttcattttttttgtagagacagggcctagtaaggtaacttagtaatattacccaggctggtcccaaactcctggcctcaagtgatcctcccgccttggcctcccaagtaactgaaatcacaggctcaagccaatgcaccgagcttcatgacttgcttatccttgcttttgagaagttcatgacccagggtgggagtcagatgggcaaagaaatgaccgtaagagatgagcagtgctacgatggatgtgaacccaagtgctatagacgtcaggttttttgtttgtttgttttttcacactgacctgagcaagacaggaagccttcacggcagaggtgaccactgaacagcattaagaaaaatgtgaaagaatctcctggggagaggtcgaggcagagcatcccaagcagagggcctgggacagaagctccaaagtgggcggggacacagtaccgagcctccgtggagtctgggaaggctggagctgggggcggccggccatcatcaggacccgcctggggctgagcttcccagcccagatccctggggctcatgtcacctcacaccccatccttaaacatgcctctctcccttcctcctccccagactccccacccagcctcggatgtgtaaggccccaggcacgtttcctgagaagataaagggcttcagcggttcctcccccgctgtgggcctgaggactcccaggaggtacccagctccccacagaccagctatttcggcccaagcccaaacacaagctggtggattctgtctgggaagccagagcactgtaggctgaccataaaaggagaaaacccagcggggactgagcacagacccaggctccctgcgtctgcccttctttctggtaacaggctgctgggggatccagtgagaggtaatcaaaacccgtctctgcagggccatcaatacccctgggctagtaaagaagaaaggtctcagcctccattgcctgcagaaaagtggctctctacctaatgccccgcacggaggcagatgccagaggttctggatcttctgtggtgtgactgtgaaggtggccactgcatggcccttgacggtgggtcctcggcagctgactgctaatgcctgttgaacttgtcctgtccatgcaccgtgtccctacacactgaccgaatcacccttgtaacaactggagtaagcacagtcatcatcctcacgggacaagtgaggaaactgaggcacaaagtaatagccggggcagagctgggaggtgaacccagctccagagcccatgacctaagccattctgtaagtgagggcccttctctttctccagccttcatctccccactctactctcccggcagagttggttaggatgacatgctgagtaagaagagatactttgagagcctttgctgcaacccaacaggtgttttccaaacctacaggaagccctggtattgtaaaagcagaactgggctgggcataggagctcatgcctgtaatcccagtgctttgggaggctgaggcagaaggattgcttgaggcgaggagtttgagactcaaagcgagacccctatctctatgaaaaaaaaattttttttaattagctgtggacagaggtgtgtgcctgtagccccagctatttggaaggctgaggcaggaaaattgcttgagcctaggagttcgaggttacagggagctattattgtgccactgcgctctagcttgggtgaaagagtgaaactctgtctcaaaaaatatataataaataaaaacatgaaagcagaactggccagtgaaggggtgtaggagacaggaaaaccaacgctctccctcttgggcctccactcctacctcctacattctcccccttctctctgctccagccccagcagcctcatagaacctatatcaagttccctagccaagcctacacttcaccttccaaggaagcctcccctgtcctcccaaggtccccagggctacacttccccactctctggacctcctctacttagcagctacttgtgggatgattcaattcgtatttacacatacgcacagtaggctgtgtctagggcaacatctaataatcaatattgttagaatgaccgggcgtggtggatcacatctgtaattccagcactttgggagaccgaggcgggaggattgcttgaggccaggagttcgagaccagcctgggcaacataatgagacctcatctctacaaaaaatcaaaaaattagccaggcgtgatgatctgtgcctgtggtcccagctacttgggaggctgagaggggaggatcacttgagcccaggagttggaggctggagtgagctatgagtgtgccactccactccagcctgggcaacagggcaaggccttgtctcacaaaaaaatgctgttggataaagaaaggaatggggagccagactgcccagaggctgggaggacaccgagggaggtggctgacacatgcaatttaacaaggaaggtgctggccaggcactgtgggtcacgcctataatcccagcactttgggaggccgaggtaggtggattgcttgggctcaggagttcaaggccagcctgaacaacatagcaaaacctcatctctacaaaaaatacaaaaattagccagttgtactggtgcatgcctgtatgcagctactctggaggctgaggtgggaggatcacctgagcctggagaggctgaggctcaggtgagccgagatcacaccactacactccagcctgggcaacagagtgagactctgtctcaaaaaagcccaaaacaaacaaggaaggtgttgccaagtgtcagctggggcttttcaggttcactcccttaagtatgtccctttttcaatttaatatttacggtttttgtttttgtttttgtttttttttgagacggagttttgctcttgttgcccaggctggagtgcagtggggcaatctcggctcactgcaacctctacctcccaggttcaagcgattctcctgcctcagcctcccgagtagctgggattatagtcgcccaccaccatgcctggctaattttttgtatttttagtagagatggggtttcactacattggccaggctggtctcgaactcctgacctcagatgatctgcctgcctctgcctcccaaagtgctgagattacaggtgtgaaccactgtgcctggccaatatttactattttataacaaataattctcctttgctgtctcccttccctgtaatgcaccatgggtaccaaaaataaaaataaaataaagataaaaacgtgaacttttcatgattagtcagagcaccaaacagacactcctagcacctctgtaaagactgagccagccagacagagccattcattcccacacacagtcccccatcattcccaaccgggccagacacatagctgacagccactgcaaaacccacaagagacagagaagcatttggctgtaccccttcctggagatgtgtttgtagcagcactgcctctgcagagaaacagctgggaattacttcttggctccaccctatcacctctgcccccagggcccgtttcctcaccagggaaatcgacaaaaatccagacctttcaagggcatgaagatgattgaaagagactggattcagaaagagcttaaaattgttttacccacagcacatttaagagcttggtaattgccgttaatatcatctttatcatcatcatctaaaacagtgatctagggaagaggttatagacagcagtgattctgaatcggcaggacaggatattcaaccaaagatatttaacccctttctgattacaaggtgtcatggtctgaatgctcatgtctccctcaaattcatatgctggaatccttacccctaaagtgatgatattaggaggtggggcctttgggaggtgatgagatcatgggggttcaatcctcattgggggagagacccagagagctagcaggtcccttccaccatgtgagacacagcgagaaggcagcactaggccctcaccagataccaagcttgatcttggacttcccagcctccagaaccacgagaaacaaatatctgtttaaaagccacccagtctatggtattttgatatagcagccttaacaggctaagacacaaggcctatgctagtcccttagccttctgggggcctcagtttcctcttccgttatatggggacaagaatactacactatctataccacgctacccaggagggaagagtaacattctgagggcagcgaagctgggtccccaggtttgactctcagttctggggccaagtaggtgtgctgagttttccccattgatcaaatggggaggctgccacccaccctgtgtggtgctagtgagggccgagcaatgtgggattgatggagcagtgaacccaggtcctgacctattgcaggggccctgaggacatcagtgcccttcctctctctgcctctactggggagcagcctcaggggagttgggtgagcaggaaccatccccagggggctgccaatctcaagcagaaggatacagccgagtgtgggaacttgcaaagtggagaaagtcgtttggatcactccacccgcagagttgtcttaagcttaaagaggaattagccaagagccccaagctgataaaggctggctgttatttctttttttaatcccctgagtgtggccatttgttgctaatgaggtgaggacaaaacattacttgtggctatcttgcatagggcaagtgcagaggctcagaatggaatcttatctgctttcctgcccctcctacaccccagggacccatggaggggctccaaagtggttcttgtctggagggctttaatggcgcttttctcctattcatcacgttcatttattgaacttagctccagcctcctaagctttgagctgtcaacactctgagatgaagacagtagacagccttccgtgggattgagggggatccctgtggttgcccggtgtcaccgactgaccagcagggctccggctttggagtcaggataatccaagtgtatatttggctctgacacttaacaaatctgcagcaagttctccactcctctgagtctgttttcccagctgtaaaagggagctaataatagctcttgcggctagcgttggatcacccaataaaccttgtaagcatatgctgagggcacacccacacaggcatgcacgagaaggaagaatgccatagttgccatttcataagcaccacgaagataaacatcatgggaaaaatagcaactttaggctgggcacggtggctcatacccataatcccagcactttgggaggtcaaggcaggaggatcacttgaggccaggaatgagagaccagcctgggcaacacagtaagatcttatctctaaaaaaaaaaaaaaaaaaaaaaaaaaaaaaagttttttcactaggcacagtgggctcacacctgtaatcccagcactttgagaagcctaggcaggtggatcacttgagctcaggagttcaagaccagcctgggcaacatggtgaaatcccgtctccacaaaaaatacaaaaattagccgggtgtggtggtgcatggctgcagtcccagctacttggggagctgaggtgagaagatcactggagcctaggaggtcaagcctgcagtgagccgtgtttgtgccactgcactctagcctgggtgacaaagtgagaacctgtctcaaaaataaaaaagactgggcacggtggctcatgcctgtaatcccagcactttggaaggccaaggtgggtggatcacctgaggtcaggagttcaagaccagtctggtcaacacggtgaaacaccatctctactaaaagtacaaaaattagctgggcatggtggcatgtgcctgtaatcccagctactcaggaggctgaggcaggagaatcacttgaacccaggaggtggaggttgcagtgagctgagatcgtgccattgcactccagcctgggtgacaggggtgaaactctgtctcaaaacaaacaaacaaaaaacagttgtttttttttaattagctgagcatggtggtacatctctgtagtctcagctacttgggaagctgaggcaggattgctgaacccaggagtttgaggctgcagtgagttacaatcgcaccattacactccagcctgggcaacagagcaagaccctgtctctaaaaaaagcaaaaacaaaaacaattttgtcagccttctttactttataatttaatttttttttatgacatatgcctgcaccttaatagtttcagggcttaattttaaaattcctaatctggtcctgtccaccttgtaggtttgtggtaaagattaactgagaatatttctgtaaagccctgagctttataggaagcatataataaaaatccatgattattattatcacttctttgtaaaagaaggcatgagagaattcccatgagaagatggtaggctgagtgcatgcatttagctctcttccttcctaaaccttactaaaataactgtaaaagactttccaaaaatacatgaaccagtttagccgggcatggtggctcatgcctggaatcccagctcttaggaaggcacaggcatgaggaaagctggagcccaggagttcaagacctgcctggaaaatataacaagaccccattctccacacaaaagaggggggaaaaggcaaaaaaaaaaaagtgtaaaaaggccgggcgtggtggttcacgcctgtaatcccagcactttgggaggctgaggtgagtggatcacctgaggtcaggagctcgagacgagcctggccaacccgtctctactaaaaatacagaaattagctgggcatggtggcatgcacctgtaatcccagctactcaggaggctgaggctgcagaatcgcttgatcctgggaggtggaggctgcagtgagcagagatcgtgcactccagcttgcgcgacaagagggaaactccatcccccaaaaaaaaacaaacaaaccaaaaagtgtaaaaatacatgaggcagtttaaaaagaactagagaggggagaacagcaaagccatcttggaagacagaaaatgggataagcgttgaaaagtaccaagaaaaagtccagacaccgtggctcacgcctgtaatcccagcactttgggaggccgagttgggtggatcacctaaggtcgggagttcaagaccagcctgaccaacatggttgaaccccatctctatttaaaatacaaaaattagccgggtgtggtggcggatgcctgtaatcccagctacttgggaggctgaggcaggagaatcacttgaacccgggaggtggaggttgcagtgagccaagatcatgccattgcactccagcctggacaacgagagtgaaactccatctcaaaaaaaaaaaaaaaaaaaaaaaaaaaaaaaggtaccaagaaaaaagtctaggtgagcagtgaggaaaggtgggaaacgacctaatttcaacaccgaattccccatttctgccccaaacctcagaaactggcaatgccaggggcctctggaagaaaagatcaaggaggagacaaaaacataaggactgggtcaaatataaggcactgttagacccctcccatatcttctacactccctgaagccaagtgactgcccttctcacaccccacagaaggtggtgggtttagtctctggtgagggttaaacagagggtctccgtcctggggggacaccaggaaccatactgaaagaaggaaggtataatgtacaaatttcactgcacattttgaaaccctcagcttcttttcaactagaccctcaaaatgatgctagacaaatctttaacctccaggcagaagatttttctacaaaccttctctgaagaatcagattagcccatgaacaaaagactgaaagacgaaacagaagtgtcctaatggggtagcccagtgctttcatattatagccaagcacatcagcaagcccatcctataagcactgagcttccatcaacaatttggtatcctgtgtactaaagcatccaagatgaatggatagccaagaatcccaagacatctgaagaaatccactaatatgacagacagaagttaaaacaattaggaaaatatgtatcttggaggaaatagactctgcattaaatatcctctgagaaacaggatattgcaaccacagaaaaagaatgtcatatgaaagaaacatttaaaaataaaatagaatttttggaatttaataaaatatataccagaaatttaaaacgcaatggaagggttagggaaaaaagttgaggtaagtgcccagaaaataccattaaaaacattaaagtgatgaaaatgacaaaagaaagagatttaaattataggattggtctaggaattccattatggaaataaaaagacttctaagaaaaagaaacagagaacacagggagaaagacagcatcaatgaaataatttgcaacatttcccagaatttgtggacacacgtttatagattaattgggccactaagtgtccaggataacaaataaaaatggactcatagcaagtcccatcatcctgaataggggtacaaagacagtctaaaagcttctagagaaggaggaaaaacaaaaactggtcatgtacaaaggatcaagaatattcccagccaggaaggtgaatataatcacacacacacacactcacaaacatacacacatacgaatcagattgggtttcatcttctcaaaactgaaactagaaggcaacaacacaaatgccttaaaaagctcaggcaaaaaaagttatttataactttctgaaaacaactttcttgcctgaaattttaaacccaactaaactatcctttaagtgttagagaagcatcaagcctctcagatatggaagttctcaatgcctcaagatcacgtacattctttcttgggaagctactggacaaagtgcttgatttaagcaggagagtaaagcaagaaagaggaagacatgaaaactgggaaacaaggaatccactatgaaagcactaaggggaatttcaaggatggtgaaaaagatcctatatgacagttactagctatagagaaagccagggcagatcagaaggctatagtagagatcacattcaaggagatgatatcaatatgatatccaatacatgtctggacatattaaaaggagattaacacatttagaaagagattttggggcagaattggtggttaaatacatggaaaacaagattggggaaaaaaaaggcaattgctaactccaggaaaaagaaaagtcatacagaaagaagaaaaatagtcacaaagcagtgcaaagctcagctttgaataacatctacataatcataataatgtaaactctagatagcattacatagtcataataatggaaactctgaacactgagtttgtcaaaactaagataaaattatactgggactctgatatgaggcatgtgtgttggaacgaggaaataggggcaaatccagagggtgaatgagctaaatttcatctttcatggaggaaagtcaatagatgatacctaaaattgaaaacaaaattaagatagcagcacaatgatcaagtgttgttttcagagatatggtggtaaataccaaaaaaaaaaaaaatcaattaaaggagttgagaagtagcagaggatggctatttttcttaataagccttcaaaaattacttgactctaagccgtctgcatgaatacttttaacaaaaataaaaaccaattttttaaaaaagggaacaaggaattcctacatgcactgatatgtaacatcctctggcaaaatataggactgtatatatatggaatgctagtatttgtagggaaatcttagggaagaaaatagatacctatttgcttatacttgcaaaaatatctctaggagaaaacctcatacactagaaaccataattgtctcttgggagggaagctaagggtctaatgcacaagggttgaagggagaagttcaccttttgaatttgtatgtaacatctttccaaaaacaaaccacggccgggcgcagtggctcatgcctgtaatctcagcactttgggaggttgaggcgggcagatcacctgaggtcaggagtttgaaaccagcctggccaacatggcaaaaccccatctctactaaaaatacaaaaattagccaggcatggtggtgtgtgcctgtagtcccagctactcaggaggctgaggcacaagaattgcttgaacccaggagacagaggttgcagtgagcagaaatcataccactgagctgagatcgtgctgctgcactccagcctgggtggcagggcgagactctgcctcaaaaaaaaagggggggagaatttaaaaaataaacatgacataatttatgcatatgcagatataagatacatattttaaatatcagcttctcttcccataccctcaaggggcttggcttccacttgggagggtgccatgttgtgaagtatctcttagaaagtccctcccattttcccaactcctgtgaggcagcaaagggctgagctctggctctgagctccctgccacagtatactagtcaacccctctaaaccagctcctgccacactcatcatacccattctcacccctacatttatgcttttattattcttggctagaaagccatccctgcccccttctctcaccttagcaaaccattcttcgaggcttataaagccccacctctctcaaataacccaccccatccatcctgaccctggtaggttcttttctataaataactctaataattcattgattcaacaaatactgagcagctactatgtgccaggcaccagaaaatgtgctggagatacaatgatgcacatgcaagaaggatggagtttataggtcctcaggaacttactgtctatgtgacacaactgcaatgcttcatcttatattcagtgcatgtgtgttacccatccctcctcaatcccgccttttcacaccccatcttttccatgaagaactcaaggaagaagccacatgtgctagctttctctctccaccttcatggtaagcttagtgtggatcgcagcccagtgacttaacagaatgagatcgtgccatttatcaatggagtcaacacactgggcctacgtgtttcttcacaaaaaccaatttcctacttgggaatggagaaaaaattaagcaggtgaacggaattcttcccaagcttaaatttttctccattatttttgacattctttttattttttatttatttatttattttgagatggagtctcgctttgttgcccaggctagagtgcagtggcgtgatctcggctcactgcaagctccgcctcttgggttcacaccattctcctgcctcagcaccccctgagtagctgggactacaggcgcctgccactgtgcctggctagttttttttgtatttttagtagagacggagattcaccacgttagccaggatggtctcgatctcctgatctcatgatccccccaccttggcctcccaaagtgctgggattacaggcgttagccaccgtgcccgattctttttatttttggagtccgccatcaatgatttgccagaaagcaccaggtcatgccaaaatagacgagggcatagcaggtgttggttaacatttaaattaagtaaagagtttatcttttatggatgtgcatattcacggttttcattttctttctttctttcgtgacagggtcttactctgttgccaaggctggagtaccatagcacgatcatagcacactgcattcttgaagtcctgggctcaagccatcctcctgcctcagcctccagagtagctaggactacagactcacgcactgtggccagctaattatttttttgtagagacaagagctcactatgttggccaggctggtctctaactcctggcctcaagtgatcctcctgccttggcctcccaaagtgctaggactgaagacatgctgctgtgctcaatcatgatagtcatttcctattggagcttactatgtgtcaagtgagcatttctaagtagtttcaagagagctgactatgcaattttgtgttaaaacctagagaccatgaggaatcaaatatatgaacacagggtgtccttgtcaattacaacattgcctcacagttaagaggtggtctagcgcaggcatctcaaaccaccgactggtactgcacagcaggaggtgagtagtgggcttcatctgtatttacagccactccctatcactccaattactgcctgagctctgcttcctctcagatcagaggcggcattagactcttatagaaccaccaaccctactgtgaactgcacataagagggatccaggctgtgtgctccttatgagaatctaatgcctgatgatctgtcactgtctcccatcacccccagatgggaccgtctagttgcaggaaaacaagctcagggctcccactgattctacatgatggtgagttgtataatgatttcattatatatgacaatgtaatcatagaaataaagtgcacaataaatgtaatgcgctcgaatcatcccgaaccatctctcccctgcggtccatggaaaaactgacttctatgaaactggtccctggtgtcaaaaaggttggggactgctggtctaggaaagcaaaagtccccacaacacaaaagtattcttcaatgactacaagagcgatcaaactccaccgaaacctccttctccgacgattcagtggcttcaccttgccaattattgggtatcaatagccaccatcatgatatgaacacaaaacaaagtggcagttctggaaaacaaggtgcagtgactggcaaagtcagtggccttggaaaggccaaaaaaaagattcaggggccaagtgtggtggtgcacacctgtaatcccaccactttgggaggccgaggtgggaggatcacctgaggccaggagttcaagaccagtctgaccaacatggtaaagccccatctctactaaaaatacaaaattagcctggtgtgatggtgcatgcctgtaatcccagcactatgggaggctgaggcgggcagatcacaatgtcaggagatcgagaccatcctgggtaacatggtgaaaccccatctctactaaaaatacaaaattagccgggtgtggtggcacatgcctataatcccagttacttgggaggctgaggcagtagaatcgcttgaacccaggaggtggaggttgcagtgagctgagatcacaccattgcactccaacctgggcaccaagagggaaactccatccggaaaaaaaaaaaaaaaaagaaagaaagaaagacaaaagaaagaaaaagattcagggcaattcacagctgaatgaacgctaagaccacaggggctttgagagacttaaacactaaagaagtaaaagaagcccttaggaaaactggtgacccatcaaataaatctgtaagaatgatcctttttagctcgggctgcagaagtcaagcatgacatgaagatgtcgttttatgctcacatgatttcatccctcagcccagaaaaagttacagaaaaaaaccccacacccactcttaattcattttatactgaatctacaaattagcacctacttgtaattaaaataaaattcttattacatgtaagctgaaattaacctatttttataatttgcaatgttggttttcttttcttttcttttgagacaaggtctggctctctcacccaggctggaatgcagtggcgtgatctcggctcactgcaacctccacttcctggtctcaagcgatcctcccacctcagcctcccaagaagtgggactacaggtatgtgctaccacaccaaagtaatttttgtattttttgtagagacagggtttcgccatattgcccaggctggtctcgaactcatgacctcgagcaatccacccatctgggcttcccaaagtgccaggattacaggcgtgagccactgtgcctggcctgcaatgtcatttttcaagctcagtcaaatattttgcccactctctttccctcctccacacacatactatctacagtgaaactttggtctctgttttaagtgatctttttctggaacgaattatcttcagatagtaaaaatttccttcatttcatgccatttagttcagttagtgtaatgaaaggtcacgtaacaaaatgttaatggtgatgagttttggatgatagaatcataggtgccagcaagttctcttttacttaaatatatgtttaagtttttctagaatgaatatacaatattaaagactttttcaagttacaaataaattttttcagagcactgtagaaatgcttacccatctgtcgctccccctccttctcctttgctaacagaattttctttctttttggtatttagattaaaatgtgcttagtgggacctcagctccagaaaagaaccaggaattgctgggtatggtggcttatgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaagacagatacctgactccaggagccatcactttacaacctgagattacagctccaagattgcctttgcaaggctccacctgctggtctttggaggtaatggcaggccctgcctagaagggccaagattctggtcctacctgtggagtctggctcactgtcagaaagttggggcacttatacctgagtccctctatcttgggggcggggtcgtggcatctctcaggcacacctggattccggcctcaagaacttccagaattgggctcctctcaactcccaactcagatccctgggttcccacctgttggtgccctttcagagggggtgtgagttttcgagtttcttgtactcttcgcctgacctggtacacttgtttgcattaactgcctagtccctctgtttgacttgggggtggctatttcaggggctccaaagtgttctaaatagaaggtgagaaggcctgggtgcagtggctcatgcctataatcccagaactttgggaggccaaagtgggaggatcgcctgaggccaagagtttgagaccaaccagtatagcaagatcctgtcacttccaaaaacaaaacaaaacaaaacaaaaacaaaacaaaaaaacccacctttttaaaattagcttgacatgacagtccacacctatagtcccagctacttgggaggctgaggcaggagaattgcttgagcccaggaggcggaggttgcagggagccgagatggcaccactgcacttcagcctgggcgagaaagtgagaccctgtctcaaaaataataaaacaatagtaaaaataataacgtataaacatgaaagtaataggcacaagtcttaagtttggaaaaaccagcattaacaatcttcacaagaagctacaagatagagactatcaccccttttgacaaatgaggaaactgaggctgaagaggaaaagatatttacccacagtcccacaggggttgagggacaggtaggtgtcaacacagaccacaatggctcagccccagggctgttccccaccctctttccatcctttgcagacagctggcccgacggggaccttgggcagcgagccccggagctggagctggagcgggcccatgcccgtatttgcccaagctcttggctctccctcaccctcccaggctgcaaacacagatgttccttttgctttttccctttttcagccacagtaactcctggtccctcgcagtgcctgccaaactccacattcctggcaagaactgcagacaagcaggacaggaggggctccctggagctggccccgtgcagccctgagttcactcaccttgaagcatgctccggtaggccgtgtctgcgatggcgtagatgtgaggcggcatctcgtgcctcttcttgcccttgtacatgtcgacgatcttctccgagtagatgggcaggtgtttataggggttgaccaccacgcagaagaggccagagtacgtctgcagacagagaacccagcttacttccagacctcctccagggtagacagattgcacagaagcactcaatattctcatgttagagatggggaaactggagcttggagtcttagtggaaaccctgggcctcactgatattccaggtacgtgggaagaggagaaagggcgagagtgggtttccaagctgcctatgttttattttgcaactgtggggggttttgtgtttgttttgagatggggtctcactctgtcacctaggctggagtgcggtggtgtgaacgtgactcactgaaaccttgacctttctggactcaggtgatcctcctacctcagcctcctgagtagccaggactacaggcgggcgccaccaggcctggctgatgtttatattttctgtagagacatgggtttcactgtgttgctcaggctggtctcaaattcctgggctcaagcaattctctcatttcagcctcccaaagcactgggattatagttgtgagccattgcacctggccaaactgtggagttttgaagagctctgggttcaaatctcagctccactcctccgacctgccactttacctccccggacctcactggcttaaataacagccaccgttcattgagcacttactatgtgttgggcaccgaactaagcactacgcaggatcttttttggatgctgacaatcatattaaatgctcatcatttaacaggtggcacagaaaatgaacagtgtgcttaagatattaactcaggaacatttaataaagaaagtgtttacagatatgtgtgcagaattaaagaaacccaaccagtgacgggagcagttaagtctgaagagcaagaacagaagagaatgttgtttacttttttttttttttgagacagggtcttgctctgtcgcccaggctgcagtgtagtggggtgatcttggctcactacaaccttgagtttctgggcttaagtgatcctctcgcctcagcctcccaagtaggtggtaccacaggtgtgcacaaccatgcccaggtaatttttattttgttttttgtagagacagggtttcaccatattgcccaggctggtctcgaactcctgagctgaggtgatgcgccagtctcagcctcccaaagtgctgggattacaggtgggaaccaccgcactcagccagagagggaatgtcgttaactgaacattggaggcatagaaagccacacacccctaaaaaggggctgtccagagggatccgcagtcatacagaaacacagctgccaaaactgtggtccaggagggagggaggaaaaggtaataatcctccaagctctctctcctcccaccaccctctgatctctttctgggacctcccaatgtccatatctaagaagaaaccccagtgactcagtctctagaagatggcagaggcatctcctcgtggcatcttcacaactactcagtaacagtgatttccccaccgcctgtttgacaggagggcaaagtgaggcatggtgaggttgtcaccaggttacacagctggagggaagttgggaactagaactcctgtttaccccacagcgcctgctcctgatcattaataccttccccatctgcaaaacagagaccaacactgacatgagctctccaatgtggatgaagcttgaaaatatgcctagtgaaagaagccaggcacgaaaagtcacgtactctatcatctcatttatgtgaagtgtctagagtaggcaaagccatggagacagaaaacagacttgtggttcccagaggctggaaagaggtgggaaatgaggaggaactgctcatgggtataaggtttccttttgaggctataaaaatgctctggggccaagtgtagtggctcatgcctgtaatcccagcactttgggaggccaaggtgggaggattgcttcaggctaagtgtttgagaccagctcaggcaacaacagccggaccccctctctacaaaaaaaaaaaaaaaaaaaaaatagctggccatggtggtgatcacctgtagtcccagctacttgggaggctgagtcaggaggattgcttgatcccaggagctcaaggtaatagtgagctatgattgtaccattgcactctagcccctgggtgacagagcaagaccctgtcttgaaattgatagctgtacaacattgtgaatgcacttaatggcactgttttctttaaaatgtttaaaatggtaaattttatgtcatatgcactttaccatttaaaaaatagcagtcctctcctactgggtgaataggagcatctgaaaataatcagatcagggacggaggagtcaaggcacaaggcgagtcccgccatgctgtacgtggtaaggcactattgtcatgatttttccttactggatactagattttcccatggttgaggtcacagttcaggagacaggctccaacccgtctcacaggaactgctttccccaaacgataaacatcagtactgcccaagactctgatggccataaagcgtatcctcttccctgcaagtgacttagggagaaccacagatccatctctcagttacagctagggtgaaccaagcaacagagggttaagtgacttgaccgaggtcaccaaagaagatcctggcagcaccaagcccagcctggcccgcccccaggtatgagcatggtccattatgctatccagcctaggcccatccaacagaaacagaaactactgatcgttcgttcattcattcattcattcattcattcattcattcattctgtacgtcccagatgccatgcaaaaggtgctgggactacattagaacattaaaaaaacacaggatcccagccctcaagggccttttagtcaagggctggagccaattagagagtgggaaagtctggctgggtgtggtggctcacaactgtaatcccagcactttgggaggtcaaggcaggaagattgcttgagcccagaagtctgagaccagcttgggcagcacagtgagacccccatctctataagaaatttaaaaattagctgggcatggtggcattcacctgtagtcccagccacttgggaggctgaggtgggaggtttgcttaagcctgggaggttgaggttgcagtaagccgtgattgtgccatgcactccagcctgtgtgacacggtgagaccttgtctcaaaaaagaaaaagaaagaaaaagagagagtgggaaggtccttccagggctcagtccactcagggacaatggtatgtaatgtctgggggtgctgcagaggaatattctttgaaggtacaggattgttgggcgcagtggttcacacctatgatcccagtactttgggagaccaaggagggcagattgctcacactcaggagttcaagaccaacctaggcaacacagtgagaccctgtttctaccaaaaatacaaaaaattagcagggcatggtggcacatgcctgtagtcccagctactcggcaggctgaggcaggagaatcacttgaacctgggaggtggagggaggttgtagtgagccaaggtggtgccattgcactccagcctgggtgacagagggagaacccatctcaaaaaaaaaaaaaaaaaaaaaaaaaaggaaacaggattgatggagacggaggttctcaccatcccctaaaaggagaatgaatgagtcaacatatgcctgtctaaatagccatcaaccatttactgagcacctactatataccacatctgtgtcagaggctggagataaagaaatcaatgatagctcctgcccttaaagaacttaaatcagagggggagacaagtacattaaaacacgtcgtaagaacagagaatgataggaacaaggaagggaaggccctaacccacattgggggtggtcagggaaacctccaggtggggaggtattccctgcactgagtcttaaaggacaacaaggtgttaaccagctcaagacaaagcagggacatgggcagaaaaacaggacacggggtccgtgggggtgaactataagcagcttggtataagcggctccatcggaccgaaatggagaagcaaagcaagggttagaggtaagcggggcccaggagcaacatccagcctggtggggctgggagtggggggctgcctgcctggacacccctcttccccattccatcacccaggaccctcccacccatcctgcaaacaccagctgcaagtgccttgagtccggggaaccccctttctcctcttcagtcccagcacaggccttggtatagaataggtgctaactaaatgcttgctaaatgcatgccaggggaataaattaatgatacagcttcctgggagcagggacagcctgacttcacctccgtgacctgggggccttgcacggcggcagtaggtactcagtggactacactgagccaggccaggggctatttcctgttcaatcagtgtcccctgtccccaggacaagcctcccaaagagaagagcccagtctgtggtcacctgaacaaaggtcaatcaagccccaccctccttcaggcctcgactccatctccagctcctctggggccatgtccactgccacgccccttttgaatgtaggtatcatttacagcccaacctgtcctcactcaagcccttgacctggaggcagtaaagggcagtggctaagggctcagaactgggtatggggtacttgaatttgaaccttcactttgctacttcttcgctgtgtgaccctgggcaagtcccttaacctctctgagtctcacttatcctcatctacaaaacagggaggcatacgaacaagcccttcatagatgtgctgcgagataatgctcgaaaagcatttagcatggcggctggtatgtagtaggtgctcaatcaatgttatttagtgactcttactatgctcccttcatttcacgagagggaagtcttgccaccttagagccttcaatatgctgttctctccacttggaacacttttcccctcatcttcccacagctggttccctctcctcttttagagctctgcctaaatgttacctcctggactgtgacccacacactactgtatctcctgcaccccgcacagtgccagggacagggtagacactcagtcagctgtaatcccagcacttcgggtggccaaggaggtcagatcacttgaggtcaggagttcgagaccagcctggccaacatggcaaaaccccgtctctactaaaaatacaaaaattagccaggcatgatggcaggcgcctgtaatcccagctagtcgggaggccgaggtaggagaatcacttgaacccaggaggtggaggttatagtgagctgagatcatggtgctgcactccagcctgggcaacagagtgagactctaaaaaaaaaaaaaaaagaaggaaggaaggaaggaaagtaagaaagaaaggaagaaagagagatgagagatagagaaaagaaaagaataaaaggaatttttaaaaagaaggaagaggccgggcatggtggctcacacctttaatgccagcactttgggaaatcgaggaggtcagatcacttgaggtcaggagtttgagaacagcctggctaacatggcaaaaccccgtctttactaaaaatacaaaaattagctgggtgtggtggcgcatgcctgtaatcccagctactcaggagtctgaggcaggagagtcacctgaaccaaggaggcagaggttatgtgagccgagatcatgccaccacactccagcctgggtgacaaagtgagactgtctcaaagaaaaaaaaaaaaagaataaaatgaatttttaaaaagaaggaaggaccacactgccttttcaactccatcactagcttctgaaagaggaatatgacttccatcctctttgtttgggacatctctcccagtgccgtgcacacaacaagcacttaatccatacttccaggtagatctgaatctctgctgagttctgtaaaagctttctaagcaagccagggtatgacgatggagtgaaggtaagactggtgcaggcagccgcacatctcacggcagggtcgtggggcttcagcatcgggctcttcctcccacattattcagccacttctccttcacctcgacccagcccaaccatagttggctgtgtttctgcctctctggccccacgagcccctctccagctggttaaattcagaggtttcaacatcccagcctcctgtgtcccagccggcatctcatgggccctgtgccaccagcaagtcccagctgcaggcccaggatttccctcttgtgaccgtattaggaagcagctccagtttttctctgacgctttatatggtcagccacagagccctgagcagggggtgctcccggggcctgcagcagaaatgaggaacagggagggaagggagggaagtggaaggaacactggctttcagacacacagggatggccgggcgcagtggctcacacctgtaatcccggcactttgggaggccaaggtgggtggatcacctgaggtcaagagttcgagaccagcccggccaacacagtgaaacctcatctctactaaaaatacaaaaattagcaaggtgtggtggcgcgtgcctgtaatcccagctactcgggaagctgaggcaggagaactgcttgaactcaggtggcagaggttgcagtgagctgagattgtgccactccactccagcctgggtgatacagcgagacttggtctcaaaaaaaaaaagacacacaggcctgggcagagtgttggctttgccttatcacctgcctgacttgtgcatacagacctacccctgagcttcctcagtaaagtgatggataatcacggcttctttatgaagctgcagtgcaatatcacggctttctaaatacccaacctagagacagacgtggtccaccaagcacgtgcttttgctgcagccttgcttttaagagcaaaaagactagaaacaacctaaatacctgtcaatagcagacaggcttaatcattatggttcatccctatagcagaagactgtgcagtggccctctctctactaccatggatgaatggccaaaatacacagttagatgcaaagattgagacgcacaacagccggggcctgtgctgccattttggaggggtgcaggaggggctctctatgtggctgcatgtgtataaaacatcactggaggctggatggagcagctcacacctgtaattgtagcactttgggaggctgaggtgggtggatcacttgaggtcaggagttcaagaccagcctggctaacatggcaaaaacccatctttacaaaaaatacaaaaattatctgggtgtggtgatgcacacctgtaatcccagctactcaggaggctggggcgggatgatcgcttgaatccagaaggcataggttgcaggagccgagatcgcaccattgcactccagcctgggtgacagagtgagactttatcacaaaaaaagcaataggctgggcacagtggcttaagcctgtaatcccagcaccttggcaggccgaggcaggtggatcacctgaggtcaggagatcgagaccagcctggccaacatggcaaaaccccctctctactaaaaatacaaaaatcagctgggtgtggtagtacacgcctgtagtctcagctacttgggaggctgagggaggagaattgcttgaacctgggagggggctgttgcagtgagccaagatcatgccacttcactccagtctgggtgagagagtgagactccatctcgaaaaataatataaataaataaataacatgactggagggctacatatgtaaccagcaaccacagtgtctctaagaaggggaactggaagggcgagaaataggaacgaagggggaagttctatattcccttatacactattttatttcatatttgcatgtcttacctattcaaaaacatatttgaagtctgactagatagttatgaacagacagaaaaaactataaggtagggttaagtggaaaaaaaatcatactgcaaaacatacaaggagtgactttttcttatgtttggggtgtgtgtgtgtgtgtgtgtgtgtgtgtgtgtgtacatacatgaacctgtgaatcatgtttgcctccagggaagagggctgctttttgtgatacatacttatttttaaatattctcctgaggtctttgcatagattatccttgtattactggaggaggttctttgaagcaataatgacttgaaagatcagaaggctgggtgcagtggctcatgcctgtaatcccagcacgttgggaggcggaggtgggaggatcatctgagttcaggagttcaagaccaacctggccaacatggtgaaaccacttctctactaaaaatacaaaaattagctgggcgtggtggcatgtgcctgtaatcccagctactgggaggctgaggcacaagaatcgcttgaactcaggaaatggaggttgcagtgagccaggatcacaccactgctctccagcctgcgtgacagagcgagactccatgttaaaaaaaaaaaaagatcagaagggctaatgcttggggcttgacaaagggcagcttccagttacagtgtctttctaccctctagggaccagtgcagtggctggcacccaggaggcctctgttcacaatctgcttgttccttgtgtccccgggtggacactgcttccagagtaggctaagattgctgggccaggtctctaaggcggaaaaattgtcacctgctaaagtttggaaggagggcttctcctgaccccctgggcattccagaagcagaaccagaactggaaaaatgtcctttggggttcatggttcagggacttgggcttggagttccaatgagcaggggggcccatccaccttggctctggatcatgattttcccaaccccagaggtttggtatagggtggagggtcccactgtctacagagacaaagcaggtaaggcatgagtgaagcagggcgtgtgtgagtgaacaaaagaggtgccacggtcaatggttaccatggcctgggagacgacagggagtggtgaggtctgcggaaaagcagagcaaaaagcccatctcacagggactgctactcgcactctgcattctgcagtgtcaggtcctctgctttttcgagcaatgccagaaacagatttctttttttgatatattaagttaactcaatttaaaaacaaaaatcactcctctgtgttagcaggttgtaatcattagtctagcacctagttaggtgctcaaggaatcataataaaaggttcaattccttcttgctctgcacttaaagcttgtctacctcaaagctaacaaggcctctggcactgtcccctcctgctccagcccacgaccatcacctcctgctctaagcctattaccccaagagccctttgctactaatcataggtagtcaccctggccctggactcacacagaccttgtctgaatcccagctctgcccaccttccagtggtgggactaagcacatctgagcttcagcaacctcatctttttttttttttttttttttttttttttttttttttgagatgtagtctcactctgtcacccaggctggagtgcagtggcacaatatcatgcctgtaatcctaacactttgggaggccgaagtggtgaagattgcttgagctcaggagttcgagatctgtttgggcaatacggtgtgaccccacctctaccaaaaacacaaaaaaattagctgggcatcgtgctacatgcctgtagtcccagctactaaggagactgagataggatcccttgagttccaggaggcagaggttgcagtgagctgagatcatgccactgtactccagcctgggcaacagagtaagaccccatctcaaaagaaagaaaaagaaaaaagaagaaagaaaaaagaagacagaaagacagagaaagaaaggaagaaagagagagggagggagggagggaggaaggaaggaaggaaggaaggaagggaggaacgaactaactaactcgaggcagacgaactcagccaaaagacagcattcagaagaccaagggacccttaggaccaggcgtcaaagccatgctccccgccaggtatgccacaaacggtcttcagcagtttaggtagactgctggacattgctgagcccagaacctgcatctctaagattaggaggaaagctcctctggcttctatagactcttctagatccaagagcacaagaggtctgccagaaccttctcaagggcacatcgtttgaggcgagccttgcagaacggaggagaaagtttatcttcatcacagagggcaaagtcatgcatgccagaccacggacctggtatcacctcactacccgcctattaacaagactcatgcatgctgctattatgggctgggagagtaagttactgtgctcccccaccccaacccctttccttctttatcttctccgtcatggacgacggtttctattaagcaattaaactgaccagaaaggaacaagagaagagcgggaccatcatcacaaggctgaaaggattttaatctaatctgtccagagaagcatagcaggaatttgaagctttgattcatttatttttaatctgctgtcagaagatattttgggtctcaggaccttcatatgccctttttttttctgatttctatttgaggacagcaggtgagatgaatacacaggcctgtcctgaaactccctagatggtgatgatacgtcttagatgaaagacctgggccccaaagagtccaattttccctctagctccctacagacgggcctctttagaaatatccaacatactggctgggcgtggtggttcaggcctgtgatcctagcactttgggaggccgaggcaagtggatcacctgaggtcaggagttggagaccagcctagccaacatggtgaaacccgtctctactaaaaatacaaaaatcagccaggcatggtggcacatccctgcaatcccagctactcgggaggctgaagcaggagaatcacttcaacccgggaggtggaggttgcaatgagccaagatcgctccacttcactccagcctgagcaacaaaagtgaaattccatctcaaaaaaaaaaaaaagaagaaagaaagaaaaagaaaatgtccaccatacaaacagccccagatcaataatttttccatacaaacagtgccacagacaagagacttcccctacttaagaaagtaaagatacattttgcaacactgcacctcagcttccttccctaaaaggggcaaacatttttaactcaggggatgctgtgttaaataaaatacaatgtgtcaatgtacagcacttggattggaggacatatttaatagttacggccaggcacagtggctcacacccgtaatcccagcgccgtgaaaagtcaaggcaggagatggcttgaggccaggagtttgagaccagcctgggcaatatagtgagatcccagtctctacagaagtttttttttttttttttaattagccaggtgtggtggtgcacacctgtggtccacagctactcaggaggctgaggtgagaggatcgtttgaatccaggacttggaagctgtactgagctacgatagaaccactgcactccagcctcaaagacagagtaagcccccatctcaaaaaaaaaaaaaaaagttatgagttgctaagttgctcactcttaccatttggctctttaaaaagccactctaactccttctgaaatatctataagaacagtggaaaaatggcctatccccatgacagattctatactaccccttacaaggggtatctttggggcttcctgagatatattacacaagtcaacactgagcatttccaaatggaaaaaagagcaagtcactaaactgtgtgcccaataggcttttaaatatgtaaacagataccatgctcacaaagagacaaagaatgcaccgcatctctggttaaggactaatttttctgttttgtgttcactatgctttctgaactctccaagtgttccatagtgaacgtgtcttagtttcctaattaggaaaaaaatgtgcaggacatttttagagatgacaaggggctttttgtaattttcatttggcaaaatgtacagaccagaaccaaagagacacaaggatgccaagtgatggaagaagaacatcttactagtaaaatcaaaagtgatcatgaccacagcaaaaaccaatctagtaacacttaacattttcagtgcctgcacttaacatgtagcaggaagtgtattaagtgctttctatttagagtaacccactccatgaagctggtactatttttttttttttttttttttgaaacagacaaggtcttgctctgtcacccaggctagagtgcagtggcacaatcatagctcactgcagccttgaactcctgggctcaagtgatcctcctgcctcagcctccctgagtagctgggattatgagtacgcaccactgcacctggctaatttatttttgcagagatggggtctcgttgtgttgcccaggctggtctcaaactcctgggctcaagtgagccacctgcctcagtttctcaaagtgctgggattacaggcatgagccactatgcccggctcccaagaggctggcactattcttgcatccattttacagaaaaggaaacaaagcttcagaggcatgaggtaacctgctcgagggtgagcaaggcctttcagagagaagacatagacataggccgggttgggtgacctctgcacatcagtctggcgacccgtgccccacaacatcacactccaagccccaatcatctagtccaagcagtccaacagaactttctatgataatgggaacattctgcacttatgctacccagtacaccagccactagccacaggtggctattgactacttgacctagggccaacacaacaaaagaaataaatttgttattttttattgtcttttacttatgtatttatttagagatgaagttttgctcttattgcccaagctggagtacaataacgcgattttggctcactgcaacctccatctcccaggttcaagcgattctcctgcctcggcctcccaagtagctgggattacaggcgcacaccatcatgcccagctaatttttgtatttttagtagagacggggttttaccatgttggccaggcttgtctagaactcctgacctcaggtgatccacccaccttggcctcccaaagtgctgggattacaggtgtgagcccacgcacccagctaataaattttttaatgtttcttttttttttttttttttttttgagatggagtttcgctcttattgcccaggctggagtgcaacggcaccatctcggctcactgcaacctctgcctcccgggttcaagcaattctcctgcctcagcctctcaagtagctgggattacagatgtgcactaccatgcctggctaattttggcatttttagtagagacagggtttcatcacgttggccaggctggtctcaaactcctgacctcaagtgatctacccgccttggcctcccagcgtgctgggattacaggcatgagtcgccaaacctggtctaatgtttcttttaattaatttaaatctaaatttagttagccacgagtggccagtggctaccatattgtgccatctctagtccactctgttctgcaagtctacctaaaatagtcctacgaccaacctgaacattcccctctgtgacaaggaaggcctccctaaaacctagccacatcctcatgtctcctacccacctggctgccaagacaaaccagcctttccaaagtggttatgagctcttctttactttcaagaggaaggaaggacagagaacgatgccaatgaaatctgttgagagtttatcatacgtcttggcacttggcacatgtgatgacatgggattgtcacacctcctgtctgtaatgagggtgattattcccattttacggataggaaaaccaaggcttcgagagaggaaataacctcttcaagggctgagatgtgaacccaccttggaatgattccacctcatcttgcaatctccctcgatcaaaccttcagcctcccatttcctttttttttttttttgagacagagtcttattctgtcacccaggctggagtgcagtggtacagtcttggctcactgcacctccacctcctggattcaagcaattcctctgccccagcctccccagtagctgggattacagatgcgcaccaccacccttggctactttttgtatttttagtagagacggcatttcatcatgttggccagcgtggtctcgaacttctgacctcaggtgatctgcccacctcggcctcccaaagtgctgggagtacaggcatgagccactgtgcccagccctcccaacacatttctaatgcctactttccttatgaggccaggagtaggtacctggctgcctgcaatactcacatatattagccctgagaagtaccgctccctcaggttgtgtagcacggaggcttcgttgaggcacgtcagctccgccatgtcctccaccttggagaacttgggtgggttcatcttctggatgtcatctttcccaaccgtgaccttcttgccattctccaccagctccacaaccacctcatcccccttctcctccttaatgctggctgcctcgaagccctgcttctccgaggggacccagacgagtctcttggcggcccagtcagcctgggccactgggctgttgatgaagtttttgtccacaaagaggaacttctcatcgtcactgagttggcccttctgcgccatggtgccttgttggtcccctgtggaataaggtaacagggtcagaatcagaccacaaccaagcccggaagacagaccaaccactcaccttgccctgtctaggaactcggtctgcagagacatcccaccaagtacaaagacctgcagtattgtgtatgtggtcaaagaacagagaccacccaaaggcccttcagaaagggatgtgtgtcatcgcctaaaataccaaaagtcagacaacccaaatgtccaccaacatacagctggatacataagccatgctatttccacactgtgaaatactacccagtgctcaggaggcaggaagtagggctggacaaggtggctcacacctgtaaacccaacactgtgggaggccgaggtgggcaaatcacttgaggccaggagttcaagaccagcctggccaacatggtgaaaccccgtctctactgaaaatacaaaaattagccaggtgtgatggtgtgcacctgtaatcccagccacttgggaggctcaggcagaattgctcaaacccaggaggcagaggttgcagtgagccaagatagtgccactgcactccagcctgggtgacagagccagactccatctcaaaaaaaaaaaaaaaaaaagaagaagaagccggaagtaagtgtacacgtgctaatatgggaagatggtcaagtctaactgtgcgctgcaaaataagagtcctcatacgattaaacatagaattacccagattccttgagcccaggagttggagaccagcctaagcaacatggcaaaaccttgtctctacaaaaaatacaaaaaattagccaggcatggtagcgcacacctgtagtctcagctacttgggaggctgaggtgggagaatcacctgagcctgggaggtcaagattgcagtgagccaagatcaagccactgcactccagcctgggtgacagagtgagactctgccttaaaaacaaacaaacaacccaaggtatataactggaaactcagtaaaaggaaagaaattatgcaataaaataaatgagtctcaaaagcatcatgctcagtgaaacaaatcagaaaggccacacgctctattactccttcaatacgaaaaactattaggctggtgcaaacgtaagtgtggttattgagatagaaggtaatggcggccgggcgcggtggctcacgcctgtaatctcagcaccttgggaggctgaggtgagtggatcacctgaggtcaggagttcaagaccagcctgggcaacatggtgagacccctgtctctactaaaaatacaaatattaatggagtgtggtggcacacacctgtagtcccagctactcaggaggctgaggcaagaggattgcttgaacccaggaggcggaggttgcagtgagctgagatcgcgccactgcactccagcctcggcgacagagcgagactctgtctcgaaaaaaaaaaaaagtaatggcaaaatagaaaaggcatatctatggtgacaggcaatcaagagttgccagaggaggccatgcacggtggctcacacctgtaatcccagcactttgggaggccaaggcaggggggatcacttgaggtcaggagtttgaaaccagcctgcccaatgtggtaaaaccccatctctactaaaaatacaaaaattagccgggcatggtggtgcacacctgtaatcccagttactcaaaaagctgaggcaggagaatcacttgaacctgggaggcagaggctgcagtgagccgagactgcaccattgcactccagcctgagtgacagagtgagacgctgtctcaaaaaaattaaaaaaaagagttgccagtggcaaggaaaggaatggattagtaagaggcacagaagaggtacataagaggtaagaggcaccacctttcggggtgataaaagtattccctgtggtcatggtggtgcttacaagactgtatacatttgtcaaaactcattaagaatgttctatccactataggatgagtaaagtgaacaataaaatattacatcgtttccaagagctagaagaaggacattgaatgttcccaacacaaagagatgataaatgtcattatataggaagtagcaaaataaaagtaatggcaaatgcttgagatgatggatatgctaattatcctgatcttatctccccacacattatatgtattaatatcaaaacattactaagagctggactcagtggctcacacctgtaatcccagcactgtgggaagctgagacaggaggatcccttgaggccaggagttcaagaccaacctgggcaacataagaagcccctgtctctgtaaaaaaattaaaaattagcctggcacggtggtgcatgcctacggttccagctactcaggaggctaagacgggaagatggctagagcccaggaggtcaaggctgcagtgagttgtaatcatgccactgcactccagcctgggccacagagcgagaccctgtctcaaaaccatccaaccaaacaactaaaaaaatcattatggaccccatgaacatgtatgattatttgtcaattaagaaataaattttttaagttgaaaaaactcactcaagctgtacacttaaaaaaacttgaatttgttttaaatcggtgagttttactttatatagattatacctcaataaagctgattaaaatatttgtcataaagtatttgtcttcattttatatgtttgtgtgtacatttctaaaagtctagaaaactgcataccaaaatattatactagggttctatctggtcaaatacgagacagtgtgaatatcaataagaaaaataattatatgtccatcaccctaacaccccaaaaagggtggaaagacaaatatatttaaatgcatttgttcaaaatgatttttgttgttgttgtttgagatggagtcttgctctgttgtctatgctggagggcagtggtgcaatcttggctcactgcaacctctgcctctgggttcaagcgattctcctgccttagcttcccgagtaactaggattacaggcgtgcaccatcacacccagctaatttttgtatttttagtagagacggggcttcgccaagttggccaggctggtctcaaactcctgacctcaagtgatccaccagcctcgggctctcaaagtgaagggattacaggcatgagccactgtgcccagccccaaatgcattattttttaaatgggtacagaaagtggggtggaaatgtgaaaatcttgattctgcgttttctatacaaattgttccttagggtaactaaattaagaaggggaagtctctcttgatggaagattaggtcattaaatgtcctgtctacatgggaagcccatggatggtagattcacgttatctgtcgttatccagatgtgtttatgaggagagggacagagacaacacactctataggcctgtccggccccccgttcctgactctctgaccatagctgcaggggctgtcctggaaacactggcttacagccccttctacctcttgctgctgggctccaaagaactgagttgctggctaagtgaggacatatggccaccaggatctatgcgtggttgacatccctccttcagcagggaattcacaactcctttgaattcactgataatccccacgcttgggccccaaatcccacagcgacagaataaagacccatgtcccactcctggatccctagagctgagcagccaactcctgaaacccaaccttttgggtgatgcagattttgcaagacagaatgggagtggcagatattccaatacctatttttttcctttcagggctgaaaataataattaaaaaactaattttaagaacctgctgctgggtgcagtggctcatgcctgtaatcccagcactttgggaggccaaggccggtggaacacctgaggtcaggagttcgagaccagcctggccaacatgtgaaaccccatctctactaaaaatacgaaaagttgctgggcgtggtagcatgcgcctacaatcccagctactcgggaggctgaggcaggagaatcacttgaacccgggaggtggaggttgcagtgagccaagattgtgcctctcaccgcactccagcctgggcagtaagagcgaaactcagtctcaaaaaaacgaaaaacaaacctggaagttgatttgctcagagattttctgctgggagacctgatatcgtagctgatgaaaaaaaagtggcggctaggtgcggtggctcacacctgtaatcctagcactttgttggggctgaggtaggaggattgcttgaggtccggagttcaagaccagctggccaacgtggcgaaacctgatctctactaaaaacacaaaaatattagctgggcttggtggcaggcacctgtaatcctagctactcgggaggctgaggcacgagaattgcttgaacccaggaagcagaggttgcagtgagctgagatggtgccactgcactctggcccaggcaacagagcaagacttcatccaaaaaaaaaaaaaaaaaaaaaaaaaaaagggcagagaaatgaggaaatcccatctaaatctgaataatcacttcagatatccagaaagagaaataaagatctggtagacaacatgtattgtcctaagtttaacaatcctcctttctgcattttaaaattgttattgaatttggcttagctcatagtaagaccaacagtgtcctgcccctgactccagttaccctatcttaaaaaagactcccttctacatggaagaattccagcgaatacatgcagaacaataaaactaggatgtaactgtttataaagctaatagtgggtctcaagctgggcacggtggttcacacctgtaatcccagcactttgagaggcccaggtgggcggaccacctgaggtcaagagtttgaggccagcctggtcaacatgggaaaaccctgtctctactaaaaaatacaaaaattagctgggcatagtggcatgtgcctgtaattccagctactcaggaggctgaggcaggagaattacttgaactccaaaggtggaggttgcaatgagccgagatcatgccactgtactccagcctggacaacagagcaagactttgccaaggaaggaaggaaggaaagaaagaagaaaggaaggaagaggccgggcacagtggctcacacctgtaatcccagcactttgggaggctgaggcgggcagatcacgaagtcaagagatcgagaccatcctggctaacacggcaaaaccctgtctctactaaaaaaaaaaaaaaaaattagccgggcgtggtggcggccgcgtgtagtcccagctactctggaggctgaggcaggagaatggtgtgaacctgggaggcggagcttgcagtgagtgggtgagtggagatgcgccgctgcactccagcctggacgacagagtgagactccgtctcaaaaaaaaaaaaagaaagaaaggaagaaagaaagggtcttggcaagttggcaagttctaccagtaattgctaaaaccattaggccaatggggctcacatttcctggtgcattagcttctgagtcagtaggactgggatggggcccaagaatatgcattcctaaccagcttccgggtgatgatgatgatgctggtctagggtccccaccacaagactgactatatcagatgaagagctcttgtggaatttttaagggatgggtccgcctgccatcacctaaatctactaattaaccctaacatcacaaaaagagagagctgactagacattataaacattacatgcctgcagatgggccactacaggaagtgccgttaccactaatgacatattcttgctcaaaagaaaaggggatggagatgggggatgaaggtgatgaagcctccagatctgacgcctgtctatggaaaatgcaaggcacaggagagcatgctaaacaatgcagtaaactcccaaaggtgagagactatgctctgtcgcccagctagagtgcaatggcgggatcttggctcactgcaacctccacctcctaggttcaagtgattctcctgcctcagcctcccgaggagctaggattacaggtgcatgccaccacgcctggctgatttttgtatttttagtagagacggggtttcaccatattgtccaggctggtctcaaactcctgacctcaggtgatctaccggccttggcctctcaaagtgctgacattacaggtgtgagccaccacgctcggccagtactctctttctttaacaaataaaatacaaacaaaaaggaggggaacccatagattaaaaaataattgaaagaaaagaggctggcagtagcccacatgtataatcccatattttgggaggccaaggcaggaggattgcttgagcccaggagttcgagaccagactgggcattatagcaagaccccatcccttaaaaaaaatatcagccaggcatgatgatgcgtgcttgtagtcccagctactaggaggctgaggcaggagggttgcttgagcccaggagtttgaggctgcagtgagctatgattacatcactgcactccagcctgggtgtcagggtgagaccctgtctcaaaaaagagaaagccacagagaacgagaacatttcataaatatagggcattttcattagcctaaaagatctttctgagcctaaataaagtacaagttcattggtgctggcaacatttgattggttgcctcctcttgagaggtaagataacctgtagtcatgtaaagacacccagactttgcaatcagatgctaattcaaacgtgactctgccactgcagaatgcgtgcttctgggtgacttacgtagatctgagactcagatttactgtatattaatactggggacctaacgggtgccctgcagagctgccatgaagtttagatgaaactctctacaccaagcttgtctaacctgcagcccacaggctgcatggggcccaggacggctttgaatgtggcccgatacaaattcataaactttcttaaaacagtatgatattttttcgcgatttttttttttttttttagctcatcagctatcattagtgctagtgtattttacgtgtggcccaagacaattcttctttttctggggtggcccagggaagccaaaagataggacacccctgatctacaccaagtaccttctgtttctataccctttctcacttccggtgactctaagccacttcgctcattcctaaccaatagcatttactactgttggatgttttaattatgtttatttctggacagccatagtcacagaagtggcttgatacgacgcgtcttcttttaatagtataaccaaggttagtttaaacaggcagcaaaataggaaatgcggcaaaatattcaatcattccctgataatctcttgtttcttaaggtgtcgcagcagatcgtgtgtgtgtgtgtgagagagagagagagaaaaagaaggagagagagagagagaaactggaggatgcgtaagagaaatgggagggtgtgaagatgaagtaagattgatcacaagtaggccgagtgtgatggctcatgcctataatcccagaactttgggaggctgaggtgggaggataacttgaggtcaggagtttgagaccagcttggccaacattgtgaaaccctgtctctactaaaaatacaaaaattaaaaattagccaggattggtggtacgtgcctgtagccccagctacttgggaggctgagtcaggagaatcacttgaacccgggaggtggaggttgccgtaagccgacatcataccactacactccagccttggcgacagagtcagcctccatctcaaaaaaaaagaagtgtcagagctgggacccaaacctgggtctcattctggagtctatttggttctgcctttcacataaggtgggtgggcttgtcagatgcccataaaggaatcaatcctgtaaggcacctggcacagtacctgacacattacaaacacccaaaataggactcgaatcaggtgaagtaaactacagctccacaccacaaaaaaggacatctcacaacacatccttgagcaaaagaaggtggtcacaaaaagcacaggttctgtgactattgaactgaggtccaaaaccaggcagaattaatctacggtgatagaactcagataaggaatgaatgagtctccggtgtgcaatgattgcaaggacagaacgtgaggggggcttgtgagggttgacctctagatcttcatctgaatgccagccctatgagtgttcactttctgaaaattcatcaaactgttgggccaggtgacatggctcacgcctgtaatcccagcactttgagaagccaagatgggaggaccacttgagcccaggagtttgagaccagcctggccaacacagcaagacccatctctaagaaaaaatgttttttaattacctgtgtggaagactgaggtaggaggataacctgagcccaggaggctgagaccggcctggtcaacatggtgaaaccttgtctctagcaaacatacaaaaattaaccggttgtgatagtgtgcacctgcagtcccagctactcaggaggctgaggtgggaggatcacttaagctcaggaggtcggggatgcagtgagccatgatcatgccactgcactgcagcctgggtgacagagtgagacccccatctataaaaaatatatcctcttgaaaattcatcaagctgcacacttttttgcacatcaagcgtacttttttggttgtaaagtacacttcattttccttccctcttatctttaattgtggtaaaatacagctaacattcaccacctcggccacttaaacacagttcagtagcattaagtatattgatattcttgtgcaataatgaagagtttgtgcagatggtagccaattacatcccaagagggctaggagagtgtttcatttgttctaagcactatgacaagtaaagtggacttcttttttttttttttttttttctgagacagggtcttgctctgtcgcccaggctggagtgcagtggcatgacctcagctcacggcaacctccgcctcccaggctcaagtgatcctcccaccccagcctcccaaatagttgggaccacaggcacctgccaccatgcccagctattttcctgtattctttgtagagacggggtttcaccatgttgtccaggctgaggtcttgaactcctgacctcaagtgatctgcctgcctcggtctcccaaagtgctgggattacaggcatgagccgctgtgcccagccctaagtgggctcttcctaattgccatgtggatgagttgccttaaaagtcagaaaaaatagcaaaagctacaacagaaaaataaaaggacacgcacgcctccattgcctgggaccctgtctaacctcagacttaaaaacacaaacaagatcaagtgcaaagattcagtctctgtacaaaaaaggagagcttggagcaggctggattccctctggctttgatgtctctgacagttacgacgtgcaaaatctgctttggtcaaaagacagcaagatgggggatgagaagcttcgactcatgctagaatggtgttttccatagcatgccccttggaaccctaattccctgaaatatctgggctggggtggagctgcggaggttgagaagctcttcaaacagtggcgcagtcaaggtcaaatccatctggaaggtgctacatattcccctttccctcattgagacacaaaacacacaacaggacacttgagtctctggcagatccggaaacctgaaagctgttttgctcctacgagccttgggtccccaaaacaacatttagccacagatttgccaaatgttttgagaatgttttcctaaaaatttgccaaatttttgagaaaattcagtgagcctgacaaattaataatactaatactagtaataatagttgctaagtcttttttttttttttttttttttgacacagagtctcgctctgttacccaggctggagtgcagtgacgcaatctcagctcactgcaacctccacgtttctgggttcaagtgattctcgtgcctcagcctcccaagtagctgggactacaggcatgcgctaccatgcctggctaatttttgtatttttagtagagatgaggtttcaccatattggccaggctggtcttgaactccaggcctcaagcaatcctcccaccttggccccccaaagtgctgggattacaggcgtgagccaccgcagctggccacaaactctgcactgtgactcttgggctgcgtcattctgtgtcgtgaggggagctcttccgtgcattgtgggatgttccgcagcatccctggtctctgcccacctgatgccagtagcaccccttcctccactcatgacaatcaaaaatgtctccagacactgctagatgtcccctggggtggcaaaactgcttccagttgagaaccacagctttagaataaaaacaagggctgtcttgggaaaggcagttaaagctgagagcagctctcacttagtcaaactcaactcggaataccaactgcagaagatcagacgggggcaaggtgaacacactggaccagagacggaccgccagttggcccaaccccagggacactcttcatctaccttgatgcaccttcccaaccctccctcctccaccatcgctcatgtttaaggtcctgcatcagctccaagggctgaaaggacatctctgaaattactacccagaactgctgaccacgaagtacagttcactcatcaagagctgctctcaatgtttttggttgggggaagggtctcactatatgcccagggtggagtgcagtggtgcaatcatagcttactgcaggctcaaactcatgggctcaagggatcctcccacctcaggtgtgggccactatgcccggcttattttttgtagagatgggggtcttgctattttgcctaggctggtctcaaactcctgatctcaaatgatcctcctgccttggcttcccaaagctctaggatgacaggcgtgagtcacctcgtccaactttctcgaatgtttggatgaaaacaaatgactctgtcacctttggcattagcgatgtttgacacatctgagtgtgtcagccttgtttacagtcctgtcctgaccaacaactgcttcattctttttttttgagacagggtctggctctgttgcccaggctagagtgaagtggcgcgatctctgctttctgcaaactctgcctcccaggctcaagccattctcccacctcagcctcccaagtagctgggatcacaggcacgcaccagaacacccagctaattttttaattcttgcatttttttgtagagacaggggtctcactttgtggcccaggctggtctcaaactcctgagctcaagcgatctgcctgcctcagcctcccaaagtgctaggattacaagcatgagccaccgcgcccaggctgcttcattttttgagcacaaacaagctaatcattagcctctggaagaccttaggatgtcaagtaacgagtctcagctttgccccaaacctgctgggtgactctggacaagtcacttgccctctctgggccttgtatttttcatttagggaaaataaatcaatggtaggctggcccagctctaccattttatgggacccgtctgtgactcccagtcaaagggctgaaactggaccaactgagaatgtcaggttgctttagtttgttttaccatcagtttcatttttcccagaagaactcaggggcaaaagatcttgccctctctgcttcagcattaataaaaagtaaattaggccgggcatggtggctgatgcctgtaatcccagtacttcgggaggccgaggcaggcggataacctgaggtcagtagttcaagaccagcctggccaacatggtgaaaccccgtctctactaaaaatacaaaaaatagccaggtgtggtggtgggcgcctgtaataccagctactcaggaggctgaggaaggagaatcgcttgaacccaggaggtggagggtgcagtgagctgagatcccatcactgcactccagcctgggcgacaagagcaaaactctgtcttgaaaataaataaataaatagtaaattaaatatcccagagcccagagagtataggatttgcacatcacctcacctggtcaacagcttccctcaggattttactgccaagccattggctaaagattttggaccagagacaaaaacccaaatgtttttggagatcaggtaagtaatacagagtgacccagaccagatgttagagtattgcttatattctaaataccatgcagggttcagcactgtggctcacgtctgtaatcccaacactgggaggccaaggcaggcagttcgcttgagcttaggagtttgacaccagcctgcgcaacatggtgaaaccccatctctacagaaaatacaaaaattagccaggcatggcagcacatgccggtagtcccagctactcgggaggctgaggtgggaagatcgcttgagcctgggaggtagaggttgcagtgagccaagatcatgccactgcactctagcctgggtgacagagtgagactccatctcaaaaagaaaaaaaagaaaaaagaaaaattgctcatattctaaatgtcataaagggctggatacagtggttcacacctgtaatccaagaactatgggaggccaagccaagaggattgcttgaattaggagctctagactagcctgggcagcacagtgagatcccatctctatttcaaataaacgaatgaatgaatgccacacaggcaaaacagaagttctctgaacctgatctgcaacacaattcgccagctggaaggacctctgcagtggaaatcctcgctcaaggcctggtccaggtgtagggaggcatcaaatgtgtcgcagggagaggcactgggcactctaaatgcacctgcttggcaggtccccagtagtaccaaaaaggcagtttagatctattattcataacagccactgtatttattgggccccttgtattcatcaggtatcaggccagacagcttcctatatagaccatctcactgtctcctaagcgctctgtaaggtggcatcacctgctattgctattttcctgctaagatgaccgaggtcctggaaggtaaatgcaagacccccacttgtaaaatttggagtcaggagtacaatccagaatctaatcctagttttctgctaagagtaaatggacacccgattaattcttagcagaaagtccctttcttgcccctgaccctactccaccatttctaccctcccctcaccattcacatccccccacctcccaagggcttgttcccaagaaagccctacttcacttttacaggaaaaaaagtgaatggtgaacctgtcacattcttattgccttgtgacatctgcctaatcatctgaataccaatggtttcaagtaactccagaaagaagttctcttaatgcataacactattttttcctcccaaccaagagaacttggttggcaagagttacggtagcccctgtgaaggatgcttctggaagcgagcaagaactgattatttctggccctaaaagccccactgtgttttatattttacaattctggcataccacagcttaaaataaatgtatagtctcctatgtcaggggtccccaacccttgtgctgcagtatcagtcaatggcctgttaggaaccaggccacatagcaggaggggacggtgggtgagtgaccatcactgcctaagctccgcctcctgtcagataagcagcattagattttcacagaagcacaaaccctattgccaactccacctgcaagggatctaggttgtacgttccttatgagaatctaaccaatgcctgatgatgaggtgggacagtttcatcccaaaaccatcctccccactccaccctggaaaatattgtcttccacgaaaccagtctctggtgccaagaggatggggactgctgtcatatgtgactgcaacaagttgcaatttgcaatgcctttttttttttttttttgagaccgagtctcactctttgcccaggctggagtgcagtggtgtgatctcggctcaatgcaacctctgcctctgaggctcaagcgattctcgtgcctcagcctcccgagtagctgggattacaggtgcccacgaccatgcccagataatttttgtatttttagtagagatagggtttagcagagaccatgttggccaggctggtcttgaactcctgacctcaggtgacccacctgctgcggcctcccaaagtgctgggattacaggcgtgagccactgcacctggtctgcaatgtctttagccagtcatttgcaatatctattaattttagatacgcatgccctttaactcagcaagcgcatttctgggaatttatcctacagataaattcatataattagacaaaaagtccaaggatgaaagagtggcattatctattattcccattttcctgctaagcctatcggggtcttgaaaggtaaatgcaaggccctcccttgcaaaagttggggaaccaggattagaatcccgatctgtttgaagcctaatttactcagagatggcattagcgatgtttgacacatctgaatatgtcagccctattcacagtcctgtcctaacaactcactgcttcatcccttgagcacaaacaagctattcattagcctgtggaagatccttaggtcttcgagttacaagtctcagctctgcccaaaactcgctgggtgatgctaggcaagtcacttgccctctctgggccttgtatttttcagcctggtacagtaaagttctatgcccctcaccttttttttgagacagagtctcactctgttgcccaggctagagaacagtgatgcaatcagggcccacggcagccttgaactcctgggctcaagcaatcctcctgcctcactcaacctcctgaataactaggactacagatgcatgccaccatgcccagctcattttaaaaatttttttgtagagatggtgcctcgctatgttgcccactctggtctcaaactcctgacttcaagccatccccccacctcagcctcccaaattgctgggattacaggtatgacctgccatacctggcctctatggccctttcctagcaactttgatgaggttgttcctccttagcccctgaaaccctgatacaagtcacagatgtccgacctcccctttcagccactgtgagcagcttcttcctctgtccttggatcacatacaaggtttctttcaaattcttgcctgcctttctctaaattcagtctttcctccattgtgtggccagggttaaaagttgaaaggtcaggagtggaaggagaagacctagagagcaaaaaggccatcccttaaagtatgccatcaagaccctaaataagccaggcgcggtggctcacgcctgtaatctgagcactttgggagaccaagccaggcgaatcacttgaggtcagcggttcgagaccagcctggccaatatggtgaaaccccatctctactaaaaatacaaaaaattagccaggcatggtggtgggcgcctataaacccagctactctctactcaggaggctgaggctggagaagtgcctgaacctaggaggcggaggttgcagtgagccaagatcgcaccactgcactccagcctgggcgacagagcaagactctgtctcaaaaacaaacaaacaaaaccctaaacaaatgtaattggaatttgtaacattcccaatccaggtaaggaatggtagcttaatatattaaagattctaatcaccactttcagcccaaatagaaacgaggtttatgagatcaaagggaagaaaattaagagaagcttctcctttaacggccacatagtttaggcttcccggttctgccaaagatgagccatgccatactgagcaaacatcttgaactctctggttgtgtttgctataaataaccatcactgaagcttaccaggggccaggcactgtgctaaacccttcatacacattagctcatcaaatcctcccatgagggtaatctgtgaaactctggagttagaaagacctagatttgtagaatcttcttttccttactggttagctgagctatcttaagcaagttattcagactccatatgtgtaaaataaagccagttagaataacagtatctactctaaagggttgttatgaagacgtaagataatgtccacaaagcgtttagcatctcgccaggcaaaagtgcccaaaaaacatgagttattctcattagccccatttcccggatgagaaagtgaggtttggggaggtgcgggagatgatttttaaatttgcttatggccttctatgattctactggattgaatattgaacttggttttcaagaaaaatctactatatatctgctcttggaattacacgcttgtgcctaacgtggaagacccacctgtttggattcaagacctgtggaaaggagacaattccctcccaccccccacccaaaaaaatcaaacctctgaataagagggggtaggaaaaaagaatcccactttcctcccaaatctcttctccttagggtttctccactagttcttcaatgggtgagggacatggtagacaaatccccagggccaggaccaaccgggctgcggtgcaaggctgggtaactgacgagggggccggggatggcctcatggaaaacgcttccataaatgggcatgtttgcctcaatctctgccctcccacggaaaagtaatgataacaaatccataacagataccttgtacggaataacacatctatttcggacatgataataaaaaaacatggtgtttacaaggcaagcctggcggcttctcggaaaagacccagctagttcacgttctggactctcggcatggcagcccacctagggtcactggtttcagctaggtcaccccctcaatcaggggacaaacagtgccttttattttaaatgtgcaaaaagtcagtttatgttttcttcaaaggacacggtgataaacatttactttgttggaagcatttagtcccaccagaaacctgaccccaacaagtttgtgtccatggtaaagaagaaagatagtggggtcaagggtatgaacttggactcaaactgacccgggaatgggttctaccacttgctggctgtgtgacactttacctctctgagcctcagctgccttgtatactaaacaggcatcataaagcctttcttatgaagttgttgcaaagattaaatgagataaattaagttaaatgttgcaacagcatgtggcactgaagtgttccatcaacggtagctatctcaaagggaaaacatcaatttccttcaaacaaaattctctatcttatttcacaccctgccacctaatgactttcagttcagcgtcaagttccgtctctgaacaattctaaaatagtatcgttgagtaaatcaaagaaacaaaaaactatgcaaagcagtttattaatagcctgcattctttttgccaaaccccggacggacagttcaccatttaatctctcagttcttcatactgcaactaaacactcccaccttgggtttctaaatattttcttttacttcttgacaagcatggctttggatggtaccttttctcaagtggcaaaatccctaccagaccctgtgctggaagaaaacttacaacaggcagtagccacactttctctcgttttacccatttggttgggcacgagagtggcattgacacaggtggctctgcgggaaattctagtgtaatcttacctaacgcacctgcagatcgtggaagcaaatggagactttggagcccacctgggtatctgggggccctttggggtcaacctgggtgagttgttttttttttttttaatttggagaagaggaaaaagtgggctgtaacaaactagatcacaaccagccttatctcccaggggttctcaacatagaagaacctcccctaaactgattaaaaaaaaaaaacaacaacactcctttctgctaagcctatgcccatgtgtttttaactgatttaatgcattatcaacacaactgtgcaatacggtcaaatccacaaggagcctcactttgcccttctgtgtgatagcaagtgacttttcagtgaagttcagctgtaaattttttggtgcctagaataaaagtgagatgccttgattgtctgcaccggacctctgagatttccaagggagcatatctcctggattagcctcttaacaagaatcactcgggactaatttttttttttttaaggcagtttttctggggattctagagttgggaaatggagttgggtccaggcattgatatcgttaataagcacccccaaaatggtacttctcactggcaatcttaagaaatgctgtttggggaaagtctaggataatctaagacgataaggcagagagagatccaaatcacaactctgcccccaccatggcccttacgaggttgacaacagggacccctaagtgcaccccagcccctatagaataccctataggacttttaacacccccctgccctgcaatctgcccccagaatgacaactactacttacagatctccaactggggggactagtggagaggaaactggatggcgagctcggatctgacgcacctcccaggccggagcgtccaaatctccctgcgcgtcctcggacgcctctctttatagacccggagctgcccgcggctgggaaaggggaggaggccgaaggggtggagttggggagggtccctcgcggccccctcgccgcgccccctgcagggcgcacccccggcgggagcgcaaggagctggggcgctcgggacaagggtgcacggaacaggtgcgcaccgcacaagggcgcacggaacaggtgcgcacagggacgggagtctcagccccggccccaggcggtcgcagacgctccggatccctagagaaagggggtcgagcaggcagtgtctgtgcgggatgcttgagaacgtcttccctgagtcggttccggccgcaaaggctttaacctcttcctccccgtgtcggggctgtggtggatctgacttgacatctcccaccccacttcccattttattggcatcgcactgtctggaaagagggccggctgtgcagcgtgaagggtagggaaaggggatttcttgaactttgcaaagtgcaagacaggaggcccccacccttgctgggaaccgtgcaggaaggggaagtttttacttttcccaacttgccatctccacctccacccacatcaccacgaccaaaatacaaataaaaattaaaaataagcccactgtgattatttcagctgtccccctcccctgtgcgccactcgccagctgcgtgaccttgggcaagtcacttcacttctctgagacttggtgtccatagctacaaaatgggggaaggcggtggcggtgataattacgttatttacaagatgcaagtgtcaagatccaaggagaaagtgggtgtgcccccagagtctgcgagttcccttcaacaacttcccttccccaaggattcctcgcctaaaattgcattccctgtctctctccatcacaggctctctcgctctgtctctgccactgtctctgcatgtctgtcactctgatcattgctgtctctcgctctatcttttgtctctgtccctctcgcttctctagatctgtcgatgtatctgtctctccctcctgtctcactttgtctctggtctctgtgtctcttgctctccatctctcccgcgtgtctcactcctatctctgcgctttctctctctctcttccccaggctctccgtcttctccccgtccctccctccccgctcctgtccacgcacgcacacacaggccataaaaggaagtcgaggcggtgggctggccccgcgccaggccggggacccgcgggcagcccgggcgctccgctccccgcgcggcaccagctcctccgaggttcccgggccgggccgggccgggccggtccccctccccgggagcggcgggagcggcgggcgggagacaacccaaaaagggcaggcgcggactccttcctgcaggaattcccagcgccgcataccagctctgggctgccggctccccctgactaaatatggtgccgagtggccttcctgctccccggcgtcgggggagggggcccttcacgcagccaccggccgccgttgccccgcggggctagatggggacccctctgcttggggaaggcccggaagggggcagcccccagtcccacgtgggtttctgctgcttcaggctagaggatttggagagagggttaaagttgggcagacccctcctgggttctgtacttgacgcaggcccttagtctacaaccactcctcttgcaaccaggtggaggggctgggggccgggggtgcggggggtggctttattaatacccccattttgcaggtgagaaaattgagtccctgcaggggtaaagggatttgaccaagctctcactgggacagtcattgattggtgctggcactggaacctttctgatgacaccattcacttccagagaggagacattaaagggaaatgcccaggcaaactggccttgaggcccagggcgtgtatctgagagtagatgtctggctttgaatctgccagtgctgctttctacctatatgaccatgggcaagtaactttgcctctccatgcctcaatttccctacctgtaagatgggaagaacatcagctacttcctggcctttttgtaagcagtccttgagatgatccatgtaaaatgaacatggtgcaccgcttcatgtgagctgctgttactcgcaacaaacatgaaaccaactagagttgcaccaggcctccgggatataaagagaggcctcttcccctgcaggctcccaggcccatctggagagctctgcatctcagacccttttgggtccttcttcatccttccaacatcaagcttacctggttttcaccctggaaactcctgagcctggccctcaccctgcaatgggcctagatcagagagtcaagaacagcctgcatttagctggctggggaagtgaggggtaaagctctgcggaaaatgatgaatgagctgctccgcacaggcttttaacatctacgctgtaaaaggagtggaaatcgtccctgcatcagcacagaaatgatgtggagcagagaagtaacggaagggggaaaattgaagtcaatcatccgcttcccatcctggaaagggaaggccatcggaatctagcttgctggcctcgaagtaaaaactggcattaatactagaggcatgaacactgtatttccaaagggttccattcgattctttaaataacttgttggtaacttttaaaagagaataattataatgtgattaacaactggagactgtaacactcaattttacttcattctctcacctaccccttatataacaaccctttattaaaaattaaagtaggcagccgggcacggtggctcttgcctgtaatcccagcactttgggaggccaaagtaggcggatcacttgaagtcagaagttcaagaccagcctagccaacatggtgaaacccccatttctactaaaaatataaaaattagctgggcatggtggtgcacacctgtggtcccagctacttgggaggctgaggcaggataattgcttgaacccaggaggcagaggttgcagtgagctgagattgtgtcactgcactccagcctgggagcctggatgacagagcaagactccaactcaaaaaaaaaaaaaaaaagcaaaactaaagtggccaaggccaggcatggtggctcacaactgtaatcctagcactttgggaggccaaagcaggaggattgcttgagctcaggagtttgagaccagcctgggcaacatagcaagaccctgtctctacaaaaaataaaaagttagccatgtgtggtggtgggtacctgtaatcccagctccttgggaggctgaggtgggaagatcacttgagcctgggaggcagaggttgcagtgagctgagactctgtcactgtactccagcctgggtggcagagtgagaccctgtcttgaaaaaaaaaattttttttaagtagccagcctgggcaacatggtgagatgcaatctcaataaataaataaataataaatagcagctgggcgtagtgtagcctgaagttccagctactagggaggctgaggtaggaggatctcttgagcttggaaggttgagactacagtgaactatgattgcaccactgcactctagcctgggcgacagagcaagatgttgtctctaaaaaataaggtacatactttaattccctccctacccccattttattgttgagaatctaggtttggaggggttaaataacacagcagtggtggaacaggaattccaaccccagtctttctgacacaggccatagtagacagcagtctgaggttttaaacccagatctcttaagcaccaaccaagcacctttgggattgtcagtaaacctctctgagcgcattttctcaaggaaaaacaaagatgatcagattctttgcctcaagtacctttctgattgttaaatatgacagcacatgtgaaggcctttatgaaccatctccgacctctctagtaccctctggaagcaggcagggacagtatgttcacttaagagtcattcaatagatatgtgtccaatgcatgaagttccgatgtttgaatcttcagaagtgcattgttatcattcgatcagatgcctctgtttcatttctcatggctcaaaaggtcagttcttttaagatggaggaggcaatagtctctttttaaaatgtcactttgactgagtgctgtcaagtaattttccttggcatatctttttctgtgaccggctgtttaatgggagtttccacgaatccatgaaacaagacagccaaggggaaatttctctcttatagtctttttttgctgttggcttaaaaaagccccaaagtggctgggcatgcctgtaatcctagcactttgagaggctgcagcggaaggatcgcttgagcccaggagttcaagaacagcctaggtaacatagcaagatccctgtctctacaaaataataataataataataataataataataataataataataataattagtcgagcacagcagtgtgtgcctgtagtcccaactagagagtgaagtaggaggattgtttgagccccagagtttgaggctgcagtgaactgtgatcgtaccagtgcactccagcctgggcaacagagcaagaccctgtctcaaaaaaacaaaacaaaacaaaaccatgaagtgtgatcccctccaatttttagtaacatcgaagattgggtctgagcatggcttactcctgcatgtgcctcaagatttaatattttttggccgggcacagtggctcacacctgtaatcccagcactttgggaggccaaggtggagggaacacttgaggtcaggagttcgagaccagcctggccaacatggtaaaaccctatcactactaaaaatacaaaaactagtcgggtgtggttgtgcacgcctgtagtcccagctacttgggaggctgagacaggagaatcccttgaacctgggaggtggaggttgcagtgagccaagatcacaccattgcactctagcctaggctagagagagaggctccatctcaaaaaaaaaaaaaagaagatttaataattttaaagtgttatcagccttgatctacttgactcatatagagtcaggtagatctggcccaagatctgtgaataaaggaacatcgttcctgaccacaagcagggccatgctccaactcttgcacaaaagcacttttgtttcactcatggtggcccccatgatggacctcacacttctcccgatactagactgcattgcatagtaacctgcaatgctctttccttcatcatcagtttccaattctgatgtcacgatttggttcatgacattcctgatagattctctatgtctatcaggaagggtcctaaaactctcaataaaagtagttctacagttttttaaaaatgaaacacacagggcacggttgctcacgcctgtaatcccagcactttgggaggctgaggcaggtggatctcctgaggtcaggagttcgagaccagcctggccaacatggtgaaaccccatctgtactaaaagcacaaaaattagccaggcatggtggcgggcgcctgtaatcccagctactcaggaggctgaggtgggagaatcgcttgaacctgagaggcagaggttgcagtgagccaagatcatgccattgcactctagcctgggcgacaaaagtgaaactccgtctcaataaaaaaacaaaaacaaacaaacaaacagaaacaaaaacaaacacgctcttaccatataatccagaaaattcttcttaggatttgcccaaaagagttgaaaacttctgtccatacaaaaccctgcacgcacatgaagtttataacagctttactcactatcgccaaaacttggaagcagccaagatgtccctcagtaggtgaatggatacataacaatggaatattattcagtgctaaaaacaaatgagctatcaaggcatgaaaagacgaaggaaaattacagctgggcattgtggctcatgcctgtaatcccagcactttgggaggtcaaggcagatggatcagctgaggtcaggagttcgagttcagcctggccaacatggtgaaaccctgtctctgctaaaaatacaaaaattaaccaggtgtgatggtggacacctgtaatctgagctactcaggaggctgaagcaggagaatcgcttgaatcagggagatggagtttgctgtgagccgagatcgtaccactgcactccagcctgggtgacagagcgagactctgtctaaaaaaaaaaaaaggcaggaagaaaacttaaatgcttgttactaaatgaaagatgctaatctgaaaaggccacgtactgtacgattccaactatacaacattctggaagagacaggaataggtggagtagagaagattttctagggcagtgacactcctctgcatgatactaaaatggtgaatacatgtcactagacatctgtccaaaaccatggaatgtgcaggcagtccccaacttataatggttaaacttaacgatttttcaactttatgaaggtgggaaaatggtgcattcagtgaaaccgtactttgaataccgacaaaaccatgttttttcactttcaatacagtattcaataaattacatgagatggtcaacactttattataaaataggatttgtgtttgataattttgcccaatggtaggctaatctaagtgacctgaacatgttaagtaggctaggctaagctaagatgctcggtaggtgaggtgtattaaatacattttgggctgggcatggtggctcacatctgtaatcccagtactttgtgaggctaagatgggcagatcacttggattcaggagttcgagaccagcctgggcaacatagtgagatcctgtctctacaaaaaatacaaaaattcaccaggtgtggtggcatgtgcctatagtcccagctattcaggagactgaggcaaaggaccacttgagccttggaggcggaggttgcagtgagcccagatcgcacaactgcactgcagcctgggtgctagagtgagaccctatccaataaataaataaatgcattttgacttattttcaacttgtgatagttttgagatgtaatcccatgagtcaaagagcatctgtacaataccaagagtgaaccctaatgtaactatggactttttgtgataataatgtgtcaaaatagatccacccattggaatacatgtgccactcgatgccggatcttgacagtgggagaagctagacatgcatgggtgcagggggcagtcaggagctctgtgcttccagtccatttagccatgaacctaaaactgctctaaaaaacgagtctacttttataaaagtagttttgttttgttttttttttccagagaatagtctcactctgtcgcccaggctggagtgcaatggcgtgatctcagcgcactgcaacctccgcctcctgggttcaagcgattctcctgcctcagcctccccagtagctgggattacaggcacatgccaccacgcctggctaattttgtattttttgtagaaatagggttttgcgatgtttgccaggctgctctcgaactcctgacctcaggtgatacgcccgccttggcctcccaaagtgccgggattacaggcgtgagccaccatgcccagcctaaaggtagcttttttttttttattttttattttttgagacggaatttcactcgttgcccaggctggagtgcgatggctcgatcttagctcactgcaacccccacctccacagttcaagtgattctcctgtctcagcctcctgagtaactgggattacaggcgcatgccaccgcgcctaattttttaatttttagtagagatggggtttcatcatattggtcaggctggtctcaaactcctgacctcaggtgatccacccgcttcggcctcccaaagtgctgggattacaggcctgagtcaccaagcctggccagcagttttatttcacttttattttaataagattcctgaacaccacacaatcctcgaatcgtggttgttaccaaaaaatcaagtaccaagtggccgggaagcattgtcccaaatgcctttaaaggcatattctcacaaatgttcatctttcatgtacacttggctttaaaagaacacatcaaattttacatcaacataaaggtatgtgagtgatacacaaatgtgttcttgcacatcattataaggctattagtttgttctgtgcaagcatatacactaagcttaaatttatcttcttcaaaagccacctctgctcctgctatgaggttttagatcacccaagttgtacatttcctaaatccctcttcagttcccattcccatcctgtttttgtgtaaatccaagttttctcctaaaacttctggagcatctctagaagataagttctcccgacaattccaagaaacccacgagtaaggtacttaaatataacacatttatgagaagggttggcttgtcctctgtgcttttccttccttcctataaacatgtgcagacggcaggaaagtacccccgcctccacccctcaacagcgaagcttctgaagatcccgacggaaggcatggcagccatctccaatcattcttctgtttttgatgtgtggcttttgatgagagaacagtgatatgaacaccctttgcaccaaagtgacttgcttattttttttattaaatgatacattgaaagtataaaaagttgccgcagtacaaacaaattacagaataatgcatataaaagcgctatggactacacgtgacaattctgcttaacttccatcttgatgattttatatcagtatccaaaattatatactccagcattttttccgaatatagtcttacatgattgcaattcctgaggtaaactaagtgtccactgccaacatccttggacgaaaaccaagtcccccgggagaattcagatatttatattcacacatacaatacaacggaattcatcaatgtaatcagatattgcagatttaaaaatggaaaatggactcttgcaatacttctgcatccatatataattttaccagcagggcctcccaaaatgttgtgtaagtatagtttaaatggatttcattaataagtttctgcatttagataaaaattcttggctaatctgtaagaagtgaacactgactagcattgccaaacagaaaatcaaaagtttcaacaatttgcaaagcagcacagaattgacaccctaaagaggatgccaattttgctaactacagctcttaccactcttctccatggaaaacctttaagctaaatgttgtcagtgtttaggtgtgcaggcaaaatttaattctgaatataccatcgaacttttgccaatcaggagctgtctatcatcatagtcagttgttttcaatgaaatgagcctgtggacactacattaaaaatacttctttaataaatatcgaagtagcgtattagagatagcacatactatttttctatcccaagaataaaaattgatgtttggtaagagtttcggagcccaaacaagtagggggctggccctcttctggctcatctgtgattgcacaaccgagggccacacggagattaaacaatgccatctttgaaaaatccctttctggtatttctcccaaagcctgtctcttcatgcttacttcacattctttatctaataaaataaactctttgttttatttacagcaaaattattacagcaaatttacttctcctctaccttttaattaaatcttccagtaagccaaagtctaaggaaagaaaaagtacattgttgcctattgaaaaggtaatacaaagccctttcatttccttacaaactttaagggcctttataatacttcctaaatggctgggctcagtggctcacacctgtaatcccagcgctttgggaggctggggcacacagatcacctgaggtcaggagttcaagaccagcctggccagcatggtgaaaccccatctctactaaaaatacaaaaactactccggtgtggtggcacaggcctgttttcccagctacttgggaggctgaggcaggagaatcacttgaatccgggaggcagagattgcagtgagccgagatcgtgccactgcactccagtctgggtgacagagcgagactccatctcaaaaaaacaaaaaatacttcgtaaaaacaatactttttttttcaagtcaaatccaataagctagatgacaagagttagcttttattcacaaatgtagttaaacatgaggggtgttttgtagaaactccaatttctacaaacattagtggtgcattttggtaacattgggacaataaataagttatttaattaataatacaattttaagacaaaagataccccaaacaaagcattatctgttgactgcctgagaaacatgaagatcttcaatgttagtacttttctgttcctcctttcttaggtggtcatctgaaatgcacagaaaccaatgttaatacttatcccaagtcaaaacacacagataggtagacatagctacaaatatcttaggatgttacatatttaatattctatgagtactttagatggtttaggacaatgaaaaaaacccattattttttaaacactattgaagaaatcagaggccaagcgtggtggctcacgcctgtaatcccagtactttgggaggccgaggtgggtggatcacctgaggtcaagagttatagactagtctggccaacatggtgaaaccccgtgtctcctcaaaatacaaaaattacccgggcgtggtggcaggcgcctgtaatcccagctactcgggaggctgaggcaggagaattgcttgaacctgggaggcagaagttgcagtgagccaagatcgtgccatttcactccagcctgggcaacaagagtgaaactcggtctcaaaaaaaaaaaaaaaaaaaagaaagaaatcagaaatgtctggcattagggactctaattattcaaaagagtttcttgactttttttttgagtagagtacaacctgcagtaaacccatgcataagtagttacaaacctctctcttacatgtaaggaatgaaatttgcaagaaaggacaaggtgttcaatcagcattttgagggttgccaaagctcttcaattacaacacaatgaaaaccacttcaaatagatcacctgaggtcaggagatagagaccctgtctctactaaaaatataaaaattagccaggcgtggtggcgggcacctacaatcccagctacttgggaggctgagggcaggagaatcgcttgaactcagaagtggaggttgcagtgagccgagatcgtgccactgcactccagcctgggcgacagagcaagactcttgtctcgagaagaaaaaaaaagaacctagagacttaatatcctaatgcaacaaaaatgtaatgcaaaaactagattcttgagaatatatgaaccccaaacactttctacaactgataaaacatctttcttgcaacaactttgataataggaaaaaatatatacataaatttagataagctgctagaaaatgcaattttatcactgggttttctaattctacaatgtgattatacacacgctttattagttctcagctgcttattctcagtgccaatactactttaagggtctggaaaacagatggaaatctctctccctttattttaggtaactttgctggacagaaaaaaaattaacaatttcctcagaaggtaacaattttaggtcttctagaaaagtgttataaaaaatgaagtctactatgcttgatagatgtgcaataaagttaagctgatgactgtccctattataaaaatctggtctttcatttacaataaaaatcttcgccaggaatgtagtcccagctgtagtcccagctacttgggaggctgaggtgggaggatcacctgggcctgtgaggtcaaggctgcagagagccatgattgtgtcactgcactccagcctgggagacagagtgagaccctatctcttaaaaacaaaaaaaaaaagaaaaaaaatgtgtgtgtgtgtatatatatataaagttgaatagcaaaaactactttgccttcaagattacaagcactaacagcagcagtacaaatgcactggctgtcatttcaaaggtgggtgtgcctacataaaccctcttcattttttttcagcactgaaaacttggatgagagaagcactttttcatcttggcatgctttggacttacttctttctttccttttttttttttttttttgagacagagtctcgctctgtcgcccaggctggagtgtagtggcgcaatctcggctcactgcaacctccacctcctgggttcaagcgattttcctgcctcggcctcccgagtagctgggactacaggcgtacaccaccacgtccagctaatttttgtattttcagtagagacagggtttcaccatgttggctaggctggtctcgaactcctgacctcaagtgatctgcccacctaggcctcccaaggtgctgggattacaggggtgagctgccgtggcctggcctgaacttattttcaagtaaaagccaatttagtttcagggtttgatatttctgttgaatgagcttctgtggagacaaggtgctgtgatgtagaataaggattttagtatcttcataaccttttcaatgctgtcaaataagagttacggagacagtaagctagagttgaggaagtaaatggaaagcttaagtgtgttactgaaacatgatgcagttctggctgacaactttcaaggcactacacaaagaggttgtgtcaataaaatttttgatgaccaagaaaataatttgcaaaatcactgttcttccccgattcattcagcagtcatcctcatttctgagctgtctgcagagctttccacagaacaggcacccaaggtggctttactgacttgaactcgattctgatgttcctggcactttagtggtgtacaggtcgtgtgtctaggtgtctctttccctccctccctccataaatacctttctctctatggtgtatgcgtaatctaccgctttcatctcagaagaacagaaattggttaggaaatagtgttccttataactttcttactagtcatgagccgtgagtattaacaaggctgattatgaaacttacaaaccagaaagttatttctcaagcggttatttttctttatgggactgatagtatcaatgacttggggttgctgtgttaagaagtgttaaggtgtacaatatccactggtgacaactgaactcagaaactcatattgtcatatattcttggtaagtgtatagactgataaagcctttttggaggggaattagacaatatctactacatttttaaatatgcatatcctttgaaccaacaactctactttaggcatccacacaagagaaacgtgtagacaaagatacaatgttacatcacaatactgtaatgtgtggacaaagatacaatgttacatcacaataccgtaaaagcaaaatatttaaaactaaataagagtgattataaggtgggagagtagcctgggcaacaggacaagaccctgactgcaaaaaattaaaaaataagcgaggtgcagtggtgcacccctatagtcccggctacttgggatgctgatgtggaaagactgatcccaggagtttgaggctacagtgagctatgattgtgccactgcactccaacctggatgacagagtaagacctcatctctaaaattaaaaaaaggatgattgtaataatactctggaatatgaaacaaagttaaaaacgagatctacacgtatcaacaagtaaaaaaaagcaaattgcaggataacgtgcaccataacaatgtatatatatttaaatacacagaaatgagtcccgaaggggctgggcatggccagatgcagtggctcacacctgtaatcccagcactttgggaggccaaggggggtggattgcctgaggtcatgagttggagaccagcctggccaacacagtgaacctcatctctactaaaaatacaaaaattaggcgggtgtggtagcacatgcctgcagccccagctacttgggaggcaggagaatcacttgaacctgggaggcggaggttgcagtgaggtgagattgtgccattgcactccagcctgggtgacagagtgacagtccatctaaaatttaaataataataataaaataaaataaaataaataaaataaaatagaaatgagtcccaaagaataccctgcaaactgctaacagggacaccttctataaaaagggagaagaattgaggagttagggagaggcaagaaggaagaaaggaaagttaaagggaactttttactatttaaaaaatttagagatttactcatgtacttgcactattaatgttttattttgctcgttaagtacttgccaattagtaggcagtaatgtcagttccttaccaatccctaaaaagagaatttggaaaacttctccataatctatatgtggaaaggtatacgggaacagcaatcaaatgtgctgattctgctactaattatctgctacaggtcttagttgagttacttaacctcttagtattggaaccttcttaaagttttctcaactatgaaataagtagatgggaatgacttattttccaacgttccatccagttcagcattctaatatatatagaaagatatctcctagtgcagtcagaaaccacctccaaaataggttatcctgattcactgtttactttcagacctcaagagacaccaagcatctaacacggtcactactggtcatagcagtttaggaaactacaaaggcaatccacattttaggcgtttcctaaaagtttcctaaaagttcgtgtcaacattcaagatttacatttgttctgataattggcagcctaaaccccacctttaactgtccttaaaaattgaccagctcttggttgggcgcggtggctcaagcctgtaatcccagcactttgggaggccaaggtgggcggatcatgaggtcaggagatcaagaccatcctggctaacacagggaaaccctgtctccactaaagatacaaaaaattagccgagtgtggtgatgggcgcctgtagtcccagctacttgggaggctgaggcaggggaatggcatgaacccaggaggcagagcttacagtgagacgagatcacaccactacactctagcctgggcgacagagcgagactctgtctcaaaaaaaaaaaaaaattgatcagctctctaccacaactgaaaacactgagctataacccactcaattcaaatggtgaaaatgggatcccattgctgggataatcaaaataagtcagggccaggtacaggctcgtgcctgtaacccccacactctgagaggctgaggtgggaaatcacttaagaccgagttcaagaccagcctagtgaacacggttgagacttccatgtccacaaaaattaaaaaattagctgggtgtggtgcctgaagtcctagctacttgggaagctgaggcaagaaggtgagaggattgcttgagcccggcagttcaaggttacggtgagctataatagcaccactgcactctagtcaggcgacagagtgactagaaaaaatacataaaaatttatgtatttttatgtctcaaaaaaatacataaaaatttatgtatttttatgtctcaaaaaaatacataaaaatttaaaagctaccaaaagctcatttaaaaaacaggcaatctgaaagaaatgtgggcgattctcctaacaatctgtaacttgtaggtaacttccactgtaacataaacagtatcctaaaaatgcaaatgacttctctatctgtatttagcaatcttaccttttattttgcagtcatggagaggaaaaaaaataatcacttgataaaaagctatttattcagtataccaaggatctaagctgctccaaatacttacaatttacatgaaaattggagttttcagtatttttttgtttttttttaaatttaattaatataattttttaattaaaaaaatagagatggggtttcaccatgtcacttaggctagtctcaaactcctggcctcaagcgatccacctgcctcggcctcccaaactgctgggattacaggcatgagccattgtgcctagcccagagttttaaatacttctataaagaaattacatctaagaattctgcccagttatgcctcccacccttccctgtccaagattctttacaaaaagcattctgtttcttggagtaacataggctagacatattagatataagcagaattaaactatgactcaaaagctcagtaaagactccaaaagaaaaatatataggaagaaaacatatttgctgacagctaaatgatgaatcttggaaaactcatacccattggctttcttctactaggttgtctgccaagacttgggtctgaaggctgaagtgaaggccctttcagaaatgcattctggatgccatccttagttccacgcaagaaatgggctaaaatcccatataaaagaggtctatagcaggaagaaaacaaaacaaaaccaaaagctaataaatctgcataaacgggaaaagcttaaaacatttattctttaaaaggtaacctctgacatcaaaaagaccaagtgattcactagactttaaaaagcggcatgattatccaaaatgcaaattgttcatacttttaaatttaagagtaccacttaatttcatgacaattttaaaacccagagaaaacatgttaacaacttaaacctcatctacactgaaatatcatttctatcaatccacaggaatctcttttaaactccaaagtccagtagagtatttcccaatacctaaccccatctaatacacaacaggtattcaataaacacctcttgattaataagtccttgccctgaaaaagtcttaggtcctgagagccaggtgacctgagttcaaattctggctttgccatttgctagctgtgggactctgtgtaagattcttaacctctccagcctcataaatgtttcttcctttataaattaggataagcaccgtccctcccttatagggctgttatgcactaaatgagttaataaatgtcaagtgttttttactgtgcctggcacatatgaaatggtatataaatgttagctcctgtgtagctaacatttatttagattaatatttacattacctattattttaaaatcttctttatagtttacagaacgtatacctcttctcatctaatcctcatcgtgtaatgtcaagatcatcaactgcaatttataaaggagaaaaccacagccaggagatttgctagagattcccccagatagtaaacaaagtttacacttgaaccccaaatcccatattgttttccttacagtgtgctgcctgggaatttatattagtactcttgcatcaaggaaagctgctctgctgacaatcaagagtggtacaatggaaatgttttcctttgtttccaatctcaaatttgaaaacacaattaaaaggatttaatctttatttttaatttttgtgggtacatagtaggtgtatatatttgtggggaggatttattttttgagatatgtatctatttactagctggtataatggtttacagtacgacgctcccttccaaagatggaatctcattgccctctgagtgtgagctgaactcacttctaactggcacaaagctgacttcagaggccacgtggtaatggccctgcagcttcctccttgctttctctcttggattgctgcctttgggagaagtcagatgcctcaggacacttcagcagccctggaaagttacatgcagtaaggaattgaggccgcctgtcaatatcattatgagtttggaagcagatagttcagccacattcaaggcttccgactacaaccctggctggcatcttgactccaacctcaagggggagcctgagctagacttacgtgactaagccaatcccaaatccccgaatattccacaaataatctatgttgttgttctaagctaccaaattctggaataatatcacactaatttttccatgccacagggaaaccaggaaagtaagtttctttatttaataagatgccgcaactcttatgaaagcgtcacctagtaatataaaacaggtctctttgtttactttaatcttccccaaagtgttaactggttcaagatgatttttaaatgttaaaagttttattttttaaataaatattcaaaaaaatgtacttgtgattaaaattttgggttggacatgggggctcaggcctgtaatcccaggactttggggggccagcctggcctcaaacaggagtttgagacagcctgaacaacatagcgagtcccctagctctacagcaattttattttaaattagccacagaaggtaatatgcacctgtggtcccagctacttgggaggctgaggtgagaggatcgcttgagtgcagaagggagaggcaacttgcaaattcatggattaaggtttatcttttaaaataagtttcaaaaagataaagaaaagtgcggcctcacaataacttgcctgtaattctgaaatgcaaaattctgaaaactggattctcttcatatatctggcaaaaaatcatcagatggcaagggttgacctaacaaggctattaacaaggctattacagactttatcttactttgtgtgaaaacattaatgtgctgggtgtggtggctcaagcctgtaatcccagcactttgggaggccaaggcaggaggatcacctgaggtcgggagttcaagaccagcctgaccaacatggagaaaccccgtatctactaaaaatacaaaattagccgggtgtggtggcatgctcctgtaatcccagctactcaggaggctgaggcagaagagtcacttgaacccaagaggcagaggttgcagtgagctgagatcatgtcattgcactcaaaaaaaaaaaaaaagagaaagaaaatattaatgtgattgtggaatactactttaggactccctggcacatacatgtagtatttggtagatgtaccatattactttttttttttttttaaagaattgaagtcttgggccgatggctcacacctgtaatcctagcactttgggaggccgaggcaggaggatcatgaggtcaggagatcgagaccatcctggctaacacggtgaaaccgtctctactaaaaatacaaaaaattagccaggcgtggtggcatgcgtctatagtcccagctacttgggaggctgaggcaggagaatcgcttgaacctgggaggcggcagttgccgtgagccgagatcacgccactgcactccagcctggacgacagagtgagactctgtctcgaaaaaaaaaaaaagaactctcgctgtgtggcccacactggagtgcagcagcaagatcatggctcactgcagcctcaatctcctggatttaagtaatcttcttgcctcaccctcctaagtagctaggactacaggcatgtcattttaaaacccgacagcatttggattttcaaacatgtatctggcctcagtggtttcagatgcagcactgcagatctgtaagtaaataatatgagtaatatgtgactatggcaaactctgtgaatgccaatcactgaagtgtgagaaacaagggcttaaagaagttacctaacttttaaaaaataaagccgttttagcaacttttttttttgcttcctcatcctctctcaaacttacttttttttttttttttggaaacggagtctcgcttctgtcgcccaggctgagtgcagtggcacgatctcggctcactgcaagctccacctccccgtttgacgcccattttcctgcctcggcctcccaagtagctgggactacaggcatccgccaccttgcccggctaattttttgtatgtttagcagagacggggtttcaccgtgttagccaggatggtctccatttcctaacctcgtgatctgcccgcctcggcctcccaaagtgctgagattacaggcgtgagccaatgcgcccggccttcttttttaaaaaaatatcaaacatttcacgaatttgcgtgtcatccctttgccggggccatgctaatctctgtaccgctccaattttagtttatgtgctgttaaagtgagcacaaacttcttaatactttcatctgaagtaggtatctcaaaagctaccaagaagccagtaatagtcattgcttatttccatcaactgctaaatgtaaaatgatgtcttgtattaaatgatgtaataactcactgctcatcctaagtcacgcttagattcccccaattatttttcccactgttctcaattatacaatttttatacttttcaaaacacttgttaccaggtgcagtggctcatgcctgtaatcccaacactttggaaggccaaggtaggtggataacttgagctgaggaattggagaccagcctggctaacatggtaaaacaccatttctaaaaaaaatacaaaaattggccaggcatgatggtgcatgccagcgtatgcctgtaattccagctacatgggaggctgaggtgggagaatcgcttgagcccaggagttcgaggctgcagtgagccatgatcaagccgctgcactctagagacctgggcaacagagtgaaaccctgccttgaaaaaacaaacaaaaaaacctcacagcactttgggaggtggaggtgggcagatcacttgaggccaggagttcgagaccggcctggccaacatggtgaaaccccatctctacaaaaaaatatgaaaaaaaattagctgggcatggtggtgcacacctgtaatcccagctactcaggaggctgaggcagaatcagttgaacccaggaggagattgcggtgagctgagatggggccactgcactccagcatgggcgacagagcgagaccctatctcacaaaaaggaaaaaagaaaaaaaaaagaaacaagggaagatgagaggaagagaaagaggaaaatgccataaaggagttactatctgaacagggccaacagaaaggaaagatgctccaatagaagttaagatgctccaatagaagagggagaaaggtgatgtagggcttctaggataagggaatggtttacaaggcaaagcagcataaagttgcaaagtgtcttccaggcataatcagaaatcaggtgtgagcagatagaacaacagacgggtagaaagaggtgtaaagtgctacgctaagcaacagggacttcactatacacacaatgacaaaggtagtatatgatcctggaacattaattttacacaaggatttgtgggagagttagatttaactggaatgtcatttaaaacatttatatagtaaagcaaacaactttcagaacttttttttttttttttgagacagggtctgattctgtcacctaggctagagtgcagtggtgtgatcttggctcactgcaacctccgctgcccaggttaaagcgattctcatgcctgagcctccctagcagctgggactacaggcacacgccaccatgccttgctaatctttttgttatttttagtagagatggggtttcgccatgttgaccaggctggtctcaaactcctgacctcaggtgatccacttgcctcagcctctgaagtgctgggactacaggcatgagccaccacgtctggctagagatggggtttccccatgttgtccaggctagtcttgaactcctgagctcaagtgatccttccacttcagccttccaaagtgctggcattacaggcacgagatacctcacttggccttaagaacttttaggatgagaaaacgtaaggcttcaaagaaagttctagatttaaaaaaaggctgctttaagctatgttctcaggtctcctatgtacttttttttttttttttggctatacagggactctccagaaaaagtttaagaaacactgaaatagaaaaaaactaagaaaactagaaagtggtcatcctccttttcaagagcatagttggtgagaggaggtacacagagggcaaaggacagagtaatagtaacgaaagcagtgggctgattcagtaatcttggtagaaaaaggtattcgagcagaagcttggggttggaagttcatagtttttgtttttgtttttgtttttgttttaggagaggagagatctgagtacattcctaagttggagtgaaggaagagttaaatatgaagaaaacaactgacaaggcaaagtctcagaggccaggcatggagggctcacacctgcaaccctagcactttgggaggccaaggcaggaagatcacttgaggtcaggagttcgagaccagcctgggcaaaaaagcgaggccttgcctctacaaaaataatttgaaaatacaaataaaagttgaaattataaattaaaaaacaaacaaagccttagaaggacaaaggatcaagaagtcaaaaggagctaactccagaaagaagatgctgagtcactctgaagccatgtaattgtagcttcagcaaacacagatctcatctgacttattcactgctgcacaccctggatttaggacaatgcttgacacacactagatctgaataaatacttgaattaaaatgaagtaaaaccaccatggtgcaattatgactcaatacaatatgtggaaacttctttaaaaaaatgtcttacattgtattatcctttgattcttcaaatgcatttagttcatggatgagaaactgtctgtccaacggaactacaggttgaccagattctgggagaaataaattcatgagaacactcagtctattaaactaaaaagcaaataagattttgaaaagaatcacatttaccagacatacactttttagattttggaagaatgatgacaacacacaccaagacagatcaaattgcctgtgattttatgactttcaaaatatctcttttgttaaatgcatgtcttaatacagtttaacataaattcactttttaaattccccagtgtttggttggaaaaataccatttctatatccaaattataatactaaattttggaagtctgtttatcaataacttatttttgaaaagaatatccacttggtgacaatacttataaataaaaattaaagttaacctgaagtgtggggcagctggaactttcacactttgctggtgggaaagcacaatggtacaggcactttggaaaacagttgagcagttttcttataaaggtgagcgtgcacttaaccacacaacccagcaatctcactcttagctttctacccaagattaatgaaaacttatgttctcacaaaaacctgtatgtaaatgtttatggcagcttgattcctaactgctaaaactagaaacaactcaatgcccatcaactggtcatagatgagcaaactagcacagccacacaatagaacagtgttcaaaggaaaaacaaacatggctgaatcttgaatgtattacactaagtgaaaaaaggcagactcaaaaggctacatcatgtacggttccatctacagcaagggtccccaacccccgagccacagattagaaactgggccacacagcaggaggtgaggagtgggcaagcaagtgagggaagcttgatctgtgtttacagctgctgcccatcactagcatcactgcctgagctcagcctcctgttggcagaattagattctcatagaagcgtgaaccctattgtgaactgcacatgcgagggatctgggctgtgcactccttatgagaatctaaggcctgatgatctctcactgcctcccatcacccccagatgggaccatctagttgcaggaaaacaggcttagggctcccactgattctacattatggtgagttataattatttcattatatattacaacacaatcatagaaataaaatgcacaataaatggagtatgcttgaatcatcccgaaccatcctcccaggtccatggaaaaattgtcttccatgaaaccagtccctggtgccaaaaaggctggtgatatcttgattgtgatctggtagtaattacacaactgcaggcatttgactaaagtacagaactgtacagtttaaaaggtaaattttattgtatgtaaattatatcccagttttttaaaaaaagccaaaccatttaatatgaaaacttgactactgtcactatatttcattctagtgaatcccaagtccccactattttcataatttcttcttttctgggtgtaactggtatcatacagccatctataacaaacaaaggaaagcagagatgctgatatcaaagatccttaaaccataaaaatcatgagtctttatgtagttcagacgtatgtttaatattaaataaaggatctgtaacgaaaaattctaacttcacaaagaattcattctctcttgcaaaatctacttcctggcctcgcttctttgctgaggcatgaagtagtcaaagcagagatggaacctgaaacgagggaatccgatgacacacattcagggtgcctcagaccaacccccagctgcatcccccaccccaccaagtccaggggtaaccaggattctgacttatttatatccatccagtctctcctcacttttttgaaagaagacatttaaaagtcagcagaagatattaaaaatattctcaccactcaataactgttacacttgaagagcaaatttatttctcaagaaataaaattcaacagataaagggaatttatctttatctccccacccccaacccccaatatcattctctgcctcctatcactaggatgagtttggagtttcccgctgctagagtctggatatttgtctccgcccaaatctcatgttgcaacgcactccccagtgttggaagtgggacctggcgggagttgtttgggtcatgggggtggatccctcatggcctggtgctgtccttaccacagtgagtgggttctcatgagaacaggtcatttataagtgtgtggcactaaccttccccacccttggcccctgccttcaccatgtaacgtgcttgctgcagtgagcaaaagctccctgaggcctcccagaagctaagcagatgccagtgccatgcttgtacagtctgcagaaccgtgagccaagtaaacctcttttcttcaaccgggtgcggtggctcacgcctgtaatcccaacattttgggaggccgaggagggcggatcacgaggtcaggagactgagaccatcctggctaacggtgaaaccctgtctctactaaaaatacaaaaaattagctgggcatggcctgtagtcccagctacttgggaggctgaggcaggagaatcacttgaacccaggaggtagacgttgcagtgagccgagatcaatccacactccagcctgggtgacagagcaagactctgtctcaaaacaaacaaacaaacaaacaaacatacaaaaaaacctcttctcttcataaattacccagtctcaggtgtttatttatagcaatccaaaaacaacctaatataccagcctagtcctttataaataccatgcttttagatacatacatttgtaaatgtacctaagcactacatagtagtaatatttcaaagttttatctccattatatctatctatctatctatctatctatctatctatctatctatctatctagatacacacacacacacacacaaatagacatatatctacatatctatatatagacagggacagttttttttcttttaagagacaggagttggaccagcctgtccaatatagtgaaaccccgtctctactaaaaaatacaaaaattcgccgggcctggcagcacacacctgtagttccaggtactcgggaggctgaggcaggagaactgcttgaacccaggaggcggaggatgcagtgagctgagatcacaatagagtgagactccgtctcaaaaaaaaagaaagaaaaaaaagacaggggttgggtgcagtggctcatgcctgtaatcccagcatttggggagtgtgagataggtggatcacctgagcccaggagttcaataccaggctgggcaacatagtgagagctcatctctataaataataaaaaaatttagctgggcatggaggcatgcacctgtggtcccagctactcaggagactgacgcaggaagactgcttgagcccaggaggtgaaagttgcaataagccatgatcgcaccactgcagtccagcctttgcaacagagtgagattctgtctctggaaaaagaaaaaagagacagggtctctctctgttgcccagactggagtgcagtgatgcgatcatggctcactaaagcccagagcacatgggctcacatgatcaccccctccccgacccctgctcagcctcagctaggacaacagacacgtgccaccatgcatggctaattttaaaaactcttttccagagatggggtctccctgtgttgcccaggctggtcgcgaactcctgggctcaagtaatcttgcctcggcctcccaaagcactgagattacaggtgtgagccacctacccagcctattttttaacaaataatatacttaatcagcgtatatttttaaagcttaatacacaggaaaaaactggtggcaaacaggacaaaacgtcaacaattgtttattctcggttacaggaattatagatgatttttccaagtatatgcctagtttaagtgattatttagttatgtattttctcttgtaagaatctgtttaagctacagaaagaacccatgtgatttttgtgtcccagtcacccagatggcactatctggtaagggaattagatttctaggataaacagtttctgagaattggggaaaggggagaaacagattttatgtgataaataataaccacttacctgctatgaggacagatgctgtatacttatatttgttgaattctaaatactctcgaattaattcattaattagaaggttttcatgagacaatgatggtcggggttcacggtcatcatctagggcattgaaaacttcagctcggatccttgcttttaaatgccctaataccccctttttttccaaggtgtcctttaaaactgttcgatataaaatattaaggcttcagttacagagtaaatttgtcattcttaggcatactttgaaaagaaatgttgaaaaggtaaatggtacaaaaacagctctcaagcagctcttaatctaaacattgtgacaaattattaaacaattacactaccaccagccatgtttatactaaaacatatagttctcatgttgcagtgatttagtcttaatatatttgagcaaattcaagtttattcctacatcatcagcactgtcaggggctgtagtctaatacatattcttttttattttatttattattttttttgagacacagtctcgctctttcacccaggctggagtgcagtggcacgatctcagctcactgcaacctctgcctcccaggttcaagcaattctcctgcctcagcctccagggtagttgggactacaggcacgtgccaccacgcccaactatttcttttttgtatttttagtagagacggggtttcactgtgttggccaggatggtctcaatctcctgacctcgtgatccacccacctcagcctcccaaagtgttgggattacaggtgtcagccaccgtgcccggccaatacataattctttagtgaggggaaaaggcgggggataggattatagttgcttactgagacctgaacttaagccccagtctctcatatattttcaagagtgtctgccactgcacacaggttctgcttgtcactaacaacctctggtctagaaagatgattaaagaaaacaactacattccataaaagaagtctgttgggttactgtgtaaaaaccttgatggcagggcatggtggctcatgcctgtaacccagcactttgggaggctcaggcgggcggatcacgagatcagcaaattgagaccatcttggctaacaaggtgaaatccccctctctactaaaaaaatacaaaaaattagccgggtgtggtggcacgcacctgtagtcccagcaacttgggaggctgaggcacaagaattacttgaacctgggaggtggagggtgcagtgagctgaggtggtgccactgcactctagcctgggcgaaagagtgagactctgtttaaaacaaccaaccaaccaaccaaccaaaaaaaaaaacacaaacctttgataatccacaacgctttagggagtgaaaaggtgttgggtttttcattgttgttattttgaaacaatctcgctctgtcgccaggttggagtgcagtggcacgatctcggctcactgcaatctccaggctccctggttcaagcaattctcctgcctcagcctcccaaatagctgggattacaggtgtgcgataccacgactggctaatttttgtatttttagtagagacagggtttcactatgttggccaggatggtctccatctcctgacctcgtgatccacccgcctcagcctcccaaagtactgggattacaggcatgagccactgcgcccactggcctcgttgttttaaagacaactatgagttaattccttagaacagtaggattctgaaattttaagcctagttagaaatctaccacgtgactgtatcaatgccatcttaaggagtcagggatgtgtatgcagaatggaaatctaacttactgattagccagagtcaccatgacaaagcagttatgatcatgggatttggctgtacatacttagtatagataatggggatcttaggactgaattggcaccatcccttgtagtgatctgcaacttttattttcaaacagttcctactggctaaatgacaacttcagagaatgaacacatctcatccacagagtcaagaacagagcaagagctcagtaggtgtcacctagaaggattataatacattgctgtacactactgggaaatcaatgtagtttaacactgttctgcaccctgccaaaggcaccaagtaagtacatcacaataacaaaaatccataaagagagcccaggagcttatccaagtcagtatggacataagatctttctaagcttcaataaataacgtcaacaataaccctggatcatatgactaaagagatagaatcttcactgacttttgacctttctttcccctcatttttaaagcatcccttcaaccttcttgcagataggttaagtacagttatcaccagatcagagtttgtaacaggtccataaaaggaaggtacagccttattgtactcttagaatcataactgaacccctattctctaattccatctttggaaattggatggagagattttgtcactggcaaggatcctgtcccaattactctgtattgcacacaggacagcctcaaactggacagagaaacgagaattagtgacagtggaatgaggaaagctagcatgtctcatcagcacctcagtggtggattaccaacccatgcctcagttgccttctctaaaataatgagctctacctctcagagatagaaccaagtaagaaggaaaaacgtgatcgtgcttaaaaaaggtaaatgcccataaaatgtaaggtaactggctggcaaacaagttttcaccgggtttcttttggaggtccatagcattttacctttccctctattatgcttagaacactgcgccatcaaaacttcttcggaaaggtcttaacctcgcttatatttcaagagtaccttttttattttattttttaatttgtttttttttttgagacaaggtctcattttgttgcccaggctggagtgcagtggcaccactgtagctcattgtcacctctatctcctgggctcaagctatcttcctgtttcagcctgtggggtagctggaactaccacaggccactatgcccggctcttttttttaatttttattttttaaataaagatggggtctcaccatgttggccaggctggtcttaaacttctgggctcaagcgatcctcccaaagtgttaggattacaggcatgagccactgtgcttggcccattccaagtgtacctttaaatcctctgaaaatgtatgcaatattacatgtgatgtgtatttccctgggaacagcatctgtagactcgtgaagtctgttcttgtggacagatgcatgcctgttctgttttatgattgttcaccagccctgtccccaaatacacacttttatacacgtctcctccctaaaatatctaagaattactagtttaaaccctgggttccctgcaaagtggaactggttttattttttggacagcaatcttgctcagtgattaagacctggcgctccagtgcgtcacaactaggttcccatgctgtgtctctttccagtgaaatcactttgagctatttcacttctcagtacctcgtttcccagtctatgaaatgggcatagggttgttacaatcaggtaacacacaggctgagttgagtagtgcctgacacatgaggctcaatgataactattattactattacttgtctggacatttgcttcaaagtaaacagcgtacaaatgtcattaatgactcaaacataactagcttagagtatcttttcctgaaaagacaggagaatggccaggccagcaaactttttgcctctagtttcttctgatgaaaaaggggccaggcgctcacacctgtaatcccagcactttgagggggccaaggcaggaggatagcttgagaccaggagttcgacagtaagaccccgtgtctacaaaaaatacaaaaattagccgggcgtagtgaagagcccctgtattcccacctgctctggaagctgaggtgggaggatagctggagtcccggagttcgaagctgcagtgagctgtgatcgcgctactgcactccagcctgggcgacagagagaccctctctttaaaaaaaaaaaaaaaaagcaaggaggggagggctacttaacaggttgttgtaaggacccaacgagacaaccaagcaaattgtttagggcagtgcctaacccaataggggttgtgggaattgtagtcatcagccctgagtgccaagcctggtccaagtcctccagcccccggcagggtccaagaagatgagccaggggcccaagatgcaggcctgtaggcctcttagatgcctgaagattacgcaactcctcctttagctccaaactggcttaaaactcgccagtgggcaacctcttccccataagagctccccgcgcacgggccaagacagcagccagacgctccccgcaggccctcacaccgaagaatgacgcctgtaaaagccaacccatgtgttccgcgcgctctcctcccatcccatcctttccacaagatgaaggcccgacgcttcccatgtggaggcctccctgctcgcactcaccagccttcaactctgccacagtcgccatttttcaacggccgccagggccgcaccgcggccctgcgcacgcgcagctccgccccactcaccctgcggcgtggtctgtagccaataggcgcacagctctcgccccgcccacttccgcccctctcagtttatgagctctgcggttgagtgggtagtgaatgtcgaccagagactccaccaatcagcgagcgctctcggaaggcccagttgagtgagacggcagggagggcggggactgaggcagtggagagccctgtggggtgctgctggcaccttagtgcttaactttagccagctgagtttttcattgtctctgcagcctcaagtaccaactgctagtagttaccacctattaaccctgcggttctcaaacttgagcatgaatcctcatcacctccaagacttgtttaaacggattgtttgctagtcctccccatagagtttctgattctgtaaatctggggtgaggccctaggatttgcatttctatcgagttcccaggtggtactggtactgctggtcggtctggagatcacacctcgagaaccactgtattaagcacttactgtgacgccttagcgcattatttccttatgatcacgccgtttttacaatgaaggaaacagagtcctccatcgctgaagagacttaaccaaggtcaccagcctgtcctcttccactcgcacttacacagtgcatgtaaggagtccaggagctttttatggaactaactaatgaaggaataagctccaacatcccatggaagtaaaggaaaaggaacaggggaataatgtaccctaaactgagtgtgaggttgcatgattccagttgtaatgccggtgagatccaaacacttggctaaataataaacatcgattagacgtacacctaagagtggccgggcgcggtggctcacgcctgtaatcccagcactttgggaggccgaggcgggcggatcccgaggtcaggagatcgagaccatcctggctaacacggtgaaaccctgtctctactaaaaatacaaaaaattagccgggcgtgctggcgggcgcctgtactcccagctactcgggaggctgaggcaggagaatggcgtgaacccgggaggtggagcttgcagtgagccgagatggcaccactgcactccagcctgggcgacagagtgagactccgtctcaaaaaaaaaaaaaaaaaagtacacctaagagctgccagggcacggtggtttacgcctggaatcccagcactttgggagactgaggtaaggagttcgagaacagcctggccagcctggtgaaaccccctctgtactaaaaaaaaagtacaaaaattagccgggcgtggtagcaggagcctgtaatcccagctacttgggaggctgaggcacaagaatcgcttgaacctgggaggcagaggttgcagtgagatgagatcgcgctactgcactccaacctggacgacagagcgagacaccgcctcaaaaaaaaaaaaaaaaaaaaaccacctaagagcaaggaaacctctttccgaggaacttccagcatacttttggttccatgcctattgtttttaaaactgatacattggccaggtgcggtggctcatccctgtaatcccagcactttgggaggacgaggagggaggattgcttaagctcgggagtttgagatcagcctgggcaatgcaagaccccatctctccaaaataaatacaaaaaattagccgggcatggtggtgcatgcctgtagtcccagttactccagaggccgaggatagaggattgcttgagctcaggagttctagaccaagctgggcaacatgagacgcatttctacaaaaaaaaaaaaaaattagccagatatgatggtgcatgccagctactcgagaggctgaggagagaggatcacttgagcctggacggctgattgtaccactgcactccactctgggcgacagagtgagtccctttctcaaaaaaaaaaaaaaaaaaaaaaaaaaaagaaaagaaaaagagagaaagaaaaattgatatatcacaattatggggagggacgtgatattttgatacacatatacaatgtgtaattatcaagtcaaggcaattgggataaacatcacctcaaacattctttgtgttggaagcattacaagtattctagctattttgaaatatacaatcaataattgttaactattttttttaaagggagggggaacagcctgggcagcatagggagaacctgtctttaaaaacgagcaaacaaggccgggtgcggtggttcacgcttgtaatcccagcactttgggaggcctgaggcaggcagatcacaaggtcaggaattcgagaccagcctggccaacacagtgaaaccccatctctactaaaaatacaaaaattagccgggcgtggtggcagaggcctgtaatcccagctattcgggaggctgaggcaggaaaattgcttgaacccaggaggcagaggttgcagtgagccaggggtgcagaggttgcactccagcctggggaacagagtaagactccgactcaaaacaaaacaaaacaaaacaaaagagcaaacagccaggcacggtggctcacgcttgtaatcccagcactttgggaggccgaggagggcagatcacctgaggtcaggagtttgagaccagcctggccgacatggtgaaaccccatttctaccaaaaatacaaaaattagctgggcatggtggcaggcatctgtaatcccagctactcgggaggctgaggcaggagaatcgtttgaacctgggaggtggaggttgcagtgagccgagatcacgccgctgtgctccagcctgggcgacaagagtgaaactccgtgtcaaaaaaaaccaaaacgaacaaacaaacaaaaaaaccgagcaaacaaaacaaaaaattagcctggcatgtgtccctgtagtccgagctactcgggaggctgaggcaggaggattgcttgagcctaggaggtggaggctacagtgagccatgaccataacactgcatttctagcctggtgacaaggggagatgccttttctttcccttccttccttccttccttccttctttccttccttcctttcctccctcctctctctctccttccttccttcctccccgccctttccctttccttccttccttccctccctccctccctctttctctctttctctttctttctttctttcttttctttctttctttctctctctctttcctctttctctcttactttttcttgagacttaaaaaaaaaggggggccaggcagagtatcttgacctagagtctaggataatgctctttaaactgctggttaaccaaatagtaggttttgaaatctatttattagtagatccccatgagtacattttcagtgaaatggaatgtaacaaatagaaaacatagaagtatggttttctagaactttcctttcaggtacacatgtgtgttctggtacctgttgtatttcttaaagtgatcagccatcagaaaagtttgaaagtgattgtaacctagaggaatctcttcctattccaaactggattaatttttgactggattaatttttgattatgggacacatatctgttctgtaaccttgaaaaggtcctatcttgtttctctactctgtaaaaccacagtgactgaatacctggccagcatttcaagagatttttggggattaactaaattccataggtggtatttttaagtccctcagaaaaagcactcctgtggtgttatgatataggtattgattttcatctccacgattcctggcatctaactcccattcacctcattataatgttgaggcactttaggcctcaggaaacagaatctccctctctgatcttctcctgtccacctctgacctgccccaagcaggactctaatctgactgtgggtcaaaagaccctcattccagaaagggttctgcctgctaccctcaaggaagaaatgctgcacagagagcccaagaaaagtctgagcagacaggctttgctgggtttagatcaggcactttctgtccaatcagatttctttcttttttttttttttttttgagacggagtcttgctctgtcgcccaggctggagtgcagtggtacagtctccgttcactgcaacctctccctcctgggttcaagcgattctcctgtctcaaccacccaagtagctgggattacaggtgtgcaccaccatgcctggctaatttttttttttttccagacagagttccgctcttgttgcccaggttggagtgcaatggcacgatctcggttcacctcaacctctgcttcccgggctcaagcaattctcctgcctcagcctcccaagtagctgggattacaggcatgtacaaccacacctggctaattttgtatttttagtagagatggggtttctccatgttagtcaggctggtgtcgaactcccgacctcaggtgatccgcccacctcggcctcccaaagtgctgggattacaggcgtgagccaccacgtctggcctgtccaatcacatttctacacggtgttcaatcacacctatgtaataaagtgtcccataaaaacccaagagaactgggttgggagaacttctggatagcagaacacgtggaggttgttgaagggtgttgcattcagggaaagcatggaagctccacaccccttcccctatactttgccctatgtgtcacttcatctgtataaacaaaattaagtgtttccctgaattctttgagccactccagcaaattaatggaacccaaaatgggggttgtggaagctccaacttgaaggcggtccatcagaagtttcagaggcccaaacttgcgactggtgtctgaaggaaggcagtcttggggactgagctatcaccctgtgggaaatgacactattttcaggtcgaagatgtcagatttaaactgaaggacacccagctggcgtcagctgcagaactgattgtttgctggccaggcgcaatggctgaagtctgtaatcccagcattttgggaggcagaggtgggtggatcacttgaggtcaagagttccacactagcctggtgacatggtgaaaccttgtctccactaaaaatacaaaaaatagctgggtgtggtggcatgcacctgtaatcccagctactcaagaggctgagccaggagaatcgcttgaacctgggaagcagaggttgcagtgagcagagatcatgctatgggtgacagagtgaggctaaacctaaaaaaaaagattgtatgcttgctggtggggggatttccccacacatttctggggtccacagaagtattctgtgttgattattggtgtgttgatgtgtgagcagagaaaaaacacggtttgagaaagtttatatccaaaaaactcctgaatatgttgatgaggaactcggagagagaggcaaataataatgtgattgaccgattggcagtggtaatcatacagtagctaacattcattatactctctgtatggcaaggactgctctaaaagctttacattaagtattcaccaacaaccctatgagatggatacttacatgcaattgtctcaagtaaaattgtatttaaaaacatactggccaggtgtggtggctcatggctgtcatcccagcactttgggaggctgagacaggcggattgcttgaggccaggaggagttcaagacgagcttggtcaacatagtgaaaccctgtctctactaaaaatacaaaaaattatttgggtgtggtggcacacacctgtaatcccagctacttgggaggctgtggcatgagaatcacttgaacccgggaggcagaggtttcagtgagctgagaatgcgccactgcactccaacctgggcgacagagaaagactctgtctcacaaacaaacaaaaaacatgtactaatgaccaggcacagcagttcatgcctgtaatcccagcactttgagaggctgaagcgagaggatcagttgaagccaggagtttgagaccagccaagccaacaaatcaagaacccatgtctttaaaaaaaaaaaaagtagctgggcatggtggcacatgcctgtattcctagctgctcaggaggctgaggcaggtggattgcttgagtccaggagttcaaggctgtagtgagctatgactgtaccagtggactccagcctgggcagcagagcaagaccccatctctgaaaaaataaatacctttatacatacattaaaaacatgcactgacattgagtaacactgaattgctggggatatgtcgaaacaggcactgccatacatagttggtaggtaggcaatcaacaccaccatccagaaggcagtttgtcaatatctcatcagattttcacaccctttgactcatcaaatctacttctaagaatgtatcttacagatataatcacacctacttacaaaggatataagtataagaatattcattcactgttgatagtagaaaaaactatgcacacctttcagaaaggctaaaataaagactactgacaatactgttggcaaacacacatgtactactggtgggaagacaaagtggtatagtcactttggaaagcagtttggcaattgcttattaagtcataggtacacttggcccagtaatcccaaaactaagtgtttgcccaagtgaagtaaaaacttgtaggccgggcgcggtggctcacgtctgtaatcccagcactttggggggccaaggcgcatggatcatttgaggtcaggagtttgagatcagcctgagcaacatggtgaaaccccgtctctactaaaaatataaaaattagccaggcatgatggagcatgcctataatcccagctacccaggaaaattagccaggtgtggtggagggtgcctgtaatcccagctacccaggaggctgaggcaggagaatcacttgaacccgggcagcagaggttgcagtgagccgagatcgtttcactgcactccagcctgggcaacaagagctaaagtccacctcacacacacaaaaaaaagaacttgtagccaggcacagtggcttatgcctataatccccacagtttatgaggccaaagcgggatgaacgcttgaatctagaagtttgagaccggcctgggcaacatggtgaaaccccatctctacaaaaaaaaaaaaattacaaaaattagacaggcgtgtaggagtgaacatgtagtcccagctactccagaggctaaggtgagaagacctgcagagcctgggaggtccaggttgcagtgagtcgtgatcacaccactgcactccagtctgggcaacatagtgaaactgtgtttcaaaaaaataaaaaatgttctctggtgaggactcggtgattgagggtcagtgttcgatggagacttacttttttttttctttttgagacagtctctgttgcccaggctggaatgcaatagcaccatcatagctcactacagcctcgacctccaggctcaactgatccttcagcctcccgagtagctgggaccacaggcacgtgccgccacgcccagctatttttattttttgtagagatggggtctcaccatgttgctcaagctgatctcaaattcttgggctcaagcaatcctcctgcctcgaactcccaaaggcctggggttgcaggcataaaacaccacacccagccttacttttgtccatagacttattttaatttattaattaatttatttatttgagactgagtcttgctctattgcccaggctggagtgcagtggcacgatctgggctcactgcaacctccgcctcccaggttcaagcaattctagtgcctcagcctcccgagcagctgggattacaggtgcacaccatcatgcctggctaatttttgtatttttagtagagacagggtttcaccatgttggccaggctggtttcgaactcctgacctcaagtgatcctcctgtctcggcctcccaaagtgctgggattacaggtgtgagccaccgtgcccagcctaattttaacttttaactatgtacatgcattactgtgcacaaccagctgtgggcaagtacagcccaatagcccctcctcttcactgtcttgagtatctcttgctcgttgttgagggcccgtctagcgccatgccccataggctgcctataggagtccttttgacccttcaggcacccacacaattgtggaaatgtggctggaccaacaaatagtgggagtgagtggtaatccatgtgtgacatgcgagaggtgcacatttttttctctctctcttttttttttccatagaaatataaaatgtttgtagaaatgtaaaatcttttgtttttctttttttttatttttccagacaggggttaactctgtcacccaagttgggctgcagtggtgcagtcacagctcactgcagcctcaacatcccagtctaagggatcctcccacctcagcctcctgagtagctgggactacaggtgtgtgtcatcacacctggctacttcttttattttctgtagaagcagagtctcgctatgttgcccaggctagtcttaaactcctggtctcaaacaaattctcccacctcagcctcccaaagtgctgggattacaggcatgaggcactatgcccagcctgtaatcttattagcacacagccatgccccccactttttttttttttatttttgagagaggttctcactctcacccaggctggagtgcagtggcatgataaggggtcactgcagcttcaacctcccctggctcaggcaatcctcccatctcatcctcccaagtagctgggactacttgtgcatgccaccatgcccagctaattttttgtattttttgtagagatagggtttcgccatgttgctcagactggtcttgaactcctagattcaagcattctgcccacctcagcctcccaaagtgctgggattaattacaggcgtgagccaccgcatctggccgcctgcctgtttcttaatgcattgtctatgggcgcttttacacggcaacagaggaattgagaagctgcaacagaactcacttaaaatattttacccggcacttgaagaaaacatttgtccactcttgaattctttttcatactttttctaggccacaggtatattattaacagattaaccattattttttttttcagctatagccaataataataaaaaagagcaactcacattgatggtgcccttattgtgtgtgtgtcgtttcatggcatcctgaagacagctgagagacagatgtgatcatgcctgttttacagatggaaactgaggtttggagggttgaagttgcttctgagtaaatggctgagtcagtgcaacttgaccccagttctgctccactcacccaacgttgctcagccgttttcggttgtttcagtttcactgcagacacttctctgttctccccctgccctccttctctcccccaaactctctctcttccttctcctcctttctcttcttctgctccccaatccccctcctcctctttcatcttcttcctcctcctccttcctcctcccagccctcctcctcctcctcaacctcctccccttctatctcctccccctcctcctctttcttctccctcgccctcctctcttcttttctctcccccaaccccctctctactgggcctttgcatgtgcccatcccccagcctggaaacttcctcctgttctggttaatttctgctcattctccaggtctcagtctacctttttgttgtcgttgttgttgttgttgagacggagtctcgttctgttgcccaggctggagtgcagtggtgcgatctcggctcaccgcaagccccgcctcccaggttcacgccattctcctgcctcagcctcccgagtagctgggactacaggtgtgcgccactgcacctggctaatttttcgtatttttagtagagatgcggtttcaccatgttggccaggctggtctcaaactcctgggctcaagcgatccacttgcctcagcctcccaaagtgctgggattacaggcatgagccaccgtgcctggtctccaggtctgtttaaatgtcatttcttcctaaagctttcctggctaattcgattcttcttctcaaatgtatcttggggggtgaaaggtctgagaagagggaggggcatagagataaaggaagcttccaacagaggtgcatcaccaatgcccttctcccaggtccgaggtcatacccctggctcgaggggaggcggcttccgatgcctggtccatgctggggtatcaagttccagccctctcaccccagtttgggacaattctgtaggaccgcctcactggcagagcttgctgagggagtaagctgaggcctttgtaggccacaaggttgagaccagcctgagcatcatagtagggccttgtttctatgaaaacatttttttaaaaaatgaaacttcccacatgacaatttttttttttgagacggagtctcactctgtcacccaggctggagtgcaatggtgcgatctcagctcactgccacttccgcctcccaggttcaagtgattctcatctcagcctctcaagtagctgagattacaggtgcccaccaccacacctggctaatttttatatattttagtagagatggggtctcgccatgttggccaggctggtcttgaactcctgacttcaagtgatccgctcatctctgcctcccaaagtgctgggattacagccatgagccacagcgcccggcttccccatgacaattttaaacatgagaactatgtatatgccacagtctggaacttgggatctcaaataatcttggattccttgttctcagtccccatacagaagggaggagggctggcctttggactcccccaaatctgggttcgaatcccagctccaccactgcaagtctggttgctctggaccagttacttaacgttctctaaatgtcagttacatccgtgagataagctacctcgcgggacttcattcagtccttcttcaaatatctgtagaatatttgtaggctgaggcctttgctgggaccgtggagaagcccaacttcctcctccctttcccccacttcctaggctttgatccagccctggagccttgatcgaattgatctctctttcaagtcttccagggaggctgtgactcaatcctagaaaccaggggcaggtccaggctgcctgtggtctacttgctccacttcctcaggtgctcaagggtgactcatcactcagtaagttcagagcagagggcgttctcctcaatgtgtgccaggagcacagcaggaatgtaggcaccctcagagctccccagaattccctaaccctggaccacactgtggcattgcagcctatgtggggctgaggctctgtttcacattgggtgcccaatggactgctttacaggacagatgccttgttatcctgctctgctccggtagaacaaatatttgtagaaggaccgaatgaagtcctgcaaggtagctcatctcacagacgaaactgatgtttagagaacattaaataactggcccagagcaaccagacttaaagtggtggagctgggattcaaacccagatttgggggagtccaaaggccagccctcctcccttctgtatggggactgagaacacggaatccatgaccatttgagatcccaagttccagactgtggcatgtacatagttctcatgattaaaattgtcacgtgagaagtttcattaaaattttttttttttttttttttttttgtagagacaaggtctcactatgttgtccaggctggtctcaagctcctgacctcaagcgatcctcctgcctcagcctaccaaattgttgggattgtaggtgtgaaccactgcactctgcccagaggtttcaaagtgaactttttttctttaatcaagatggggtctcactatgttgcccagactggtctcaaactcctgagctcaagcgatcctcccgccttggcatcccaaattgctgggcttacaggcatgagccactgcacctggcctcaaagtggaatgtttttagtggggggaaggtgctggatattactgtcagtcctttagaggaagtaaaataaatcctacaggtacattgacattctcaggtcactttcagagggatgagcaataaattcattcaatgccttctttactaaaagcattagagataaagaaattctggaagtaaatcttgctgaaatgcattttgtcaggggaactcagttgaacaaaaactaaaggttgagttcagaaaaggtaaatgtcttttaccaagatttagttcttttcttccaggtagatatgccttttcttaggatctggagtgagaggctgttggaaaataagggttggggaaagccacagatggaattttacaaattggagacagctacttaatagaaacggcatctcatcagacaagtcaaggcaactgttgaaaatatgacatgtctctctatcagccattcatggcccaggacactatggcaaccaaatccaaactgctggttcaaagagattagtctgaatcccaaaagaatcctaattctctcctgatttattaaggaagaaaacaacaaccgcctttatttgcaatattattgcattgcatgcaatcctaggaaaaggtgtggctgttatttttgaagaagtactcaccctatactagatacagtatgaaacattattcatgcgtcattgcatttatttctcacgtgatctcaagaggtagatgctactgtcatcctgattttaagatgaagaaagcaagccttagggagttaaagggaactgcccaaggtcaaacagctggaaagagacttggccagacgcaaaaacagtctgatgcccggttcaaggtcctttagtttcatctgtccagtaagtagacagagtatttgatacttgggctggactagacaaatctatgatgtgtaattgttctgtgaactcacagatcctagcgtgaagagttttttgttttgttttgttttggtttttttagatgcagtttcgctcttcttgcctacgctggagtgcaatggcgtgatcttggctcactgcaacctccaccttccgggtacaagtgattctcctgcctcagcctcctgagtagctgggactacaggcacccaccaccacgcccggctaattttttgtatttttagtagagatggggtttcactatgttggccaggctggtctcaaactcctgacctcaagtgatccacccgcctcagcctctcaaattgctgggattacaggcgtgagccactgtgcccggcctttttttttttttttttttagatagggtcttgctctgtcgcccaggctagagtgcagtggtacaatcatagctcactgtagccttgaattcctgggctcaagcgattctcccacctcaacctccctgagtggctgggactacaggtgcgtaccattacaacacctggctaatttttttttattttttaatattttgtagagacaaattcttgttatgttacccaaggtggtattgaactcctggcctcaagtgatcctcccaccttgtcctcccaaagttctgagattacaggtgtgagccactgtgcttaaccaagtgaagacttttttggctagctcaaccctgtaattccagcactttgggaggccgaggtgggtggatcacctgaggtcaggagttcaacaccagcacggccaacatggcaaaaccctgtctctactaaaaatacaaaaattagctgggcatggtggtgggcgcctgtagtccgagctactcaggaggctgaggcaggagaattgctggaacctgggaggcggaggctgcagtgagccgagatcacaccactgcactccagtctggacgacagagcaagactctgtctcaaaaaaaaccccaaaaacaaaaaacaaaaatcaaaacaaacaaaaagcccaaaggaggactttttcatgctgataaagaatgtaggataaacctgataccctctccaaaatctcttccaattttcctaacctctgtaccaatgaggacttcctttcctttctgactttcgatcaatgtaacaaaaataaaattgaagcagagaagggttaagtatgttgctcaaggtcttgcaggtgatttgggttagagccaatcttgaactcagccaggtgaggtggcacctggttccatgactggaccctccctgctgccctggtttgcgagaagattcttacacacatgtccctgatctccttgaagctttgattttccacctagagccccactgcagcatcctggttatctgcgcaagctctgttgttacactgaactggatggtgaatcctgggtacctgtgtggccttgggcaaaaaaaaaaaaaaaaaaaaaagcacctctctgagcttccatttctttcattctttctttccctttcccctctcctcccctcccctcccctccccttctctctctctctctctctctctctctctctctttctttgttggagtctccgtctgttgtgcaggctggagtgcagtggcgcaatcttggcttgctacaacctctgcctcctggcttcaagcaattctcctgccttggcccccctgacgagctgggattacaggcatgcaccaccatgccagctaatgtttgtatttttgtagagatggggttttgccatgttggccaggctggtctcaaacttctgacctcaagtattacgcccattttggcctcccaaagtgctgggattacaggtgtgagccaccacacacgttcttgggcctccatttctacagctattaaaaggaggccataatagtacctaactcctgggatattatcgtggctaaaatgagctaatgggccaggtgcggtggctcacatctgtaatcccagtactttcggaggccgaggcgggtggattacctgaggtcaggagttcgagatcagcctggccaacatggcgaaagcccgtctctactaaaaatacaaaaattagccaggtgtggtggcttgcacctgtagtcccagctactcgggagtctggggcaagagaatcgcttgaacccaggaggtggaggttgcagtgagctgagattgtgccactgcactccagcctgagtgacagagctagactccatctcaaaaactaataataataataataataataataataataataataataatatcataataagatgggcctggcgcggtggctcacgcctgtaatcccagcactttactctactaaatctctactaaaaatacaaaaattagccaggtgtggtggcgggtgcctgtaatcccagctacttgggaggctgaggcaggagaatcacttgaacctgggaggcggaggttgaagtgagccaagatggcgccattgcactccagcctgggaaacaggagtgaaactctgtctcaaaaaaattaaataaataaataagtaaataaataaataaaatgaactaatgcatgaagagcacttagttaaattaaataaataaataaaatttttaaaaaataaaattaattaaataataaataaataaataaaatgaactaatgcatgcaacaacttagcacagtgcctaggacataataggcactcgataagtgggctgggcgtagtggctcatgcctgtaatctgagcactctgggaggctgaggcgggcagatcacctgagctcaggagttcaagaccaccctgggcaacatggcgaaaccccatctgtacaaaaattacaaaaattagctgaccatggtgatacccacctgcagttccagctacttgggaggctgaggtgggaggatcacttgagcccgggagactaaggttgctgtgagcccagatcatgccactacactccagcctggtggacaaagctagaccctgtcacacacacacacacacacaaaagtggctatttcctcaccattccccccttggcaggtcacagcccagtccactccactcctccatggtctccattcttgtcgcctcgacaccagatggcctggattaggtgtgtaagaacatatttatgctccagttttctcttgtcaaattcctcatccttcctctccccttcccagatgttctccattctccgcaaatcctctacctcacctccatcttccacctgctctttggtcactctgtctcctactcaactaggaagaccctaggaaccctccacttggaccctaaatctctttgcattttaacctttcattcatgaattcattcattcgaaagatattattgagcatctactatgtaccaggcactaaggatactagagtaaatataataaacaggatcctggctgggtgaggtggctcatgcctgtaatctcagcactttcggaggtaaaggtgggtggatcgcttgaggtcaggagttcgagaccagcctggccaacatgacaaaacccgtctctagtaacaatacaaaaattatctgggcatggtggtggcacatgcctgtaatcctagcaacttgggaggctgaggcaggagaatcgcttgaacccaggaagtggaggttgcagtgagctgagatcacaccactgcactctagcctgtgcaacagagcaagactttgtctcaaaaaagtaaacacggtctctactcacatagagctcactggccaagagaaagggcagcaattcatcaaatatttaattacaaactcagataaatactataatgaaaaatgcagagattctgagacagtcaggggccataacctagcctaggttggtggttatggaaggcttccatatcagcatgtgtttctttctttctttttcttttttcttttcttttctttttttctttttcttttttttttttgagatggcgtcttgctctgttgcccaggttggagtgcagtggcaccgtctcatctcactgcaacttccacctcccaggttcaagcaattctcatgcctcagcctcccaagtagctggggttacaggcttgtgccaacacacctggctaatttttgtatttttagtggagtgcagtggaaccatctcggctcactgcaacttctgcctcccaggttcaagcgattctcatgcctcggcctcccaagcagctgggattacaggcgtgtgccaccacacctggctaatttttgtgtttttagtagagatgaggtttcacaaagttagccaggttggacagcacgagtttctatgcaacacactgtcctaaaacttagtggcttaaaacaacaacaatcattgatttcacccccaaatctgcaatttgggcaggatgtggcctggacagcaagtctgtgttccacatgccatgctcaacatggggcagcttgacaggggctggaggacccacttttttttggttgtctctgagatataatttacatgccataaatttcaccatgtgaaaccatacaattcaatgctttttagtatattcacaggattgtacaactattgctatctaattccacgatatttccttttccctaaaaagaaatcctatacttatctggatgtggtggcgcacacctgtggtcccagctactcgggaggctgagacagggggatcaattgagcccaagagttccaggctgcagtgagctatgatcgcaccattgcactccagcctgggtgacagaatgagaccctgtttctaaacaacaatgacaagaacaacaacaacagaatatataccattagcagtctcttctattccctcttcccctagtccctggaaacactcatctatcttctgtctttatagatctgtctgttctagacacttcaaatggaatatacactacgtggcctattgtgtctggcttctgtcactgagtacaatgttatcaagattctggaagacccactttgtggatggctcagtcacatggctggcaatttggtatttgctgtcaggtgggaactcagccagggctgtgggcagggatcccatttcttctctatgggggccccctccacgggctgcttgagcttccttatggcatggtggttgggttccaagatggagcatcctaacagagccaagtgggagcttttcatatcttttttttttttttcaattgagacaaagtctcactgtcacccaggctggtgtgcagtggcatgatcttggctcactgccacctccacttcctgggttcaagtgattcttgtgcctcagcctcctaagtagctgggactacaagtgagcgccaccacgcccagctaattattgtatttttagtagaggctaggtttgccatgttggccaggctggcatatttattaaaaaaaaaaaagagagagagagagagacagggtcttgcttgttgcccttggcaggtcacagcccagtccactccactcctccatggtcttgaactcctagtctcaaatgatcctcctgcctcatccttccaaagtgctgagattacagatgtgagccacgatgtccggccagcttttcaccttttatgaccagtttcagaagtcacaccatgtcacttccacagtagcctcaagctcgtctggattcaagggaagggaacacagaccacccttcacaacaggagtgtcaaagtcaccttgtttgcgttttaacttttcattaatgcattcattcattcaaaagatattattggccaggtgcagtggctcaaacctataatcacagcaccttgggaggctgaggcggatggatcacctgaggtctggagttagagaccagcctggccaacatggtgaaaccccgtctctactaaaaatacaaaaattagctgggtgtagtggcatgcgcctgtaatcccagctacttgggaggctgaggcaggaaaatcgcttgaacccgggaagtggaggttgcagtgagccgagattgcgtcattgcattccagcctgggtgacaagagtgaaaatccatctcaaaaaaaaaaaaaaaaaaaaaaaagtcacaccatgtcagttccacagtagcctcaagctcatctggattcaacggaagggaacacaggccacccttctcaataagagtgtaagatcactttgtttacattttaaccttttattcatgcatgcgttcattcaaaagatattattgagcatctactcatgaatgaataattgtggccacttttggaaaatacaagtgctacagcttccctgagaagatgatgttggggctgacagctgaaggataagcaggtgttacttaggcacaggtatggaagagcattcaaaaaacacagaacaacgtgttcaaaagacccgggggaacaattagcacactggaggaacttaaggcggccttgagtggcagaggcagagagaaaggcacttgtctgttgtgtgctttccatgactgctgtttccactcagccttcattgtccattttttcagaaacagtaccctaaattccctttggggaaccattgactcacccgccctcagccctctcagtggggctggctgcaggggtgggtgttaagacccaggtctagccattcaagacagttcacccagcctcgccagtctcactgattggttcgggtgtggtcatgtgacactcagaagggccaatgaggctcaaacccaagacatctgctgcagctattggacaagacagagtgtattgccttggggttgctaggtaggatagaggcaggagtggttgggtgtcacctttgcctctgccagagaataacctgttgaaatgacaccaacaaagagaaagtagaacgaagtgacacagaccattgagctcctggactatgaccaaagccagctctgccactggacattttagattcatgggccaatacatgatggtttaggctaatttgaatttctgtcacctggaatcaagagtactgtttaaaggcaccatcggtgggcgcagtggctcatgcctgtaatcccagcactttgggaggccgaggcgggtggatcacccgaggtcaggagtttgagaccaccttggccaaaatggcgaaactccatctctactaaaaatacagaaaatagccgggcatggtggcacgtgcctgtaatcccagcaactagagggtctgaggcaggaggatggcttgaacctgggaggcagaggttgcagtgagccatgattgtgccactgcactccagcctgggcaacagagtgagactccatctcaaaaaacaaacaaacaaacaaataaataaataaagacactatggttaggatttttctcttcctgtccctaactacacattctccattcctggttcttacgtaccacttcagaagcctccagcacttcatctggcctctcttccttctctctctctttcatttcttattttttttgagacagagtctcgatctgtcacccaggctggagcgcagtggcgcaatcttggctcactgcaacctccacctccaaggctcaagtgatcctccagcctcagcctcctgagtagctgggattacaggcacacaccaccactccaagctaactttttgtatttttagtagagactggtttttgccatgttgcccaggctggtcccaaacttctggccccaaacttctggcagatcaagtgatccacctacctcggcctcccaaagtgctgggattacaggtgtgagccactgcatctagccttctctcttttttttgtgatcaataaatgtttgtttattgcatcttggtctgaatgtcatattaaatttggggttccaaaaaactctagaaaacatttatgagaacttgggaggtggaggttgcagtgagccgagatcgcgccactgcactccagcctgggtgacagattgacacttcgtctcgccaaaaaaaacaaacaaacaaaaaaaaaaaacaaaaaaagaaaaaaagaactaaatgtccctgaatataaaatggtaggtaagaacagtaattggcttgtcgatcaatgatgaatcaaacagaaaatgcgtgacagattatggggaagtttaaaatgtccaaatattatgtcccagaagaatttgtctagataatagatcttcctcagtccctttcaggggatggatggatagtggacatacttgggcaggtttattcagggtaagctggaggaatgtgtcaaataggtagctacctatctgatttactttcatcctattttttctgctcttaaaacaaaataacctcctattggttaaacttttttttttttttggttgcaaatcaaactctcttactggttttaaaatatcaatttcttttctttttctgtttctttttttttttgaggcggagtctcactctgtgacccaggctggagtgcaatggcatggtcttggctcactgccacctccgcctcccgggttcaagcgattctcctgcttcaggctcctgagtagctgggactagaggcatgtgccaccacacctagctaatttttgtatttttagtagagacagggtttcatcatgttggccaggctggtctcgaacttctgatcttgtgatctgcccgccttggcctcccaaagtgctgggattacaggcgtgagccaccgtgcctatcctattttttttctttttctttttctttttttaagatgaagtcactctctgttgcacaggctggagtgcagtagcacgatcttggctcactgcatcttttgcctcctgggttcaagcgattctcagcctcctgagtagctaggactataggcgcgcgccaccacgcctggctaatttttgtatttttttacagagggggtttcactatgttggccaggctggtctcgaactcctgacctgaagtgatccacccaccttggcctcccaaagcgctgggactacaggcatgagtcaccacgcctggccaaaaaaaagattaatcttaaacataaccagaagtctagatgtttgacaggtttatttatttattgagacaaggtctagctctgttgcccaggctggagtgcagtggcgtgatctcttgggtcactgcaacctccacctgtgggttcaagacaccctcccatctcagcctcctgagtagctgggactacctgcctggctaagttttgtatttttagtagagaccaggtttcaccatgttgcccaggctggtcttgaactcctggcctcaagtgatccagcacctggcctcctaaagttctgggattacaggcgttggccaccatgcctggtcagtttggcaggtttaagggttgacttatgcctgtgactgtggctatctttctttatattctcatggcttaccccaggctggccacttgtaatatatggtcatcttaaccaaattagaaaaaggtattccagttgatgtggtggctcacgcctgtagtcccagcactttgggagaccaaggtgggtaggtctcttgagcccaggagtttgagatcagcctgggcaacataacaagacctcgtctctacaaaaaatacaaaaattagctgggcatgattgtgcatgcctgtagtcacagctactcgagaggctgaggtggagcccagaaggcagaggttgtagtgagccaagatgggaccactgcaccccagcctgggcaacagagccaacctgtcttaaaaaacaaaaaacaaaaaacctgacatgggactttgaatattctagtattgaatgaatgaggaataaagagatggatgggtggatggatggacggacagatgaatgaattgatagatggatgagttgaatgggtgatggaaggatggatggatggacaggtggatgaatggatggatgggtggtggatgaatggatggacaactgaatgaatgaatgaatgaatagattgacaagtggatgggtgatgggtggaaggatagatggtcagatggatgggccatggacggatgaacggacagatggatgagagagagagagagattcctctgggcagcagacaatttccttaaaaacaaacaaacaaaatctcctttttcgggaagatacaaccacacatacgggctgaatgtcagcccccaatcatctactcggcacttccatagcacagggcacaattttgggcaagtgctcatttcgtgaggaccacagacaggcaccatttttttaagggttggtgggatgatcaccactgtttgaggccttatattcaaggattacaatgttcagaggagaaaatagaacgacttccaggatctctgccagagcgccaggaagaacttcctcggaaacatttaacaaaactctcctcgtatctcattggcctgatttgagttacatttcctttcttttctttcttttttctttttctttctttctttctttctttctttctttctttctttctttctttctttctttctttctttccttccttccttccttccttccttccttctttctttctttctctctctctctctctttttttctttccttccttctttttttttttcttttttttgagacatggtccagctttgtcgttcaggctggagtgcagtggcacgatcttggctcactgcaacctccgcctctgggttcaagcaattctccccgcctcagcctcctaagtagctgggattacaggcacccatcaccacgcctggctgatttttgtattttttagtagagatggggttttaccattttggccaggctggtcttgaacccccgaccttaggcgatccgcctacctcggcctccgaaagtgttgggattacaggtgtgagccaccgcgcccggccttctttctttttttgaggtaagattcacaaaacatttttaaaatcaccctttggggccaggcatggtggtgtgtgcctgtagttccagccactagggaggctgaggcaggaggatcacttgggcccaggagcctgaagtgcgctatgatcactccactgtacttcagcgtgggtgacagagtgataccctgtctcaaaaaaaaaaaaaaaatcaccatttaaagtgaatagttcactgttttttgtcacattcacaatgttccacagctatcatcactatctagaacatttttaccacagcaaaacaaaagaaaaaaacaaaaagcaaaacaaaaaacaaaaaaccataaccattaagcaaacattctccattccgcccctcctcctaggccctgagaaccacaatctacttcctgtctctccggctttgcttattccgtgtgtttcatcccatataaatatattcataaaatatgtggtcttttgtgtctgtgtctgtttccttcctctccctttctttctttctttctttctttctttctttctttctttctttctttcttcctttttctttctttctttccactttctttctttcttcctttctttttctttttctttcctcttttctttcatatcatggctcactacagccttgacctcccaggttgaagagatcctgccacctcagcctcccaagtagctgggactacaggtgtgcaccagcacccctggctaatttttgtatttttttgtagaaacgtgctgttgccatggtgcctgggctggtctggaactcctgagctcaagcaatctgcccaactcggcctcccaaagtgctaggattaccggtatgagccactgcgcctgactggggttcttttttgtagcatgatgttttcaaggttcatgccagttgtagcatgcatcagtattttcttccttttcatgtctgaatgatattccactgcatagataaactaaatattatttatccagtcgttaattgatgggcatttgatttgtttccactttatggaccgttacgaatagtgctgctatgagcatttgtgtgccagttaatgtttgaacacctgtatactagtatacacccaggcattaaattgctgggtcatattgtaattctatgttcaactttttgaggaactgccaaactgttttccatagaggctgtaccattttacattcctagcagcaatgtacaaggcttccagtttctccatatccccatcaggcttgtaattttccttttttttttttttttttttttttgacacagagtctcactctgtcgcccaggctggagtgcaggggcgtgatctcggctcattgcaacctctgccccctgggttcaagcgattctcctgcctcagcctcctgagtagctgggattacaggggcctgccactgtgcctggatgatttttttgtatttgtagtagagatggggtttcaccatcttggccaggcttgtcttgaactcctgacctcgtgagccatggcgcctggctgtaattttccatttttaaaaattataaccattctattgtgtgtgaagtggcatctctttgtggtttttatttgcatttccctaataacgaatgatgttgagcatctgttcacgtgcttgttggccatttgtagatcttctttggagaaatgtcttcaaatccggggcccatttttaaaaactgggtgctttgctttttttgttgttgagttgtaaagttctttacatattccagacagtagagccttatcaaatatgtgatttgcaaatattttctctcattctgtgaactgccttttctgtccttcgatactgttctttgatgcataaaaggttttaattttgatgaagtctagtttctcaacctttgctgttgtcacttgtgtttttggtgtcatatttaagaaaccattgccaagccaaagataatgaagatttccctctgggctctcttttaagtattttatagttttaacttttataatttagatgttaatattatggcgtgagttcaaagtccaatttcattcttttgcatgtggatatctcatggtcccagggtcatttgttgaagagactgttctattaaattatgtcttttaggctgggcacggtggctcatgcctgtaatcctagcactttgggaggccaaggtgggtggatcaccagaagtcaggagttcaagaccagcctggccaacatggcgagaccctgtctctactaaaagtgtaaaaattagccaggcatggtggtgtgcacctgtagttccagctacttgggaggccgagacaggagaattgcttgaacccgggaggtggaggttgcgtgtgccgagattatgccactgcactccagcctggatgacagaacaagactccatctcaaaaaaaagaaaaaaaatatatgcctttttcagcaatttggatggagctggaggccattaatctaagtgaagtaactcaggaatggaaaaccaaatattgtatgtcctcacttataagtaggagctaagctatgagtacccaaaggcatacagagtgatataaaggactttggagtctcagaagggggaggatgagaggagggtatggatgaagactacatgttgggtacatgtgtaactacttgggtgatgatgggtgcattaaaatctcaaaatttaccactatataattcatctatgtaaccaaaacccacttgtaccccaaaatctattgaaatttttaaaaaaagagagagagggaaactgttctttcgcctattgaatggccgtggcacgcttgtcaaaagccgattcactggctgggcatggtggctcacacctgtaatcccagcactttgagaggccaaggtgggtggatcacctgaggtcaggagttcaagatcagactggccaacagggtgaaagcccgtctgtactaaaaatacaaaacttagccaggcgtggtggtgggtgcctgtagtcccagctactcgagaggctgaagcaggagaattgcttgaatccaggaagtggaggttacagtgagtcaagaattcgacactgcactccagcctgggtgacagagcaagactccatctcgaaaacaaacaaacgaacaaacaacaacaaaaagccaactgaccacactgggtgcagtgggtcacgactgtaatcccagcactttgggaggtcaaggtgagaggattgcttgagcccaggagtttgagaccagcctcagcaatatggcgagacttcatttgtactaaaaacaaaaaacattagccaggtgtggtggcacgtgcctatactcccagctactagctatgtgggaggctgaggtgggaggattgcttgagcccaggaggtagtggttacaatgaactgtgattgcgccactgcactccagccagggcaacagagaaaatgctgtctcaaaagaaaaaatcaattgactatagatgtatgggtcatttccagactttcaattctattccactaatctatatgcctatcctcataccagtatcacaccttttgattattgtggctttgtagtaaattctgaaatcaccaagtgtgagtcttccaactctgctcatttttcaagattggctcttgggtgcaataccatgtgaatattaggtttgaattttccaggtctgcaaacaaggacgttgggattttcatagggattatatcaagtccatagatcactttgggatagtattatcatcttaacaatattaagtcttctaattcataaacacgtgtattagtctgttttcatgctgctgataaagacatacccaaggctggggagtttacaaaagaaatcggtttaatggtcttacagttccatgtggctagggaggcctcacaatcatggtggaaggcgaaaggcattttctacatggcggtggcaagcgagagaatgagagccaagtgaaacgggtttctccttataaaaccatcagatcttgtcagacttattcactaccacaagaacagtacgggaaaaactgcccccatgattcaattatctccccctgggtcccttccacaacacgtgggaatcatgggagtacaattcaagatgagatttgggtggggacaaagagccaaaccatatcaacatgtgacgtcgtctttctatttatttaggtcttcgtatttgctttcagccacgttttgtagttttcagggcactagtgttactcctacttggttaaatttatttatttttattctattggaagtgaaattgttttcttaattttactttctgattgtttattgctagtttatggaaatgtggctgatgtttgtgcgttgatcttcttttttttttttttttttttgagatggagtcttgctctgtcacccaggctggagtgcagtggcatgctcttggctcacagcaacctctacctcctgggttcaagtgattctcctgcctcagcctcccaagtacctggaactacaggtgccctcaccacgcccagctaatttttgtattttttactagagacaggctttcaccatgttggccaggctggtctagaactcatgacctcaagtgatccacccacctcggcctcccaaggtgctgggattacaggcatgagcaaccacgcccagctgcaaactaccttttcaatgacagttgtctcctaatttgttggcctcagcataggtagataataataaaacctacattttaaaacattaaagggcaatgttcagccaggcacagtggctcacgcctgtaatttcagcactttgggaagctgaggtggacagatcacctgaggtgaggagttcgagaccagcctggccaaaatggtgaaaccctgtgtctactaaaaatacaaaaattacctgggcatggtggccgacacctgtagtcccagctacttgggaggctgaggcaggagaattgcttgaacccaggaggcagaggccacagtgagccgagatcgtgccactgcattctagcttgggtgacagagagagaagcggtctccaaaaataaataaataaaaatagatgagtcacttccaagatggccaaataggagcagctccggtctgtagctcccagcgagatcaacacagaagacaggtgatttctgcatttccaactgaggtacctggttcatctcactgggactggttggacagtgggtgcagcccacagaggtgagctgaagcagggcagggtgtcgcctttcccaggaagtgcaagggttcaggggatttccctttcctaggcaagggaagccgtgacagactgcacctggaggaacggtacacttccatccaaatactgtgcttttcccacggtcttagcaactggcagaccaggagattctctcccgttcctggctcggcaggtcgcacgcccacagagccttggtcactgctagcgaagcagtccaagatcaacctgtgatgctgcagcctggtcagcaactatcatcagactgaacaggcaatctacagattgggagaaaacttttgcaatctgcccatttgacaaagggctagtattcagaatctacaaagaacttaaacaaatttacaagaaaaaaacaaacaaccccatcaaaaagtgggcaaaggatatgaacagacacttctcaaaagaagacatttatgcagccaacagacacatgaaaaaatgctcatcatcactggtcatcagagaaatgcaaatcaaaaccacaatgagataccatctcacgccagttcgaacggtgatcattaaaaagtgaggaaacgacagatgctggagagggtgtggagaaataggaatgcttttacactgttggtgggagtgtaaattagttcaaccattctgcttaatagccacacactgtgtggctattcctcaaggatctagaaccagaaataccatttgacccagcaatcccttcactgggtatatacccaaaggattataaatcatgctactataaagacacatacacacatatgtttattgtgccactattcacaatagcaaagacttggagccacccaaatgtccattaatgatagactggattaagagaatgtggcacatctacaccacggaatactatgcagccataaaaaaggatgagttcatgtcctttgcaaggacatggatgcagctggaaaccgtcattcttagcaaactatcacaaggtcagaaaaccaaccaccacatgtttcactcataggtgggaattgaacaatgaaaacacatggacacagggcagggaacttcacatattggggcctgttgggggtagtgggggcggggagggagagcattaggacaaatacctaatgtaaatgtcgagttgatgggtgcagcaaaccaacatagcacatgtatacctatgttacaaacctgcacgtcgtgcaacgtcgtgcaaatgtattgtagaagttaaagtataataaaaaaagaaaaaaaatccattcatatatcaataaaaaatagatcaatcaatcaataaaacattaaagtgcaatgtcgacaagaggtggtaaaagcaggcatccttgtgttgttcctggtctttgtggggaaatctttaaatttgtaagcctttcactgttgcatatggtgtaagtctcttcctttctttctttctccttccttccttctttccttccttccttccttccttctttctctcttccttctttttctttctttctataaatagaaacagcaggccgggcacgctggctcagcctgtaatcccagcactttgggaggccgaggcaggcggatcacgaggtcaggagatagagaccatcctggttaacacagtgaaactccatctctactaaaatacaaaaaaaaaattagccgggcgtggtggtgggcgcctgtagtcccagatactcgggaggctgaggcaggagaatggcctgaacccaggaggtggagcttgcagtgagacgagatcatgccaccgcactccagcctgagcgacagagcgagactccgtctcaaaaaataaataaataaaaataaataaataaatagagccagcgtctcactatgttgcccaggctggtctcaaacttctaggctcaagcaatcttcccaaagtactggggttacaggagtgagtcaccttgcctggcctggtgtaagttttttatatatgccctttatcctgttgaagaagttctcttctggtctttattatttcagtattctttgttgttgttgttgttgttttgttttgttttgttttaaatcctgaaaaggtgttgggttttgtcaaaggctgttttctacattatcccttaattctattaatgttgtgaataacatttatttatttatttatttatttatttacttattttgagatggagactcactcagtctcccaggctggagtgcagtggcatgatctcggctcactgcaacctccatctcctgggttcaagcaattttcctacctcagcctccctaacacctggcattacaggcgtgtgtcaccacgcccagctaatttatttttattttttgtatttttagtagagacggggtttcaccgtgttggccaggctgatcttgaactctttacctcaaatggtccacctgcctcggtctgccaaaagtgctgggaatacaggcgtgcactaccgtgcctggctgagttttttcttttttgagacagggtctcactttgtcacccagggtggggtgcagtggcacaaacatggttcaccgcagcctcaacctccccagctcaagtgattctctcacctcagcatgccaagtagctgggactacagttgtgagccactgcgccctgccctgattttcttataatgaatcacccttacattcttgggataagtctcatctgttaacacatatgtataatatgtttctatgctgctggatttgatttgctagtattttctttaggatttctgcatctatatttataagggacattggtctatagtttccttttcctgtaatgtcattgtgtggctttggtatcagggtaatgctggcctcatagagtgggtcagaaatgttgcctcctcttctagttttgggaagattttaataagaattggccttaattattcaaatacctggtagaattcaccaatggagccatcgggtcctgagcttttccttacggaactttaaaaaattgttaccaattccatctctttccttgttatagatctattccgacttcctagtttttcttgggttagtcttggtaatttgtgtgtttctagaaatttgtacatttcttccaggtgtattcaattaattgacatgtcattgtttatagtattctcttataatcttttatttttgtaagggttgtagtaatctttggttcctgattttagtggtttgggccatctccattcttcttctgggggcatcagtatttccaaaagtttagcaattttgctgatttgttaaagaaccagtttttggttttgttgactctattgcttttatagaatactatattttatttatcttcactgtaatttttattgtttttttgctgctgcttgctttcggcatagtttgatctttttctaatcccataaggtggaagaatgtattatttatttgagatctgtctttctttttttgcttgagacaaggtcttgctctgttgtccaagctggagtgtagtggtgcaatcatggctcactgcagcctcaaactcctgggctcaagtgatcctcctgcctcagcctcccaagtagctgagatcacaggcatgtgccacgatgcctggctagattttttatttgtatttttcatacagatagggtctcgctatattactgaggctggtctcaaactcctggcctcaagtgttcatttttttttttttttttttgagatggagtttcactcttgttgcctaggctggagtgcaatggcacgatctcagctcaccacaaccttcgcctcatgggttcgagtgatccacctgcctcagcctcctaggtagcaaggactacaggcatgtgccaccatgcccagctaattttgtctttttagtggagatggggtttctccatgttggtcaggctggtcttgaactcctgacctcaggtgatccacccgcctcagcctcccaaagtgctgggattacaggcgtgagccactgcgcccaccctctttcatttttgatgtaggtgactacagctataaatttccctctgagcattgtctttgctgcatctcataagttttggtaagttgtactgctttttcattcatctcaaaatatttaaaaatttttttatgatgtcttattttactcattgtttatgttaatttctacataatcgtatatttgtgaatctaaaaattttctttctcttgttgatttctagttttattctgttgtggttgaagaaattactttttttttttttttttggcagggtctcactctgtcgcccaggctggagtgcaatggcctgatctcagctcactgcaacctccgcctcccgggttcaagcaattctcctgcctcagtctcccaagtagctgggattataggcacccgccaccacacccagctactttttgtatttttaatagatatgcggtttcaccatgttggccaggctggtctcaaactcctgacctcaggtgatccgcctgcctcggcctcccaaagtgctgggattacaggtgtgagccaccgcacccggccaaaagtactttgtatgatttcaacttttttttttttttttttttttttgagacagggtctctctctgtcgctcagtctggagtacagtggcgtgatctcagctcactgcaacctccacctcctgggttcaagcaatcctcctgcctcagcctcctgagtagctggaattacaggtgcccacaaccatgcccagcaaattattgtacttttagtagagatggggtttcactgtgttggccagggtggtctcgaactcccgacctcaagggacccacctgccttggcctcccaaagtgttgggattacaggcgtgagccaccgcgcccagccgataactcaaaaattttcaagaggcaaagacttattttttaacagatgtgagactcagtgttttaaacaagacccaataaagacagtatgaggctaactgaatctgtccctcctgcaaagaaacatttttttactgttttttaatattacatgaaaattttgtttaaaaaactaaattttacctttgtatgtaaaattgttcctttagtagttttaattacatatattataatgttaactcttaggcagtctccgcctctcgggttcaagcaattctcttgcctcagcctcccgagtacctcagactacaggtgtgcaccaccatgcatgcccagctaatttctgtatttttagtagagacagggtttcgccatgttggccaggctggtctcaaactgctgacatcaggtgatctgtccgccttggcctcccaaagtgctgggattacaggcgtgagccactgcatccagccattactgacttttatttttaatgaaaaactaaggaggtaggcaattttaattatgtaccaggtacagagtctaggacagtaataatatatgtcaataatatatgatgctttttaggataggcaggggacatggttaattctacacatccccaggccttatctacaatctaagggctttaaaatagacaagtccaacaattatttaaaatattatagaagggccaggcatggtgcctcatgcttataattctagcactttgggagcagaggctggtggacgccttgaacctaggagttagagaccagcctggccaacatggtaaaactcgatctccactaaaaatacacaagtgagctagacatggtggtacgtgcttatagtcccaactacttggaaggctgaggtggaaggatcacctgagcccagggaggttgaggctgcagtgagcatgccactgtactccagcctgggcaacagagtgagtcccagtctaagaaaaaaatttataaaagtagtttaggacctgaaaggtcttagtaaagacaataccagacttgtctaatttacaccaaatgttcacattctgaagatgtttttattttactaataattgaaaaactgtctttatttactaaagattattaaagtcatgtgaactaaaagatacttaaagtttttattttttgatgaaatattcaatttaagtggttaagtcaactgattagagcttttaaaaatatatttcagtagtgaaatattatatattcatggcacatataaacatagacataacagacagaagtagatcttatagacttgtaagactttctgtcaattttaaaatttttattaattaattaatttattagagacaaggtctcactctgtcacccagactggaatgcaatggtataatcatagctcactgtagcctcaaattcctgggcttaactgatcctctcgcttcagcctcctgagttgctgggactacaggcatgcaccaccatgcccagataattttaaaaattttttatagagatggtgtctcactttgttgcccaggcaggacttgaactcctggcctcaagtgatcctcatacctcagcctcccaaagtgttggaattacaggcttaagccaccacatctggctggttttaattattaaacaataacaaaaaaattcattttctaaaaaaaagagtactgtggcctctatacaaaaataaagaaaaacaatttagcatagtgaaaacaagatagagtcaataatattaaatttgtatttttgagacagagtctcactctgttgcccaggcttgagtgcagtggcttgatctcagctcactgcagcctctgcccccctggttcaagcaattctagtgcctcagcctccggagtagctgggactacaggcttgcaccaacatgcttggcttatttttctatttttagtagagacagggtttcaccatgttggccaggttggtcttgaacccctgacctcaagtgatctgcccgcctcagcctcccaaagtgttgagattacaggcgtgagccaccgcgcccagtcaattatgttaaattacccttattactatgatttttataaaagtggtttcaagcatataaagaatgtttgttattactattatgtattattttctttatcatgatacttcagtcaaaaggaactgcttaggacagcttgaatatgtcccatagttacagcctgcaagcctttttctttgctgtgccatgtgcctaagacaccatccttcgtttgtgtgtgtcaaaaccccaccagtctgtcctcttaatcccaacaccaatgtcctgggtgccaataaaggctttcctcacctccaaattgagattttattgacctctcttggggtgcttatactggctttgggttgaaatctattttttctcctctcccttgaagaagcacgtctctttgcttaagggaacgtagaagccacagcagatcctagcagatatctgttaccctgaagaagaggtcagggcccaggcacggtggctcatgcctgtaatcccagcatttggggaggtcgaggtgggcggatcgcttgagcccaggagttcgagcccagcttgggcaatatggcaagacaccgccccccgactctacaaaaaatacaaaaattagccaggcgtggtggtgagtgcctgtagtaccagctacttgaaaggctgagttgggagaatcagctgagcccaggaagttgaagctgcagtgagccgtgatcgcaccactgcactccagcctgtgcaacgtggcaaaaccagagtggggccttgtctcattttaaaaagtaataagagaccgagcacgggaactcaggcctgtaatcccagcactttgggaggctgaggcggccagatcacttgaggccagagagttggagaccagcctggccaacatgggaaaaccctgtctctactaaagatacagaaattagccgggtgtggtggcaggcacctgtaattgcagctactgggaggctgaggcaggagaatcgcttgaatctgggaggcggaggttgcaatgagcagagatcgagtcactgcactccagcctgggccgcagagcaagaccctgtctcaaaaataaataaataaataaataatttaataaataagaagaaagggtcagggccatttttaaaaggcactagataaggcctggttgcaatcagggagtgcgggcaactgatttctttgaagcctcctcttgttctgtttccgtgacattgacagggaccagctcccatggttcaggagctgctgagggttaacatcctgtcccaggagggatctgaccacaccaatggctttatcgttgcctaattggggaggccctgtgggggatgtttcaaggactgagagtgcagaggagcctcccgcatgcagttacgctgatggaaacacaatgggtggattgccacaggggcccgcaggctcgctggcaaacagagcgcacaggtggaaaccttccccgctgaccagatactttgtttcctttctggggaggcagataaaacagttaccataacccaaaccctgcccactcttcatttgcaaactgcaatgctcttagacatcttccttaggtaagcgctttgagagctcctgttcatttcaggactaaaatgaacaataatagcgaccgtccttcagagcctgctggatgccaggcacctcacaagtgtctcccagtgctgggtgcagtgattcacacctgtaatcccagcactttgggaggctgaggtgggtggatcgcttgagctcaggagatcaagaccagcctgggcaatatagtgagaactctgcctctaaaacaaagaaaaaggaaaaagtaactcctggtgaatttccaccttagaacaagagtgggaggtgtcctattcatgatctttaatgctttgctcaaatatcaccttctctgtgaggcctaccctgaccactctgcttaaaattgcaaccctccaccacctccaccccgcatcgcaagttctcgtcacagcctttctcacctgctacccactccatgatttacttattaagtatgtttgttaggccgtgtgcagtggctcatgcctataatcccagcactttgggaggctgaagcaggtggattacctgaggtcaggagttcaataccagcctggccaacgtggcgaaaccccatctttacaaaaatacaaaaaagttagccaggtgtggtggtgcgtgcctgtagcccagctactcgggaggctgaggcaggggatttgcttgaacctgggagggaaggttgtagtgagctgagattgcaccatcgtactccagcctgggcggtagagcaagactctgtttcaaaaaaaaaaaagtattgctaagtcaaaaagtataaacagtctaattttttttttttgagacaaagtctcgctctgttgcccaggctagaatgcaatggcacggtttcggctcattgcaacctctgcctcctgggttcaagcgattctcctgcctcagcctcccgagtagctgggattacaggcatataccaccatgcccagctaactttttgtatttttagtatagatagggtttcaccatattggccaggctggtctcgaacttctgacctcgtgatccgcccgccttggcctcccaaattgctgggactacaggcaagaaccaccgtgccctgcctgaagagtcgaaatttttttttttttaaacagtttcactctgtcgcccaggctggaatgcaatggcacattctcagcccactacaacctccgcctcccaggttgtagccattctcctgcctcaagcctcccaagtagctgggattataggcacccaccactatgcctggctacattttgtagtttttttttttttctttttgagacggagttttgctcttgcttcccaggctgtagtgcaatggcgccatctctgctcaccacaacctccgcttcccagattcaggtaatcctcctgcctcagcctcccgaatagctgggattacaggtatgcgccaccacgcccagctaattttgtgtttttagtagagatggggtttctccatgttggtcaggctgaacaaccgacctcaggtgatctgcccgcctcagcctcccaaagtgctggaattacaggtgtgagccaccacgcctgggtctactttttgtagtttttagtagagacagagtttcaccatgttggtcaggctggtctcgaactcctgaccttagtcgatctgcccgcctcagcctcccaaagtactgggatcacaggcgtgagccactgcgcccggcccaaatagtctaaattttaataaatactgccaaataacactttcaaaagagtatccattcatactcccaccaatggtacataaaaagtctcaataacaattggtaaaattggtttggtggggaattcaactctacactgctgagctgctgctatttgcaaccatagaatcttttttttttttttcttctgagacagagtctcgctttgtcaccgagactggagtgcaatggcgctatcaaggctcactgcaacccttgcttcccggctttaagtgatcctcctgcctcagcttcccgactagctgggattacaggagtacgccaccatgcccagctaattttgtatttttagtagagacagggtttcaccatgttggccaggatggtctcgaattcccgacctcaggtgatctgcccgccttggcttcccaaagtgctgggattacaggcgtgagccaccgtgctgggccctgcaaacatagaatcttagagttgaaagggacataaaaatccatcgaattcttgtccaactcccctcccaaggcagcaatcccctgcaatacagccttgtttacaacgctgttgtctgtgactggggtcaaactccacatctttgatcttaagaataaaccaccactgacagtgggcttatcacatccagtaagtttgttatatcactgggccaaaatctactttcctggtggggcccggtggctcacgcctgtgatcccaggactttgggaggctgagtagggtggatcacctaaggtcaggagccagagaccagcctggccaacattgcgaaaccccatctctactataaatacaaaaactagctgggtgtggtagtgcatgcctgtagtcccagctactcggaaggctgaggcaggagaatcacttgaacccaggaggcggaggttgcagtgagtggcgatcactgcactgcactccagtctgggtaacagagcgagacacacacacacgcacacgcacacgcacacgcgcgcgcgcacacacacacacacaccctacctttcctgcaacacaccccacctatcctagctcagctctgggaagtaacacaaaagagctaatccttttccacatgacagcccttaaaatatttgaagactgtatcacatttccccagagccttctttttgtggggtacaacttcccagttgtgaccaaacacgtcccttccataggaaagtgctgactggagtctcttcagctgagtggcccagcataagagctttagagtcactaggcttgggttcaaggccatgttcccaccccttccagccacctgacctgggctaaatcacttctcagactagtttcctcccttggataaactgcatagcaataatacccatgtcatagggttgctggtttggccacattatgattttttttctttttgagacagagttttgctcttattgcccaggctggagtacagtggcacagtcttggttcactacaacctccgcctcctgggttcaactgatttttcctgcttcagcctcccgagtagctgggattacaggcacctgccaccatgcccagctaattttttgtatttttagtagagtcggggtttcaccatgttggccaggctggtctcgaactcctgacctcaggtggtccacccgccttggtctcccaaagtgctgggattacaagtgtgcgccactgctggccttttttttttttttttttttttttttttttgagacagagtcttactctgtcacccaggctgaagtgcagtggcatgatctcggctcactgcaacctccgcttcccaggttcaggtgattctcttgcctcagcctcctggtagctaggactacagacacccggcaccacactcagtcacatggatttttttggtgggttccttcctccataagaaaaaaagtgttttaaatcatattttatgactgtgttagtataaggatgaatataacaaggcctggtgcagtggctcatgcctgaaatcccagcactttgggaggccaaagtgggagaattacttcatcccaagagttcaagaacagcctgggcaacatggcaagaccctttctctacaaaaaataaaaaatataaaaattagccggaagtggtggcatgtacctgtggtcccagctcctcgggaggctgaggtgggaagactgcctgagcccagggggtcaaggctgcagtgagccatgattgtgccactgcactccagcctgggcgccagagctcctgctcaaaaataccaaaaactaaaaactaaaaataatatatatatgtaataaaggcagggttatgtttattttttcttctgattttaaaagaagtaaaacattttcatggggccctaaaagtattgtgggccttaggcatcatgccttctgtaagttcataggccctggctgctggaaggagtaaaaaagaaaaaacatgccaaatatgtaaagtgcttagcgcagcactgggcctggctctttgtaacttaataaatggtgatcaaaaattaaaaagtgcaatgcaggccgggtgcagtggctcacgcttgtaatcccagcactttgggaggccaggtgtgcggatcacgaggtcaggggtttgagaccagcctggccaacatggtgaaaccctgtctgtactaaaaaacacaaaattaaccaggcatggtggcacacacctgtaatcccagctacttggaaggctgaggcaggagaattgcttgaacctgggaggtggaggttgcggtgagtcgagatcacaccattgcattccagcctgggcaacaagagtgaaactccgtctcaaaaaaaaaaaaaaaaaaagttgggggtgtagtgcagagaacagagtgtaaccctggagaactctgcagagctttccttttttttttttttttttgagacggagtctcgctctgtcgcctaggctagcacaatctcgactcactgaaacctctgcctcccgggttcaagtgattctcctgcctcaccctcctgagtagcggggattacaggtgcatgccaccatgcccggctaattttttgtatttttagtagagacatggtttcaccatattggccaggctgctcttgaactcctgacctcagttgatctgcccaccttgacctcccaaaatggtgggattacaggcatgggccaccacacctggcctgcagaactttctttattggcatgcattgggacttgcagactcagcttcagctgaatgtaaggaacagttcctgggtccatgttttctcactgtgttcacagagtcttgcaagagattctgcaaaaagacacacagtctatggcatttatcttgagacgagagaaagtatacatttaaggacatgtgcgtgaagaattctggaaggataaagaagatattaatttatagccattacctattgagaaggaaggattgggaatattgtgaataggtccaggagtgggagagagactttccactgtatgcctactgatagttttgatgtgtaaacaatgataatagagtgctgattcaaaaatgttaataattttttttttttttttttttgtgatggagtctcactctatcacccatgctggagtgcagtggcgcaatctcagctcacttcaacatctgcctcccgggttcaagcggttctcctgcctccacctcctgagtagctggaataacacttgtgcaccaccacacccagctaatttttgtatttttagtagagacagggtttcgccacgttggccaggctggtctcgaactcctgacctccggtgatctgccagcctcggcctcccaaagtgctgggattacaggcttgagccactgcacctggctcaaaaatcttagtaatttttttgactgtcctaaattgtttattaggtatgagttttacaaactttacttatattagtggtaacagtggagattgagagtattgcgccttctccaagctgcccggcaagaaccaccaatagtgtggtggaacttacggccctttccaaggccatggctcttttggcctgcacatgccagcccacgcatctccttgtgcttgtggactggtttggtgatccactgggtgtcaggatttcttccaatagctttatggaatggatcaatgaggataacctcaaaaaatttgtgtgtggaatcttcacccatccagtaagaattcaggactcttagagccccacagtggcgtccaactcactcctctgcaatcaactgtaggcttcagttaataccatgatggacaggcttgccgtaagttgcacccttaggaactgagcattttcggccatcacggagaatacgaatcccgtagataacataaccttgcttgatcttgtagcccagttggtgcactttatcgggccgggtggggcggggagccctgtggagagcagagagctggcggtactgccagcagcggaccctcagaagaaagctcatgacatcagactgcttcttcctccacagctcgtggatgtacttgtatgcacccatcttggcttacctgattgctgccgccagacagaagggccaaaaatcttaataatttttattttgaaaaatatatgcatgtggttagaaaaaacttcaaacagttcaaaagggtgaaaagcaactctccctcttgtacccagggagtacctggtaagatataacatctcatacaggacttacagaacctctataaaaactattaaaaaattttgttgagagacagtaaagaagacctaaataaatggagagatatacatgttcattgattggaagagcctagatttgaaggcgccaactcttgtattgattcatagatcaaatttaatcccaatgaaaagctcagcctttttttttttttttttttttttgcagaacttgacaatctgattccaaaactgataggggaataaaagggagtcaaactacccaagacactcttgggaggaaaaaacaaaaccaaaaatgaactgtgggctgggcgcagtggctcacgcctgtaatcccaacactttgggaggccgaggcaggtggatcatctgagatcaggagtttgagaccagcctggccaacatggtgaaaccccgtctctaataaaaatacaaaaattagctgggcatggtggtgggtgcctgtagtcccagctacttgggaggctgagggaagagaatcgcttgaacccaggaggcaatggttgcagtgagtcgagattgtgccactgcactccagcctggcaacagagcgagactccatctcaaagaaaaaaaaaagctagacatcaagttagggagaggaagacaaaccagaacccacattcctttttgacgctgttgtttacttttccattatagccattctagcacaattagagtaatatcttattgtggtctgttgaaatactttagaggaagttacacagatcatgatagattactttaaatgccatgccatatatctctaaaaatacacgtttatgtattggaagactcaatattgttaagatggcgatactactccaaagtgatctatagacttgatgtaatctctatgaaaatcccaatgtccttgtttgcagacctggaaaattcaaacctaaaattcacatggtatcgcacccaacagccaatcttgaaaaatgagcagagttggaagactcacacttggtgacttcagaatttactacaaagcaacaataatcgaaaagtttggtattggtaggaagataggcatatagattagtggaatagaatcgagagtctggaaataacccatacatctatggtcaattgttttgttttgttttgtttttttgacagagtctcaccctgtcacccaggctggagtgcaaaattatcacacctgtaagttccgaaattttttctcttattatttcatctacagctttttttcctgtgttttgtcagttttatttttctgaaatgcttattatttagatgtgggatctttttgtgtgaccttctaatgttctccattttctctgatctctgcaagatttcagcaatttctttcttcttcccttttctttttttacttcttgctttcttaatttctgagagctcctttttgttccctgaatgtttcttttaaaagatatactggtcgggtgcagtggcttacacccgtaataccagcactttgggaagccaataggaggatcgtttgaagccaggaatttcagagaagaattctgcaatctcctcattgaaggttgtggtagtcatacctgaccctgtgaataattctaaccaaggctgggcatggtagcttatgcctgtaaccccagcactttgggatgctgaggcaggtggatcacctgaagtcaggagtttgagaccagcctggccaacatggcgaaaccccatttctactaaaaatacaaaaattagctgggcatggcagtgcatgcctgtaatcccagctacttgggaggctgagggaggagaatcgcttgaacccggagctgagatcatgccattgcaccccagactgggcaacaaaagtgaaattccatctcaaaaagaaaataaaataaaaataaaaaaattctaaccaatgaggtatgattgaaaatgacacacgtctttgccaatcatacttcattggttagaattattattattatttgagacagagtctcactctgttgcccaggctggagtgcagtgttatgatctcggctcactgcagcctctgcctccctggatcaagagattcttctgtctcagcctcccaagtagctgggattacaggcatgcaccatcatgcccagttaattttttatacttttagtagaaatggggcttcactatgttggccaggcttgtcttggactcctcacctcaggttatccacctgccttggcctcccaaagtgctgggattacaggcgtgagccaacatgcctggcctggttagaattattcagagaataattgaacaattattctgtgaacaacctgtaaacgaacaacctgaaaattaaactaaggaaagaaaattaagacaatccacttgcaatagcaccaaaaacaataaaaatacttggtaataaatttaacaaaagatgttcaaaatttgtacactgaaagccatgaaacattgctgaaagacattaaggaagacctaaacaaatagaaaaacatcccatgtgcatggattagaagactcaatattgttaagatgtcaatactacccaaagcaatcaacagatttaatgcaatttcattggtcttttctgcagaagtggaaaggctgattctcaaattcacatggaattgtaaaagactccaaacagccacaacattcttgaaaaaaagaagaacaaagttggagggctcatatttcttgattttaaagcttactacaaagctacagtaatcaaaacagtgtggtattagcttaagaacagacatataaaccaatgaaatagaattgagagtccacaaataaacctatacaattatggtcaattgatttttgacaggtgtgctaagacaattcaatgggagaaagaatagccttttaaaaaaattgtcctaggaccactggataaacatgtacaaaaggatgaagttggaccctaaccttgcaattaccttaaaaattattataaatataagaactaaaactataaaactctcagaagaaaacacaaggatgaattttcatgatcttggacttggcaattaattcttagatatgacaccaaaagtacaagccaaaaaagaaaaatagacaaattagacttcatcaaattaaaaacttttgtgcattgaaggatattattaagaaagtaaaaagacaatgtacagaatgggagaaaatatgtgcacaccatgtatctgataaaagtctatgttttaatgtaattaaaacatgaacaaagttaatttgtgcggcagcaataaaaaagggaaacaaatatgaacaaaggacttgaatagacattcctagaagatacgtaaatcaccaacaggcacataaaaagatgttcaacatcattagtctttagagaaacacagacaaaaaccacagtgaggtctcaattcacacacactaggacagctacaatttttttttaaagtgtgtgtattggggggtgcagctgggaacagtgactcatgccagcactctgggatgccaaggcaggaggatcacttaagtccgggagtttgagaccagcctgggcgacatagcaagactgccatctctccaaaaaattaaaaaattagctgggagtggtggcacacccctgtggttctagctacttgggaaactgagtcgggaggattgaacccaggagtttgaggttgtagtgagctatgatcatgccactgcattctagccagagcaatagggtgagatcctatctctaaattacataaataaataaataagtaaatatgcagaaaataacaaatgctgacaggaatgtggagatattggaacactcatgcattgctggtggaaatgcaaaatggttcagctgctgagaaaaactgtttaatgattcgtcaaaaagttaaacacagaattaccatatatctcagcaattctactcctagaatattcacaaaataaatgaaaacatgcactcacatagatgcacatacacacatgtcgacagaggcactattcaccgcgccggacccaaaacatgtattttcttaggaacaccagatagcacttcagtgctatgcttgggggccatttcaaacagcaaaatcaataataaataccacagaaatgtgaaacctatggcacacaaatgctgcaaaaaggacatttgtggcctggcgcagtggctcacgcctgtaatctcagcacattgggaggccgaggtgggtggatcacctgaggtcaagagttcaagaccagcctgaccaatatggtgaaaccccgtcgctacaaaaaatacaaaaaatagctgggcgtggtggtgggcacgtgtaatcccagccactcgggaggctgagacaggaggattgctcaaacccaggaggcagaggttgcagtgagctgagatcgagccactgcactccaacctggaagacagagtgagactccatctcaaaaaaagaaaaaaaaaaaaaggacatttacaataggacagctgaaacaagaagtcagggtgtggcctcattcaacctcagataggaacatgtgtgttgagcaactcaaattttcttcttttttatttgagacgcagccttgctttgtcacccaggcccaggctgtcccaggcccaggcagtgacgtgatctcggctcactgcaacctctgcctcctgggttcaagtgattctcctgcttcggcctcttgagtagctgggattacaggcacccaccactatgcccaactaatttttgtatttttagtagagactgggtttcgccatgttggccaggctggtctcgaactcctgatctcaagtgatccgccagcctcagcctcccaaagtgctggggttacaggcgtgagccaccgcacccaacccttttttatttttattttcatttttttgagacagggttttgctctgtcacccagactggagtgcagtgatgccattgtggctcactgcagcgtcaacttcccaggctcaagtgatcctcccagcttccaaagtagctgggaccaaaggtgtgcaccaccacagctggctaattttttttgtctatttttggtagagacggggttttgccatgttgctcaggctggtctccaactgctgagctcaagtaatccacccacctcagcctctcaaagtgctggcattccaggtgtgagccatcacgaccagccagggatctcaccattcttaagtgcctctcattgaattctcctgttgatagttgcattgatttctcactccttcttctactctgtctcttgctacatctggaccctctctcattcattttctcaaagacattcatctagaatgtctaatttttgtggttgggatcaatacagttcacttgctttatggggtgggaggagtgtaacttttctttaaactgaattctaagcagttttcagttttaactcactacagtctccatgctatattctgaatgtttatatcccccaaaattcatatgttgaaatcctaacccctaaggtgatggtattaggaggtgagcctttgagagatgattaggtcttgacagtggagttctcatgactgggattagtgcccttataaaagggaccccaggctggatgtggtggctcacgcttgtaatggttcagctaccaaggcccccaaagtgttgagatcgcttgagcccagtggtttgagaccagcctgggcaacatagtgagacgacatctccacttaaaattgaaataataataaataaataaaaaggaccccagagagatcccctgccacttatcataggaaggcacagtgaaaagacagctatctagaaaagcaggtcctctccagacacttgaatctaccagcattttgatcttggacttcggtaccatgttacaacagccatacattgtgctactgatattccatatataattgacattttcagggttttttgttttgttttttgtttttttgttttttttttttttgagacaaaggctcgctctgtcgcccaggctggagtgcagtggcacgatcttggctcactgcaacctccgcctcccgggttcaagtgattatcctgcctcagcctgttgagtagctgggactacaggcatgcaccaccacgcgcagctaatttttgtatttttagtagagatggggttttgccattttggccaggctggtctcgaatgcctgacctcaagtgatctgcccaccttggcctcccaaagtgttgggattacaagagtgagccaccactgcacctggtctcttttctattcgttttgttttttgtttaaataaagacaggggtctccttatgttgcccaggctggtctggaactcctgacctcaagtgatctgcctccctcaccctcccaacgtgctgggattacaggcatgaggcactgaaactggcagaatttgaaggtgaggatttgggcttggcagggaaagtccacgcagagcagagctatgaggaagactgaagcccaagcccaaggtctctcatgacagttaggccatttttggtaaaagatctgaaagtctgaatttggggatcctgtaaataaaacgttcatgggtagggctgaatccaggatgcaaatgaagccatcatgagtctgtttttctccctttcttgacttctgcttgccgtttgttggccccagcctcaggcttcatgtagcagggacacgatggatgtcattcaggtacctgggtcccctcagacttccagtgagaggagtcagaagcaagactctctttccccatattctttttttttttttaaagacgaagtctcactctgttgccccaggctggagtgcattgacaccatctgggctcgctgcaacctctgcctcctgggttcaagcgattctcatgcctcagcctcccgagtagctgggattacaggcatgcgctagcacgtccggctaatttttgtatttttaatagagacggggtttcatcatgttggccaggctggtctggagctcctgacctcaggtgatctgctcgccttggcctcccaaagtgctgggattacaggcgtgagccaccgcacctggcttctttccccagattcttagcccaaattacattgtgactcttgggctgtgactaggtcacatgatctctttgaaccaatcactgtgtccagatgaatgcaatgcactcattgtctaaggctgggaacacattttgggcacagggaatggcctttcaaaactgtacatcaaatcatgtccctttccagtctgaggtcctatccagcaatgattctcaaccaggtcgagtttgccctcccaggggacatttggcaacgtagggaggcatttttggttgtcacaacgtcagggtgtgtgtgcaggtacattcctggcatttggtgggtaggggccaggaatgaggctaaaacatcctgcaatgggtcaggtatgttggctcaaacctgtaattccggagctttgggaagccgcggcaggaggattgcttgagcccaggagtttgacaccagcctgggcaaaatgacaaaacaccatatctacaaagaaaaatacaaaaattagctaggcatggtggcacgtgcctgtggtcccagctactaggaaggttgaggcaagaagatcccttgatcccaggagtatgaggctgtcgtgagctctgatcatgccatgccactccagcctgggtgacagagggaaaccctgtctcaaagaaacaaacaaacaaacaggccaagcatggtggctcacacctgtaatcgcagcactttgggagcctgaggcaggcagatcgcttgagccaggaggattgcttgagcccaggagttcgaggctgcagtgagctatgatcacaccactgcactctgcactccagcatgaacaacagagcaagaccttctccagaaaaaaataaaacccctcaaaaccagacaaagatatctgcaaagataacaggaaataatatttctcccaaggacactgcagctgtcaagtgccatggtgacttcctactgtgaaccactgctttctgacttgctgagaaactttgttccaggaaatcatagataatttgcagtttgaaaatatatcagtgcaggccgggtgcagtggctcacgcctgtaatcccagcactttgggaggccaaggcaggtggatcacctgaggtcaggagttcgagaccagcctgaccaacatggtgaaacccccgtctctactaaaaacacttaagttagccaggcatggtggcgggtgcctgtaattgcagctacttgggaggctgaggcagaactgcttgaccctgggaggtagaggttgcagtgaactgagatcgtgccattgtacttcagtctgggcgacaagaccaaaactctgtctcaaaaaaaaaaaaaaaaaaaaaaaagaaaagaaaaaagaaaagaaaagaaaatatgtcagtacaaatgaaattttttcttcttgcttggaggatctgggcagttggatacccaggcacagcaattcagataagggttccctgaacaaagtggtccacatttactaaactttagaagttaatttttgcctttgtttggtgaagcaacccacagctgctcagttgctctggtgtccctctccctccttttttttttttttttttttttgagacagggtctcactctgttgcccaggctgcagtgcagtggtgcaatcacagctcagtagaacctctacctcctgggctcaagcaatcctcccacctcagcctcccgagtagctgggaatacaggcatgtaccaccatgcttggctaatttttgtattgtttgtggagatggggttttgccatgttgccccagctggtcttgaactcctagcttcaagtgatcccccagcctcggcctcccaaagtgctgggattataggcgtgagccaccatccagcctttccttgttttcaataaatgaataaacctgactttctcactaaaggttagtccctggtggccaggctggtctcgaactcctgggctcaagcaatcctcccacctcggcctctcaaagtgctgggattatatgtgtgagccatcacgctcagcctcatttatgtatttgttatggctgcctttgcactcccatgatagatgtgagaaatggtggcagagactgcagggcctgcaaagcctaaaaaatttacaatctggctctttacagaaaaactttgctgacccctggtctaaatgttctgagtacataagtgagcaaaacatagctaaatccctccatcatggagctgaaattctagtgggaaaaagaaaaggatttacatacttacaagacaccataaatacatctagtatatgacttgtatataacttagggtaattaaatggtaagaaaagaagtggccgggcatggtggctcacacctgtaatcccagcactttggggggccgaggtgggcgggtcacctgaggccaggagttcaagaccagcctggccaacatggcaaaaccctatctctactaaaaatacaaaaattagctgggcgtggtggtgccaacccgtaatcccagctgctcgggaagctaaggtgggaggaagcaccatgcccggcctgcttccactttttggctactgtgaataatgctgttgtgaacatgggtgtacaaatatctgttcaaacccctgctttcactacttctttttttttttttttgagacggagtttcactcttgatgcccaggctggagtgcaatggtgcaatcttggctcaccacaacctctgcctcctgggttcaagcgattctcctgcctcagcctcctgagtatctgggattacaggcacgcgccactgtgcccggctaattttatatttttagtagagagaggatttctccttgttggtcaggttggtctcgaactcatgacttcaggtaatgcacctgcttcgggatcccaaagtgctgggattacagacgtgagccactgcgcccggcctctcttattttggttatatacctagaagtagaattgttgtatttttttccagcaggattttataccaaggacaaagggaggccatgggaagctgcatgcagggtgctttactaggtcccctggggctgctgtgaggcattctgattgtagtggggaaagaaaggaagtggggagaccaaggaggaggtaggtacagaagttcaggtcacaggtagcagcagcttcaaggtcccaatctgggccaggcgctcacgcctgtaatcctagcactttgggaggccaaggcgggcggatcacttgaggtcaggagttcaagaccagcctggccaacatggtgaaaccccgtctctaccaaaaatacaaaaattggctgggcgtggtggtgtgtgcctgtagtcccagctacttaagagactgaggcaggagaatcgcttgaacctgggagatgcaggttgcggcgagccaagatcctgccactgcactccagcctgggcgacagagcgagactctatcttaaaaaaaaataaaaataaaattaaaaaaatgctctcagtctggcaggggaggccatatggagcaaataaataaatgaatgattacaaatagtgaaaagtactcctaaataaatgaacaagaacagagtgctgtgattacaggaaataaaaagaggaactctggcattctctgtgctacctatcagtttagtgatgcttgaaatccaaaattcaaatcttgcattttaatcatgaatcactttgctgccagttgagtgggtttgatgcagggccgagtctgttggtctaagggtttgttacattgtgagagcccctaatggggaggaaggggcttagaaataaggcaaagggggtggtttgagcctgtggctgaaagagttgcacagagaggcttggtggttaggagcagagctgagccttatctctgccacatcccagctgctggatctgcaacaaattacttcttccctctaaacccagtttccgcttttggaaaatggtagactaattggtttggtctataattacttccttctttgttttggtcactcctgtgtctacagcacctaatacagtatccggcacacaggagactcgcaataaatttctttcttgcttttctttctttccttgtctttccctccttccctccctcccttctttctttctcgctgtctgtctttctcgctctttctctttctttctttctctctctctcttttctttctttctctctctctctttctttcctttcttgatggagtctcactctgtctctgagactggagtgcagtggcgccatctcggctcacctcaacctctgcctcctgggttcaagtgattctcctgcctccacctcctgagtagcttggattacaggcatgcgccaccatgcctggctaatttttgtatttttagtagagacggtgtttcaccatattggtcaggctggtcttgaactcctgacctcaggtgatccacccgcttcggcctcccagagtgttgggattacaggcgtgagccaccgtgcccgactctcgtttatttattttctattttaaaaattttaattgaggctgcgcacagtggctcatgcctgtaatcccagcgctttgggaggctaaggcaggagggtcgcctgcggccaggagttcaagaccaacttgggtaacgtagtgagatcccattttacataaatattgcaaaaaatgttagtcaggcgtggtggtgtcccccatagtcacagctacttggggggctaaggcaggaagattgcttgagtccaagagtttgaggctacagtgagcacccactgctctctagcctgaagaacagagcaagagcaagatcatagctcaaaaaaatttttttaattgagtttaactttcatagagcaaagtacagcaactttaaatgtcctcttgatgaagttttttttttttttttgagacggagtctcactctgttgcccaggctggagtgccgtggcacgatctcggctcactgcaatctctgcctcctgggttcaagtgattctcctgctgcagcctccagagtagctggcattacaggcatgcaccaggacacctaatttatgtatttttagtagagatgcgggtctgccatgttggccaggctggtcttgaactcctgacctcaagtgatccacccaccttggcttcccaaagtgatgggtgggattacaggcatgagccactgcacctagccaagctcaatgaattttaaaatataaatgtgtgtgtacgtgtgtgtgtgtgtgtgtgtgtgtgtgtatatatatatatatatatatatatgtttaaaaccacataactaccaccaaatcaagttatagaacatttacatctccctaggacatttcttcctatcttgactttgatcaacatatgttgttgttattattattattattattattattattattattattattcagagacagggtctacctctgttgcccaggctggagtgcagtgttgcaatcgtacacaattcaccgcagtctggaactctggggctcaagcaattctcctatctcagtttcctgagtagctaggaccacaggtgtgtgccaatatgcccagctaatctttaaaattgttttgttgaggcaggcatggtggctcacgcctgtaaccccagcactttgggaggccgaggcaggtggatcacaaggtcaggagtttgagaccagcctggccaacatggtgaaacgccgtctctactaaagatacaaaaaaattagccaggcaccgtggcacgcacctgtaatcccagctacttgggaaactggggcaggagaatcacttgaacccggaaggcagaggttgcagtgagctgagatcatgcctccgcactccaacctgggccaaagggagagagtctgtctcaaaaaataaaaaaaaaaaagaaatttgttttgtagaaatgaggtctcactatgttgcccaggctggtctcaaacttctggcctgatgagcaatccgcctgcctgggcctcccagattgctggtattacagacatgagccacagtgcctggctcttgaataatgtatattagttttgcctattgttgaacatcgtgtaaatgagatcatggcaaatatgctcttttgtgtctgccttgttttgctccttgttgtgttttgtgggattcatacatattgttgctattatgaacattttttgtagatgtgttttggtggatgtaagctcacctttcttttggaggcgagtggaatttctgtgtcactatgtaattgtatgtttcactttagcacgaattattagttttctttcttttttggagatggagtctcactctgtcacctaggctggagtgaagtggtgcgatcttggctcagagcaacctgtgcctcctgggttcaagtgagtgttgtgcctcagctccccaagtagctgagactataggcatgtgccacaacgcccagctaattttattttattttattttacttttgagacagagtctcactctgtcgcccaggctggagcgcggtggcgcgatcttagctcactgcaacctgcgcctcccaggttcaagcagttctcctgccttagcctcccgagtagctcggattacaggcatgtgccaccatgcctggctaatttttttgtattgttaatagagatggggtttcctcatgtcagccaggctggtcttgaactcctgagctcaggcaatccacccaccttggcccacctttttgtattttttgtagagatggggtttcaccatgttgctcaggctggtctcaatctcctgagctcaagagatccacctgcctcggccacccaaagtgctgggattacaggcatgagccactgcacccagccaaattgttagttttccaaagtagttaagccaatttatatacctcccaacagagcgtgccttttccagttaatccacgtctttgtctgcactcgtaattttcagtctttgtttccagtcactctggtgggtgtatgatggtatttcactggggttttatttgcatttccctgatgactaatgaagttgagcatgttttcatgtgcttgctcaataaatatttgttgaaaggatgaataaagagtgaatgaataaaacatggaaagaaatccaactctgtcttgtgccctgcctaaaacccaccagtggttcccactgcccctcctttggccgacgggtacctgcctgccctggctccttctgaccccacctgctccggatggatttcttttgcttcttctctgggttcctgccatccaggctgtcttcagtttcctccaaggaccctccctgcttcataactttgctataaactgttttcttctgcccagaacacaacccaggcccaaggaacccagacgcgttccttgtatctcagtttgaaagcctcttcctccaggaagccttctctgacttccaccccccagcaagggtggtataaattgctaacttaggcccacttttgcccactttttttgtttgtgtttttgagatggagtcacactttgtcgtccaggctggagtgcagtggggccatctcagctcactgcaacctccatctcctgggttcaagtgattctcctgccttagcttcctgaatagctgggattacaggcacccaccaccatgtccagctaatttttgtatttttacatttatttatttatttatttgagatagagtattgctttgtcgcccaggctggagtgcagtggcatgatcttggcttactgcaacctccgcctcccaggttcaagtgattctcctgcctcagcctcccgagtagctgagcctgcaggtgcctgccaccacacccagctaatttttgtatttttagtagagatggggttttaccatcggtcagactggtctcgaactcctgaccttaagtgatctgcctgccttggcctcccaaagtgctgggattacaggcgtgagccaccatgcccggccaccactttttttttctagctgtgaccatagttgtacatatctccccttccctggcttttttttttgttttttttttcctgagacaggatctcgctgtgttacccaggctgcagtgcagcggtgcaatcatagctcactgtagccttgaactcctgggccaaatgagcctcccacctcggcctcccaaagcactgagattacatgcgtgagtcactacttctggcctgtaaataccctttcaaaaatataatatttgattaacatctgccatcttaccataagaaacacttaaaaaaatcccaatccaaaaaaattccaatcctttaagctatataagagtagcaattttatcttgttcctagcaagacatctggcatatagtaaatgctcaataaatatttgttgacagtataaaggtcaagcaacagcataactggcattattacatgaaagtaattatcccttagaaactcattcacccttgggggacccgggccaataaaaaaatcacagaaaacaatcctatctaccttcctccttcctccttccctcgctaggtcctttgattggggggaggtctcaaatgcacacactgtttctgttttatttggtgcagctgttgtgtgcatgtgttatggaaacccacatcaggcaggagattaaggaggagaggagaaaagaaaggcatcgctggtatcacagtgaaatttacactctgcggcctcgccctagctcctctgtctctacctgtctgcctatgaaacagttcaaaactaatatggcgcaatggatggtattatagacttcccacctccctggccagacttcttgggttcaaagtttggcttaatcacttaccatctaaataatccctgacaatgtactctgtctttctgggccttagtggcctcatctgcaaaatggggataatactacttcttacctcatggggttgtgaggattgcacaagttaatttgtgtaaattgctaagaacacagccttaggaagccttgtcactgtgaatgcatattaattttttttattattattttttgagacagagtcttgctctgttgcccaggctggagtgcagtggtgtgatctaagctcatttcaacctccgcctcccaggttcaagtgattctcctgtttcagcttctcaagtagctgggactacaggtgcccgccaccatgcccggctaatttttgtgtttttagtagagacagggttttgctatgttggctaggctggtcttgaactcctgaccttatgtgatcggcccgcctcggcttcccaaagtgcttgattacaagcacgagccaccatgcctggcctacgattatcatgtctccaggcttcagtttccttacctctgaggtgaggatcaataacctggttatttctaagtgatgcttaaagaggttgagaagaagcaaaggcgctctgcacacaggtgaggtcaacagctgttagtgatggagactggcgccgtctgggtcatcagtgctccggaatcaggctgctcacgggtttgaatctcacttccactttcactccttattaactgtgtgacctcgggcaagtcacttcgcctttctgaacctcagtttccccatctgtaaaaggtaggtgaataacagtattcacctccttctgtgtgactcagctttggagtcagcggaccgggttcaaatcccagccctgcaagtgattagccaggtgaccctgggcagagggaatcactcaacctctctgcacctgggtttcttccttcatgaacgtggagactttacaggatgaaatgagggcacagttaaggcgcccggtacactccaggcaggtagggggctccgttcacgttattttcccctggtgacggatactgtccttaaacagcatttgaaaagtggtcgcagggtgtgtggccccaaagatcccaggcgcttccggaaggcgagccaacgctccccaggcccgtccgcgagcgggtgggcctaagccttggaggatctggggtgggggtggcgcggggtccaggcccggggcgccgagaggtggctggtccggctgcccacgccgagacgcgcgaggtgagcgggcgccggggcggggcggggtggggcggggccgccgcatccccgtgacgcgcgggccaaccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggtacgtgccgggggccgcgtgaggccggcgggacggagggaggccggcggggagggaaagcaccgggcccgcagccgcccggggcaccccgctccccgctctgctgccggcctcgggggcccgggaccctcacgtcgcccgcggcccagcccctttcgggggtgcaaggcatgggggaaacttgggtgactcagttcctgcggagcagagcgtggggggccgcgtgcccagccctggggttttggagggtcgggtcgggtcagagccgccgtgaggaggccttcctgttttggggttcccgtctgtaaaaacaaccttccagggaaggggacgctagagatggggggcgggaagaggggtgtctctctgcttctgttttcccatcttttttgtggttagggtccccccttttcacgaaaaatactccgtgaccaacggggtgagctggggaggggcttagattgtagaaagggactttcattgtctccccaaagttgtcgtacaagccacattactcttctgtggttacctagctttgttttttttgttctttctacttagatactgcgggggaagtttgggggaaccagggaagaagggggatgtccacccttgatgtgccctacctgaccctcggctcggggcagacttggggtgcagctgaggacgcccaggaccctggtagctgtggtcctgccctcccttccctgcaacacgtggagctcctctctggggatgccccttagatttaaccccggcaagttttcttctgtaacgtggcctgcggagcctgactgggtgtctggagtccacttgctgtggtttaagccccagtcttttgggcttcagcttctccgtaatgcgatttgcctctttgttccaggaaggcaggcacttctgtctcgtgctgtcttgattgttggtgaacgcagtaggcaaatctggacacgactgtttctctctcctcttttgtttaggaatcaggagaaacagccttggttcttaggagctggtgatcagcttccaaaaatactttcttgtcctgttttgccggcctttcctcgagggttgcatttggagtgttgaaaagtcatcctccagggccccattggagggtttggttttgtttgtttgttttttttagtagggtatcattgtgtttaataacctaccacactttgatatatctcccattttaagccagtggggttggagagtaaccccaggggtggaaatagaacacagactttgccttgagggtctgggggtgattggagcctctttgcagatggactttctttagcaggggaaaacctgtggcttccttgttgccaggtgtagtaacagcaagattattttttgcaaagattcacatggtgatctgggtttgtgttgctgtgaattccagaatattctcttgtttattttcttctgaattgaggagggggcaaaacagggtgaacatccatgaggttttgtatcaggacgtattttattgatggcaattggtagttgatggctaatgagtatgtttggggtgcgctttgtttatcttaagaaactcattcacgaagtccagttgtaatattttttaaaatttttattttcttttttctttttattttttccttcgttaaggactttctgccacagaaattgccaggtggttgggttttgcttgggggtaattgtagctgatctctgcctctggtaggtaccccatccccgtgtttgaccttgcgtatttctgctgtctggattccaagacttgttggaggtgccttggaaccagaatttgagaggaggcaactggggcctgagtgggaaaattgaaatataattaactgaaagctagaaagtaggtagttgttgcttttttcttttcttttttttttctttttcttttttgagacagagtcttgctctgtcacccaggctggagtgcagtggcacgatctcagcttactgcaatctctgcctccccggctcaagtggtcctcctaactcagcctcccaagtacctgggactataggcgtgtgccaccacgcccagctaatttttgtattttttatagagacagattcgcactatattgcccaggctggtctcctactcctgggctcaagcgatcctcctgccttggcctccaaaagtgttgagattacaggcatgggcctctgtgcccggctgtttttgtgtttttcaaggtagcgtgtccgaggccaggagcgactggcctcccaggcagtcagataactgtgtgaccttgagcaagccactttccctctgtgtgcctcactttcctcatctctaaaattggacaggagccaaaaatgtggcagccttcttgggttgttgcgaagggtcaatgagttaatcttgtaagtggctcagcttgtgccctgcacggagataaacaatggttagtattaaatattattttttccaaagatgaagttgtgtgttttaagctccttgttcttcctttggattccccttttcttcagctggtggagatgggattgggctgtgaaaaggcagtgaggcacccgtgcctggctcctgttgtgaccaaggtcatgtgcttagaagtcaaggtcagtgggcctcgggtgactctgtcagagctttgtttctgggctactgtctgcctctgagccgcaggaaatgtccagaaaacccagaagatggaaatggcccatgataagtgttctgttgacctttactcagacagatgctctgggaagagaaaaggagaactttgctatcaaaacggaaaatagggcctgaggacaggtcacagcagcccttggctttcttttctcatgggggtgggactggtaggaggcgctgctttgtggttgatattggcatgatggttggaaaaatgggcctgggactttttgtgagttcattaaaaaaaaaaaaaaaaaaaaaaaaaaaagcaggccgggtgcagtggctcacgcctgtaatcccagcactttgggaggctgaggcaggcggattgcttgaggtcaggagttcgagaccagcctaggcaacatggattgacccccgtctctactaataataccaaaaaaaaaaaaaaagcctggcatggtggtgtggcacctgtggtcccggctactagggaggctgaggcactagaatcacttgaaggctgtgggggtggaggttgcaatgagctgagatcacggtcactgcactccagtctgggccacagactgagaccctgtctcaaaaaaaagagggccgggtgtagtagatcatgcctgtaatcccagcactttgggaggccaaggcaggcggatcacctgaggtcaggggttcaagaccagcctgaccaacatggcaaaaccccatccctactaaaaatacaaaaattagctgggcctggtgattcacgcctgtaattccagctacttgggaggctgaggcaggagaattgcttgaacctgggaagaggttgcagtgagctgagatcacatcactgcactccaacctgggcgacagagagactgtctcaaaagaaaaaaaaaattgtgcttcaggccctgtgtagaaaaattggaaattatggaaaagcagaggaaacaacttggtattaagcagtatagtgtggtggctcagagcaaattcgcctctgctgctgaggcaggttacgtcatctctccgtgcctcagtttccctatgtgggataacgtagtacctagtgaatagcggtgacttgaggaataagtgagttaatccttagcaaggacttaaaatgttgctgcttggcacacagcgctcagtaaagatcagtggtcgttgccacctggaattctccagttaatttttgctgttgcaccaactgccactggagaagaccagaaggaagctgcaggtgtgtgtcaccgtcgatggagtgagctggtcccagggttgatgtgcacctctgagatgctctgtggcatccaccaactcagtaaccccctgaatatctgacttagccgccaaggaagaatatcttagaagctattaggaattcctcttggggctaggtctgggccttggagtcagtctgatccctggtttaattcttccccttggctcaacagcagtgtacgacgagccaatttttcccctcctccaagtgtggctttggttttcaaatccatcccttagccttctcctacttcctctgttttcccctccccaccctttttttttttttttttttgagatggtgtcttgctgtgtcgcccaggctagggtgcagtggtgtgatctcggttcactacaacctctgcctgctgcgttcacatgattcccctgcctcaggctcccgagtagctgggattacaggcgcacagccaccatgcctggctaagttttgtatttttacaaaactttacaaaacccccatagagacggggtttcatcatgttggccaggctggtcttgaactcctgacctcaagtggtcaacctgcctcagcctcccaaagtgttggggattgcaagcgtgagccaccgcgctcagcctgttttccccctttttggctgcccctccttccagacccttcctctctcccttccttatggagtgttagagtggaaagggatgtcagatcttggggggccctcctctccacccaccccatttcgtggatgtggacactgaggtccaggatggtgacatgacagggtgcaaggtggcaaggtgaatggctttgggaggagatgagggtgacccgggagaggcctgggcaggagtggactcaggggttcctggtccaaatgggttcgtgattcaggccaatcaggagcggattcagggttccttggccaaatggagccactgcagccacaggggccctgcagaaggcagctgcagccggtccctttggccaagactctcctgaagggtcgtgttctctttctccgaggacaagttccatttgtgatagcctggagggggtgcctcgcctttgggacctggtggtagatgggggggaagaaaaccttttctgtttgtggacacaacttttaggaactgatctctctatgtgggtgtctcccactgaccatgttcctaaagaacgtgagcttcctcttcccatgtcagtctccagctttgacttctctttttctcctcccattcctatcacatctgtcagcaaatcgtgttgcccgttgcctcaaacgggctgcttttcatggcttccccgacttccactctggctcgagtcatcgttggccagtttctggatttgaacagtcacctcagtccaggcgccgtggctcatgcctgtaatcctggcacttcgggaggccaaggcagacggatcatttgaggccaggagtttgagaccagtctgggcagaatggtgaaaacctgtctcaactaaaaatacaaaaattagccgagcctggtggtgggcgcctgtaatcccagctacttgggaggctgaggcaggagaatcgcttgagcccagtggggttggaggttgcagtgagccgagagttcgccactgcgctccagcctgggtgacagtgagactctgtctcaaaaaaaaagaaaacagccacctgttcgctgctgtgcctactctgcccttgacccctacagtctagtcttggcccagctgtccctcttctactaaaaccctgcagtagttccttgagggtacaagccaaagggcttacagtggcctcgaaggctgggcagcatctgtccccttggcctccctgacctcttctctggctgctttctgtctcactctcctccagccacacttgtggccaggcctgtccctgcctcagggcctttgcacttgctgtttctcctacctactatgtccctcaccttcaaactttgttcaggtgtcacctcaggcatcccgttctttccctccactagcaaatctctgtcccccatctacacccccagtagcacttactgccttctaatacacgtaatattttgcttaagtattgtgcctactctgtaaactcctaccaaaagatcggctccataggggcagggattttggcctgtgtttgtttacggctgtaatcccagcacctagaactgtgcctggggcttagtaaataacagttgaccttggaacaattcaggggttaggagtgctgatgccccatgtagttgaaaatttaggatgcagcgcggtggcttacacctgtaatctcagcactttgggaggccgaggcaggtggattacctgaggtcaggagttccagactagtctggccaacatggtgaaagcccatctctacaaaaattagccaggtgtggtggctcatgcctgtaatctcagcactttgggaggccaaggcaggcagatcacttgaggtcaggagtttgagaccagcctggccaacatggtaaaaccctgtctctacaaaaattagctgggtgtggtggcgggtgcctgtaatcccagctacttgagaagctgaggcatgagcattgcttgaacctggtaggcggacactgcagtgagccgagatcgcgccattgcactccagcttgggtgacagagtaagactctgtctaaaaaaaaaaaaacacaataaaggaaagaaaattcaggtctaactttcaactccctaaaagtttaactactaacagcttactgttgactggaagccttaccgagaacataagcagttgataacactaattctgttgttgttggttgttttttgatagagatggggagcttgctgtgttgccgaggctggtctcaaactcctggcctcaagctattcacctgcctcggcctcctaaagtgctgggattataggcgtgagccactgcacttggcctaactcataccttgtatatatattatatactgtatttttacagtgaagcaaggtagagaaaagaaaatgttaagattaattcataagagagatttttactatttattaagtggaagtggatcatcataaaggtcttcatcttcattgtcttcacgttgaggaggctaaggaggaggaggaaggggaggggttggtcttgctatctcagggatggcagaggcagaagcataatctgagtataagtggacccgtgcagtttaaatgtgtgttgttcaagggtcagctgtttgttgaataaatgaatgacatgaagtattacagtggcttttgggcggtgtcgaaacttctttgtaaggattttaaggatgaaataatcacttaactgtctggaatgaacactcagataaactgagtcctccagctttctcatcagatggcttgtttttttattttatttttttgagacagggtcttgctctgtcacccaggctggagtgcagtggcgcgacctcagctcactgcagcctcaacctcctgagctcaagcaattctcccacttcagctccccaggtagctgggactacaggcacacaccaccatgcccagctaattttttttttttttttttttgtagagatagggttttgccatgttgctcaggttggtggtgaactcctgaactcaggcgatctgcctgccttggcctcccaaagtgctgggattataggtgtgagccaccgtgcttggcagaacagcttctatttcatcttggaaaggtcagaacagggttttgtccacccctcttttcccaggactcagtgtctcacacacagtgggggctcaatcaacattagaatttgagtgtttgaggtatgagttccaagctaggggttagatatagctcaccactgtgctggtttggcttgattttaattataggaatgactgtgatttccaattttatttatttatttatttgagacggagtcttgctctgttgccaggctggagtgcagtggcacgatcttggctcactgcaacctctgcctcctgggttcaagcaattctgcctcagcctccccagtagctgggactacaggggcacgccaccacatccagctaatttttgtgtttttgatagaaacggggtttccagtatgttggccagcatggcctcgatctcttgacctcgtgatccgcccgcctcggcctcctaaagtgctgggattacaggcatgagccactgtggcccgccctacaatgtttattcattggcagatttcacagaaacatctggatttctggcttcccttgaaaaatcagaagttctgctagccccaggcccacatttatacatggtagcggtccgctgaggctgtccgtttctgagttgctccagtttgccgcagtccccacccctccctgttgttgctttaattttaaggccaaatgtttgttgcctttgttttattttatattatttttttgagacgaagtctcgctctgtcacccaggctggagtgcagtagtggaatctcggctcactgcaacctctgcctcccgggttccagtgattctgctgcctcagcttcccgagtagctgggattacaggcccgcaccaccacactcggcttatttttgtatttttagtagagatggggtttctccatattggccaggctggtcttgaattcctgaactcaagtggatcacttgagttcctcagcctcccaaagtgctgggattacaggcatgagccaccgtgcctggcctgttgcctttttaaaattgtgcttcctcacacctggtctgcttcttgcatggatggaacccactttggcacctgttggtatctgagttggcatctcctgctttgcaggccaaccttgaagttagcatctgattggtatgttggcttcagattttcatggcgaagtaaggcctagctttgatgatcagctcttagtgtggtcagtacaactctagctcgtgaaaacttgcccaaacattttgccaaaattaattaatggccagacatcctgaggcaagcttccccccgcttagcaagaaaactgggatagggcagcatccctgtgggtggagtggtgctggggacctgcacttacctcttagaggctgaatggttgaacggggcctttgaggaagctgtattttgcgggtggggacatggagcacagttgctcagtgtcggccccgttgacatgtaggccacatcattctttgtggcctggttgctgttctgtgcagcgtagtcttagccccaaacctggcctctaccccctagtagatgctggtagcacctcctcttgttgtgacaaccgaaaatgcctctagatgtttccatatgttccctggggtgtgaaatcacacagccactggtgtggaggaatatgggggagaaacatggagcaagaccttcctcctcatcctgcatttccctaggaggttgtgggctgtcgaaattctagtgtaattggcttactggggttgccttggagaagcttaatgagacgttaaggaggttaaactccaattagctagagaagaaacttgcggcagtttcttttttactgagggctgtgtctttttacctttttccattttcccagttggagttgtgacagttcattctcccctgggaaaacaaaaatggctttctttttctttttctttcttttttcttttgagacagggtctccctctgtcacccaggctggagtgcagtggcacaatcatagctcactgcagcctcgacctcctgggctgaagctatcttcccaccttagcctcccaggtagctgggaccagaggtgcacaccaccatacccggctaatttttgtattttttgtagagtcagggtctcaccatgttgcccaggcttgtctcaaactcctgggctcaagcgatcctcctgcctcggcctcccaaagtgctgggattacaggcgtgagccaccatgcccagccgaaaatggctttcttgagagatcagctttgaagctctactccttcattttaaagtgccccaggagaagtggacgattacaaagttgagattccacttaagtgtccccttagtttaactgtgggattcatctcctggggaggttgccaggttctggaaagtgggtgttaatgaccagggagggtgcccctaggctagcatcctgtaaccctcaggaattgagatttttatggaggttttctcttcctctctgtgagttttctctctgagaaacctgtctagggagggaggctctaggctagcatcctgtaaccctcaagtagtaattgagatttttatggagcttttatcttcctctctgtgagttttctctctgaggaacctcagtgtaccttttactggcctcctaggtaatacttgtttggagaatatgtgtgatgtctaagtcttcccagtacaagaaatttgtgtggtgtttgactgattgatggatggagtcttgttctgtcgccctagctgattgtaccactgcactgcagtctcgacctcccaggccaagtgaccctcccaactcaccctcccaagtagctgggactacaggcatgcaccagcacacccggctaatttttgtatttttttttgtagagatggggtttcactatgttgcccagtttggtcttgaactcttgagctcaagcagtctcccagagtgctgggattacaggtgtgagccaccacgcccagcctcgtgtggtctttgatacccctgggttcattgtattgttcttcccacactgcttttcattcattcatttattcagtcattattaattgagcagctactatgtgctgctgctgctctaggcactgaggatacaacagtgaacaggacagaccaggcccatgttctcatggggtttacactgagggtgacggaaatgatttcagatgctggcaagtgctgcaaagacttgaaccgggaaaaactgggtgaggtgcaaactactacggagggatgtccacagaaggcctttcggaggcggtgaggtttgaccccagagctcagtggcaaagctggccatgcaaggatgtgggggaagggagtcccagagtgggaagagaatgtgcataggccttgaggaagatcatggtgtggttaaagtattgaggagtttaactcaaaggaactgcagagcccatctcataaaaatctagcctggagcattcggcaaaatgcataaagcactaacacaatggcttgtggtcctggaatttccagggaaggcgcttaccagctcagcaaggaagtagaacaatgcatggtccctggcagaagcaagaaccttctgatctgtttatgtttgaatgaaacgcaggttttttttttttttttttttttttaaaatagatgggggtcttgctatgctgctcaggctggtctcgaactcctgggctcaagcaatccacccaccttggcccttccatgtgctgggattacaggcatgaggcactacgccctgctgaatctcaggtcttaaaaattcagtttattttgttttatgagtctcttctctttctcagaaccttaactgaaacgtttgtgatcaagaccaacttgggtttccccactccccagttgcctttgattctccgccaaaggcttgttcgtaagatgatgaggtacttttttcctgtggttaagaggactttctataggttgctagaaaactcttgttttaaaacaagatgttgttgaattgatctggctgattgcaggaggaagatcttgtactgcaactttgttgatgatgctaatactttaaggtgaatattctagaagaatataaagggaaaaataaaagttttagtatgttcccaccctgccctttgttcccagaagtagccgttattgatgatggttgttgatgatagtttcttgggtgtttttcgagaaaagtttcaagtatatgcaaatgtatgtgcaagaacgtgttcgtttgtgtgtatatgtttacatattcattttttccctccctagttgggtattttaaatactgttttgtctcttgttctcttcacttaaccagtgttgattttcttgccattttaagcccatgcaaattgaaagtaaaagccaatcaaatcaacttttttttttttttttttttaaacaagccacgcatttgcctgttaaatggctgagccatgtattcacccattcccctcttggtgtctatcaaggtcattcccagttcctggtttcttgctgtgataagcagtgctgcactgaaggcacatgtatgcaaatatatgtaaatgattcagcagaataaattttcccacaggaaattgctaggttgacagtatgtgcattttgaaatttgatagttaattgtcaggttactgcagcagtttatactcccactaatgggcccaccagcacttattaagcacctgttgttttcctgccatatcagaaaaattgagcaagctgggaagtgatcaggcccatgttgcttggctgtgtgtgagagggctttgcccagttaagttaaaccttactttccagaggtcaggagatcaaagcagaagtgtgctttggttttgttcagttttttaaaagatgtgtttaaattttaaacatctttggacttattttaaaaattgcttttaaatcaataatttaacaatgtgtaaaaacattactgatagtctcaccatgctaatgtcactctgatttttacacctaaactaatttaattgcagagttttctgatcacaagtgacatgtgttccatatgacagaacaaacaatacaaagatatttaaataaagcctgaacatggtactgatattagtttgttcatgctgctatgaaaaaatacctgagactgcgtagtttataaaggaaagaggtttaattgactcacagttctgcatggctggggaggcctcaggaaacttaaaatgatggtggaaaggaaagcaaacatgtccttcttcacatggtggcaggagacagaagtgcagagtaaagaggagaaaagccggtataaaaccatcagatcttctgaggactcactatcaggagaacagcatgggggaaccgctcccatgatctaatcacctccagtgaggtccctccaccaacacgtggggattacaattaagattacaattcaagatgagatttgtgcggggacacagagccgtgccatatcattctgcccctggcccctcccaaatctcatctttctcatatttcaaaacacaattatgccttcccaacagttccccaaagtcttaactcatttcagcattaactcaaaagtctatgtccaaaatctcatctgagacaaaatctagtctctttcacctatcagcctgtaaaatcaaaagaagttagttagttcctagatacaatgggggtacaggcattggataaatacacccgtttgaaatgggagaaattggccaaaacaaaggggctgcaggccccatgcaagtctgaaatccaataggccagtcataaaactttcaagttccatagttatctcctttgactccgtgtctcacatccaggtcacactgttgcaagaggtgggcttccacggccttgggcagctctgcccctgtggctttgcagggtatagccccgctcctggctgctttcacaggttggcgttgagtgtctccgtcttttccaggcacacgatgtagctgcaggtggatctaccattctgggttctggatggtggcccttttctcacagctccattaggcagtaccccagtggggactctgtgtgggggctctgaccccatatttcccttctttactgcattggtagaggttctccataaaggctccacccctgcagcaaacttctggctggacatccaggcatttgcatacatcctctgaaatctaggtggaggtttccaaacctcagttctttagttctatgtacccacaggctcaataccacatggaagctgccgaggcttggggcttgcaccctctgaaggcacagcctgagctgtgtaccttggctcctcttagccatgactggagtggctgggcaccaagtcctaaggctgcacacatcaggggggccctggacccagcccaggaaaccgtttttccctcctaggcctgtgatgggaggggctgctgtgaaggtttgtgatatgccctggagacattttccccattgtcttggaattgggctccttgttacttttgcaagtttctgcagccggcttgaatttctcttcagaaaatgggtttttctttttacattgtcagactgcaaatttccacactttttttttttttgagatggagtctctctctgttgcccaggctagagtgcaatggcatgatctcggctcattgcaacctctgcctcctgggttcaagcaattctcctgcctcagcatcccgagtagctgggattacaggcacccgccatcatgcctggctaatgtttgtatttttgtagagacaggatttcaccatgctggctagactggtctcgaattcctgacctcaagtgatctgcccaccttggcctcccaaagtgctgggattacaggcgtgagccactgcgcccggccaatttccacccttttatgctctgcttcctcttgaatgctttgctgcttagtaatttcttcccctagatgccctaaatcttctctctcaagttcaaagttccacagatctctagggcagggtcaaaatgctgccagtctctttgctaaagcatagcaaggatcaggagaacagcatgggggaaccgtccccatgatctaatcacctcccatgatgtcccttccctaatatgtggggattccaattcagattacaattcaagatgggatttaggtggggacacagagccagaccatatcagtaatctcttgggctaaccaataaccaatgtattcttgtattttttctttgaaattttataaatatttataaatttaaataacatttaaatcaaaatggattatgttgtaatcattactctgccagttttttttttttaatttttaaatttattttttgtagagacaggatctccctatgttacccaggctggttttgaacccctggactgaatcgatcctccggctttggcctcccaaagtgctgggatcaaagtttgttaatttgatagctaaaatatattttcatctgcatttcaattacaattagaagctatgtatcctgcaacatattttccagcaatttgtgtattttcagtgtgtctttctgagtcctttttgggtatgcctggactagtttgtctttttcctgttagtttgtaagggctcttgttattgtgggacctttcctctttgtccatcacctgtattgtataaatattttgttacaggctattgttttcctattggcatattaacatttgagtcttgttcttactagtatgtagttttgcaaggttgcatttgtagcttgcatactgtctcctatgtttttatttactgtaataagtattttcccatgtacccacgtaacctttttaattaaacctataaatgtccaatcgatagttccctgtgttggtgggctataatcacataattattatctgtggtttgacatttgggttgctgtgttttctttctccttttttttttttattattatttttgagacggagtcttgttctgtcgcccaggctgaagtgcagtggtgcgaccttggctcactgcaagctccgcctcccaggttcacgccattctcctgcctcagcctcccaagtagctgggactacaggcacctgccaccacgcctggctaatttttttgtgtttttagtagagacggagtttcaccgtgttagccaggatggtcttgatctcctgaccttgtgatctgcccacttcggcctcccaaagtgctgggattacaggcatgagccactgtgcccagcccctttctccctttttaacttttttgagacagcatcttataccatcacccaggctggagtgcattgcgcaatcttggctccctgtgacctctgcctcctgggttcaggtgattctcctgcctcagccgctggagtagctgggattacacatgtgtaccatgatgcctgattaatttttgtattttcagtagagatggggtttcaccatgttggccaggctggtctcgaactcctgacctcaggtgatctgcctcccaacgtgctgggattacaggcgagagccaccatacccagtcatttttatttttcttttaaagaaaacactgtcctgaataccacatgggtagagtgcgtattggcttatttccttagatgatgttctcaggagtggaatgaataacatctgaaaaggcttcactctagccattgtcttattttctaaaagtgagctggcccagctcaccgttctagcagggtctaaggttacttactgctgtggttattattcagagtggacgatggtgcatgttaatgtcaggcacagcagggcgcggtggctcacgactgtaatcctagcactttgggaggccgaggtgggcggatcacgaggtcaggagttggagaccagcatgaccaacatggtgaaaccccatctctactaaaaatacaaaaattagctggcgtggtggcaggcacctgtaatctcagttactcgggaggctgaggcgggagaattgcttgaacccaggaggcggaggttgcagtgaactgagattgtgccactgcactccagcctgggtgacagagagactttatcttaaaaaaaaaaaaaaaagtcaggcttttctagggttcctccatcagccttgtaaggctggagacccgtggccaggaagaaaattggagctgtctggcactgggaagggtaacccagtagttataattaggttggcttatctgcgagccctttgataaggcttcactaatttactaacccaggatcgcatgttagatcaggatctctctgagtgctgcaattgtagtttgcttttctctctctcttttttttttttttttagagacagagactcactctgttgcccaggctggagtgcagtggtatgatcatggctcactgcagccttgaactcctggcctcaagcgatcttcctgccttaccctcccgagtgtcttggattatagatgcttgtcaacatgcccagctaatttttaattttttttagagatgaggtcttgccctgtcacccaggctggagtgcagtggcatgaacatagctcactgcagccttaaacttctggcctcaagcagttctcctgcctcagccttccaaagtgctgggattacaggtgggcaccactgtgcctggcctgcagtggtttaatagggctctttcatctttaactttggtcccctgccccctgagatccgtggagtgagccgtttgacgcttggtacttgggacaaagctggcctatgtccagttctctgcatacttggtaggggagtgtttggagaaaaggctcacctctgagtcacaccctctatattctccaaagggccatggggatggggtggaggaggctggggtgaagagatgttgtagctccagagaaagccagggaggtgtatgctgggtgaagaggccaagttcaggagcctaggtttgaaaatcagtatagacgattcaggttaattcaccctgttgttatagagcatctgtctgtagggtggccaggtctgggtgagtctcttggacaagatgggtatcaggtttcagctctgaaattggactgatatgtggggagattcattctgcagttttatttgtagtttaggtttaagaaaacttggactgggcactgttgctgtcgtctgatcccagcacttagtgatgctgaagtgggaggatcacttgagcccaggagtttgagaccagcctgggcaacagaaagaccccatctctacaaaataataataataataattattattattattattagctgggcatgatgggacatgcctgtagtcccagctactcaggaggctgaggcgggaggtttgcttggtcctgggaggttgagctgcagtgagctatgattgcaccactgcactccagcctggacaacagcatggcactgtctccaaaaaaaaaaaaaacaacaaaaaaaaaacttgtttaactacctaaatcatagcatttgtgtgaagccagactatcacaactctgagaactgctgacatatacatattttggaagttccaggttttctgttactataaacatggtagagattgaattacttaaagggacgtcttttctcctactctttgtcttgtctgatgttataaggggtacagtatagaatgaaaacagtgcagaaatgagtgaaacatgaaaatcccttctagagataattttcttttattatttttttgagacggagtcttgctccattgcccagtctggagtacagtgatctcggctcacggcaacctccacctcccaagttcaagtgattctcctgcctcagcctcccgagtagctggggttataggtgtgtaccatgcaccaccatgcccggctaatttttgtatttttagtagagacagggtttgctgtgttagccaggctggtctcgaattcctgacctcaggtgatccgcctacctcggcctcccaaagtcctgggattaccggggtgagccaccatggccagcctcttctagagacaatcttattggcaggttgatgtttttaattttcagcctctcttctccacagatcctaaagatatagtaatttttttttttgagacagagtcttgctctattacccaggctggagtgcaggtggcgtgatctctgctcactgcagccttcacctgccgagtagctaggactgcaggcatgcaccactatgtctagctaatttttgtatttttagtagagatggggttttaccattttggccaggctggtctcaaactcatgacctcaagtgatccacctgccgcagcctcccaaagtgctgggattacaggtctaagccaccgtgcccagccataaatacatggtattttttaagaacaagaacgggattctacaaaaacatatatatgtgtattttgagacaggatctcctctgttgctcagggtggagtgcaggggcacgatcatggcccactgcagccatgacctctcaggctcaagcaatcctcccaccttagcctctggagtagctgggaccacaggtgcccaccaccatgcccagctaatattttttcttttttttttttgtattgaaaacagtcagccaggtgtggtggctcacacctgtaatctcagtacgttgagaggccgaggtgggcagatcacttgaggtcagtagttcaaggccaggctgtccaacatggtgaaactccatctctactaaaaatacaaaaattaactgtggtggcgcttgcctataatcccagctactgggaagggggaggcataaggatcacttgaacctgggaggaggaggttgtagagagccaagatgatggcactgcactccagcctgggcaacagagcaagactctgtctcagaaaaacaaaacaaaacatatagtctttatttttttgtttgcgtgggctggtgcatcttgattatgatgcatttttgttaattgatatttaattgcagatgaaatgtaacatggatctgagtaattgctgataattgtttcctctttaggcagctggtcagtcttttttttttttttttttctttttaagagagtttctgtcttgttgcccagactggagtgcagtagcgtgatctcggctcactgcaacctcctttgccagggttcgagtgattctcctgcctcagccccccgagtagctgggattacaggcatgtgccaccacgcccggctactttttgtatttttagtagagacgggttttgccatgttggccaggctggtctcaaactcctgacctcaggtgatcccccctgcctctgcctcccaaagtgctgagattacaggcttgagccactgctcccagcccatagtcttttttttttttaaacctctgtgtacaggtaggtcctggggaaattcgaggcaagacttgggtgagtgggtatcttagaccctctcaggagctctttgcaggaggtagaatctccgagggtcagtgcccatgaatgggtcccatggcctgactggtcccattcaggtgacagtctctgagggtcctgcatagcccttacctgggctccatgctgggaatcgagcggtatacagagcatggttccctgccttccttgagccccagtcttgttggggaaatggccaaataaatgaataatcatcaggaagtgctatgaaggggagctgcgtggtgcccggtgagtgcaatagcggggtttcatctggttggagagaaaaaaggagactccttaagtggggaacccgtttgatgatacaggtttggctatgtgtgtcaaagaccccaaatatagtgggttaagatacaagctcatttctctctcatgtaaaaatcccagctggtgtggcagctctgtccccaaaataatcagggtcccaggcccctcccatcttgttgctctgctgtcctcatctgcatggatcaagatgatgcatctccatgtccacatggcagccagtaggaaagcagagtaagggcacaacctggaggttgcctacgtctctcctcgtcacatcccattggcttgtacctagtcatgtggtgcctctagctgcaaaggaggctgggaaatgtagtttcctttctaagcaggatgtacccagctgaagatgttactcagggatgagggagagttgatactggagcgcagctagcagtttctgctgtataggcaaaagcagaaggtaagaatgttctgggcagtgggaaatgcatgtgcagaagcactggcttaatgaggaaggccactgtggctggagtcaaagagtagggaagagaaaaagaaccagaaggaggctgagaattgggcctgtaggacttggatcctgtgggaagccttggcagctttctttcccccctccttgcttaggcattagctctaagacagggatatttacaacacaattatttctttaaaattatatatatattttaatttgtacagatgaggtctccctgtgttgtccaggttggtttcaaacccctgagctcaagccatcttcttgcctcggcctccgaaagtgttgggattacaggtgtgagccattatacctggccttcaactcagtccctaaagacaactccttctcaagtgttggaaagaaccaatgactaatcacttctagtctgccttatccccatcttgcttgtgtgactttggtaagagtttgtttgtttatttaaaggagcagagagtttaataggcaagaaggggcaagaaagaagggagaataagatcccctgtatagagacggaggagggctccaaagctgagagagggaaccccagctgccacagatagcagctaggtatatgtacagaggctggaagaggcagtgtctgatttgcataggcctcaggggattggtttgactaggcatgtctttcacgtagcgcatgaaaaagctggccctcccacctagccttttaatatgcaaatgcagggtaccatgatctgcacacttggggaggtgtggtggcggccatgttgctaggaacatgtggggaaagggcaagaaggctgtgggaatcgccatgtttgggtggacccagtttctaatggcttgcatttgcatatcaaaggttgctggcctggctctaagagccggggctttacaagaaacttttccggagttgctttaaaaaccaaacatttcccaaggaccccttttcctctctatttgcctaaaataattgcttaactcctacattaccccctgtggagatgccacattaactgctgttagggggttttgggcgacgacttcttctggctacttcctggtgaaaaggggcgttgaatggggaacagcagctagggctcctcctggggtggatctaagggtcctcggaagaatggcgtgtccatgtgtgcttcaggttacagcaccattttgagtttgattgcttcagtctgatgaaataatttcctttcctggccaacacaccaaaatgatacggctccgatgagtgggggaacaccagggttcttggtcctcatgccggtttagataaaatgacacagacacacgtggagtggttttaaggagtggagagtttaataggcaagaaggaagggagaaggaagaaggtcccctgtacagagacagagggtggggggctccaaagctgagagacggaacctccaggagttgattttataaataaaataacatgcgttgaggtcactctgtgttgtgtggtatgcccagccctctctgcacataacttgtttcaggcccacagtcatgctgggtggttgctgtaatgactttttattttaaatggggaatctgtgacacagttaaacatgcgcaggatcatgtcactagcaaggagtggacacggtattcaaacccagcaggttgactcaaagcctgccctttccccagctgttttgcccctcagtcatttgagtctagtcttcaggattttgacatctatctcttaccttgtatctgttaggattgcatctggcttcaagaaacagccctacttcagcagcctaagcagaaaggtattcatttgtttattttttacatgtcaggaattccagtacctcttggagttgctggcattggattagtgatgcagggttgttaggactgacatctctgctgttttcttgtcttttcctcaaggcccctaaatggctgctacagccctaggcaatatatctgggttcaaggtaggaagagggagggattgcaccagcctcatgggttcctttctattcaggaaagtccaagccttcttcaaaggctcttctgtccacattgcagacttctggtcatgtctccttggctgaaactggattacatgaccacctctagctgcaagggaggcaggaaaaatgagcatttggttttatgcttctctaggaggaaacagcaagggagaaacttttgagtaagccagccaatattgtccaacatgtacttattttttaactttttttttttttttttttttttttgaggcaaggtctggctggctctgttgccgaggctagagtgtggtggcacaatctcagctcgctgcaacctctacctcctaggctgaagctatcctcccaccttagcctccagagtagctgggactaccacatgcaccaccatacctggctaatttttatatttgtagagatggggtctcaccatgttgcccaggctgctcttgaacttgtgagttcaagtcgtctgcccacctcagcctcccaaagtgctgggatgacaggcatgagccatcacactcagctaatgtttttctttcaatcaattcactttttaagccttaacaaagttatcgcaaaaggaagtttcatatcactttagaatgtctttgaagtcacaggttggttatatttatgtgcttactttaatagctattaaagtaaatatagcactactaagaaaaaaagatattctttaaatcgcctattatcagtggttcttaactctggatgattttgtctccaggggacatttggcaatgtctggaaacatttttggctgtcacgatggggcagggagcgcacgcctagagtctagtgggtagaggccagggggtgtgctaaatatcctacaatacaggatgggctccataatgaaaaatcctctggtcccaaatgtcagtagtactgcagttgagaaaccctggcatggacgcaatccacctgctgccaggagttatatacaagccatgttagggtaatgctgcaatatgtccatcgtgattgtgttttctcctgggtgactatcagcaatggtgtagcctgcttgttggttttcaaggtccattctcaagatactatcagatctccagcaatcgtgtgatgcagtttaaaatgttcatgtgagctgggcgtggtgactcatgcctataatcccagcactttgggaggccaaggctggagaatggcttgagcccaggagtttgaaaccagcctgggcaacatagcgagacccagtctctacacaaaattaaaaaaaaaaaaaaattagcccggtatgatggtgcatggccatggtcacagctactcaggaggcagaggtgggatgatcacctgggcctgggaggttgaggctgcggtgagccacgattgcaccaccgtattccagcttgggtgacagagtgagaccctgtctcaaaaaaaagaatgtgcatatgaattcaagatatgtcccttatagagactggtgaggacacagcttattgaccctgaagctgaagtggttgaaatgatagccctcttgccaggcaaatcctatgtgagtgcttctaaaagaacactgtaccttgcagagagtattcctgggacctggcaggaatcagggcctcttggtgaccacatgctttggaaagggctgtgctttggcaagtgggagattttattatttattttctcctgtctgcctcggtttggcaaaaacaaacctggcctgggcatgggccttgtggagacaagaaggcagcttgagattatcagagatcaggctgctggtgggtttgcctgagctggcctggtcaggtagcttgacaatgatgctcagacccccattaaagttaattgagcggttacagagtgggagtggggagtggggggtgtggtgactgcctgtctccttgagttggcgtggctaagaagtaagggaattttttaacttttccttcttaattctggaaacttagaaaaaagcctctcaccatcccttaatcattcagttagagagaccaggctgttgatatggacatgctgcgtttcatggaatcctagaggccagtatttatgacatacttcccagtttcagagatgttaggatataaaaatgtagccagcagtgtttacaggatgggctaatcgagagacacagacaaatatcaaagatagcaaaataggaagaaacagagtcttagaatcaatgcagtataataatagcttctagtttctttctgtttttctttttatgatacagagtctcactctgtcgcccaggctggactgcggtggcatgatctcggctcactgtagcctccgtctcctgggttcaagtgatcctcccatctcagcctccaagtcactgggattacaagttgtttgccaccatgcccagctaatttttgtatttttaatagagacagggtttcaccatgttggccaggttggtcttgaatgcctgacctcaagtgatcccccccagccttggcttcccaaagtactgggatgacaggtgtgagccaccatgcccagcctccccctcactcttaagcacagctcttcggcagtcagagatgttgcctgctgtatttctcgttctgcttttacacatggtttaaaaatcctcgcccaagaatgtaagccccatggctagtgctacctgctacctttaggggtggcctctcctggggtgcaggaggttgcacagttcgttttgtgacagcagggtcattttttaatcggatcatctgccccagtttgcttggctcttaggtgcttgggagttctcctggttttttgctgttgtgaaatggcccagcttgtacacgttgttccttttcttgctggagttatttcctttagactcctgtccctaaagtaggattgttgggtgaaaatggggtatgcgtggttaggcttttctctgcctgctttctggattgctcttcagatagatttaatcaccttttatttatgttttgtggtggttttttttgttttttttgtttttttttgttttgagactgagttttggtcttgttgcgcaggctggagtgcaatggtggggtctcggctcacagcaacctctgcctcctgggttcaaacgattctccttcctcagcttcctgagtagctgggattacaggcatgcgccaccatctctggctaattttgaatttttattacagacggggtttctccatgttggtaaagctggtctggaactcccaacctcaggtgatctgcccgcctcagcctcccaaggtgctgggattacaggcgtgagccgccacacctggccaccttttatttgttgaatgagtgtttaataagcatgtcctatatgcatcaggagaattaaatggacatggtcttgctttggggggaaatgacaggtaggagagaaagagacacttagaactcaacagaggccagacgcggtggcttacgcctgttatcccagcactttgggaggctgaggtgggcggatcacctgagatcaggagttcgagaccagcctggccaaaatggtgaaatcccgtctctactaaaatataaaatcaatcaggcgtggtgatggcacatgcctgtgatcccagctactcgggaggctgaggcaggagaattgcttgaacctgggaggcagacattgcagtgagccgagattgcactactgcactccagcctgggcagcaagagcaaaactctgtctcaaaaaagaaaaaactcaacagagaaaaggcggatcgttaaggcttctttggcacttcctaagtgccagggactgttgttaatgcctttgaagtgctaataatgacttaatggtgacaagttccctgtgaagcagggactgtgattgtttctaccttatgggtggggaaaggaggcagagagaggtgaagtcacccagctagtaaatgacaggactagactgaaacccaggcagtctgtctccagggcctggccggtaccccatgctccatcttgccccataaacaccctggggtgggccagagaggagtcttttccaacaggctgtgccagatgactttggctaatcttggaggctggaggattagtcagtctactaagggggcttcagcattttggcacgtggctttatgagctgtttactccaacagtgatgatgacaatagccatagtagtgataatactatggtagaagtaactgcagcaaactcaacccctaacgagtattctatcttcccaacattgtgtgcaatagccatgagagatgggtgttattcttttaatttgacacacgggaactgaaagccagagagattgggtggcttcccccaggccacacagcctggaagtagtaggacagggactcgagcccagatctgctgccccagagcctgtgcccttgaccaccaagtcatggtcactcctttcaaccctgcctgcccctgggccatctgtgttgtgatgccggctggccaggatggggagtgaggatttcagtttgtcatagggcagggagatgggtgaggcaggacactccttgagatggaaggctctggggtcgggggagagggagtggtggagactggggtgtctccgaaggagtgtttgaagatgacggtggtttttccagtttcctgttcttagctatattcaagaaaagggtaagccagaaaatttccctctgagtttcacaacttctgggagcttttgcaaagtctgggtgatgcagcattttcctggtttgaatcctaagtgaagtttcattttccttcacttaactcattctggctctggcctgtcttcccagctgtattggccatctggtcctcttctggctctttgtcccatttattattatttatttttatttttaacagagatggggtctcactgtgttgccgtctgttctggaactcctggacccaagtgatcctcctgcctcggtctcccaaaatactgggattataggcatgagcctctgtggccagcttataccccctaagcttgtgactatcttctatgtgtgtccctcttggagtgaggttccctcctgtctccatgttggcaaatcttagcaccttggcccttcgagatggaggtctgtgttgcctaggctggtcctgaactcctggtctcaagtgatcctcccatcttggccttccagagtgctgggattacaggtgtgagccactgtgtccagccaacccttcttagattttacttacttcaagaagcctgctttgacctctcaagtggaaataacaacttccaggaatagagtgatcactgggcatccatctgttgtcacatgaatgattttatccatattaaggaggcattacatgcagcagtgagctaacctgcctgtgttgaagttttcttctttttacaggctgtacaaccttgggcaagttgctttacttctctgtgccttagtctcttcctcagcaaaatggaaaaaatactacccatttcaaatggggtgaaaatgaaataatatataagtctcgtcttcacaatgtctctgatgaaaagcaggtattggttgcacatggtgctcatgcctgtaatcccagcactttgggaggccgagcagggaggattgcttgaggccaggagcttgagaccagcctggggaacatggccagaccacatctcttaaaaaaaatttagctaggtttggtggcatgcacttgtggttctaactagtttggagcaggtgaggagggaggatctcctgagctcaggaggttgaggctgcagtgagctgtgattgcacacgactgctttccagcctgggcaacagagtgaaaccccatctcaaacaaacaaacaaacaaacaaacaaataaacaaaaaacaggtattgtccttgctgtatgaatgaggaaagtgagttttcctttttgctttgtgaaactcttttctggatatttcttgccttttatgtgtatctctttggtggtactctgtgcttttaaaatcttttgtaatggccatttatggacaaatcgtatcttatattcaagattctaagctttctgagggcaggatataaatgtggttgtttctggttcaagtcctgatacaagcaaagctcagtaatttttttaaatgaatgggtgggccggtggttgggtcttcagagtcactaaatactggtggcaggagtgggaccacatagaaaaaaatattaaggcagtggatctcaatggggagtgatctgcctctcagaggacgttcattgatgtctagagacatttttgttgtcacagtttgggatgggggtgcagttggtgtctgttgggttaggatcaggaatgctataaacatcctgtgatacacgggacagacgtatccagcctaaaacgtcagtagtgttgagggtgagaaaccctgggcttattaaggcaacaagcaacatattaatagcaacaggagaaaacatgcatttaaattttttttggccaggcgtggtggctcacacccgtagtcccagcacttcggggggcccaggtgggcggatcatgaggtcaagacatcgagaccatcctggtgaacatggtgaaaccccatctctactaaaaatacaaaaattagttgggtgtggtggtgtgtgcctgtagtcccagctacttgggaggctgaggcaggaaaatcactttaacctgggaggcggaggttgcagtgagctgagattgcactactgcactccagcctggagacagagcaagactctgtctcaaacaaacaaacaaacaaacaaaaaaaaaacaaaattttttttccacaaatgtgaagtagtctagatgagatacgctcttcctgagatgataaagtgaggtctaagtgtatttattaattcttttgaggagggtgttaggtgctaaaggcagcacgtgtaaggtgaaaattgcgtatagccaaaatgaccctggggcttattctctctctctctctcttttttaataaacagcttttttgttgagatataattcacataccatatgatgcacctataaagtgtgcaactcagtttagtacattcagaattgtgcatgtctcctgtctccaggtaggcaaatcttagcacctcggcccttcttagattttattttttagagatgggggtctcactatgttgcccaggctggtcttgaacttcttggccttcctcccatcttggccttccagagtgactatattcaatattcaaagtgactgtagtcaacattagatatttttatcaccctgcttacttgtttttatttaagacctggtgtggtgtgtgcctggccttgtgatcacaaatgctagttacactgaattgacattttgctgagactcgttctgaggtccattcatagatgccctaggtacttcctgattacttgccacaccccaggaattctgcacagtgagtggggagtgacattttgagggacagcatcagtacattcactgcgctaaagaaacagtctggggagagtgagacatcgaaaaaataacatataaaataaacatctgatggagacataggaagatgccaaccttcaacaatgtttgacttggagcaggggttggcatgctttttctgtgaagggttaggtagtacatattttaggtctctcaggcccaggggcaaatagtctttcttataatatgtatttaaaaattggccaggcatggtggcttctgcctgtaatctcagcactttgagaggccaaggtgggaagattgcttgagcccaggagttcgagaccagcctcagcaacaaagtgagactctgtttgtattagtctgttctcacgctgctataaagaactgcccaacactaggtagtttataagggaaagaggtttaattgactcacaattccacagggctggggagacctcaggaaacttatactcacagcagaaagggaagcaaacatgtcctccttcacatggtggcaggaaggagaagtgctgagcaaaaggggaaaagccgtttatcaaaccatcagatcttgtgagaactcactataatgagaacagcatggaggtaactgcccccatgattgaattgtctctcactgggttcctcccacaacacatggggattatgagaactacaattcaagataagatttgggtggggatacagctgaaccatataattccatggccaaatgatatcgttctgcccctcccaaatctcatgtcctcacatttcaaaacacaatcatgcctttccaagtgtcacccagagtcttagctcattccagcattaacccaaaagtccaattccaaagtctcatctgagacaaggcaagtcccttctgcctattagcctgtaaaactgaaagcaagttagttacttcctagatacaataggagtacaagcattgggtaaatacacccattccaaatgggaaaatttggccaaaatgaaggggctgcaggccccatgcaagtctgaaatccagtggggcagtcatttcttaaagctctgaaatgatctcctttgactccatgtctcacatccaggtcatgcttatgcgagaggtgggctctagctatggccttgggcagctctgcccctgtggctttgcagggtacagcccccatcaaggggctttcacgggtttgtgttgtgagtctgcggcttttccaggtgcacggtgcaagctgtccatggatctaccattctgcagtctggaggatggtggccctcttctcacagctccactaggcagtgtcccaatggggactgtatggggcctctggccccacatttgccttctgcactgccctagcagaggttctccatgagggctccactgctgcagcaaacttctgcctggacacccaggcatttccatgcatcctctgaaatctaggtggaggttcccaaaccttgattcttgacttttgtccacaggctcaataccacatggaatctcctaaggcttttgaggcttgcaccctctgatggcacagcccgagcagcattttggccccttttagccacagttgaagcaactggaacaaagtgtaccaactccctaggcagcacacagcaggggggccctgggcccggcctatggaatcattttttcctcctagacctctaggcctgtgatgggaggggctactgcaaaggtctctgacatgccctggagacattttccccattgtcttggtgattaacatttggttccgttttacttatgcaaatttctgcagcaggcttgaatttttccccagaaaatgggtttttcttttccgtcacatcatcacccttccaatgtttcaaacttttatgctctgcttcctcttaaacactttgttgcttagaaatttcttctgacaatcatctaaatcatctctctcaagttctaagttccacagctctttagggcaaaggcaaaatgctgccactctttttgcttaagcatagcaagagtcaccttggctccatttcccaagaagttcctcatctccatctgagaccacctcagcctggacttcattgtccatatcactatcagcgttttggtccaagtcattcaataagtccctaggaagttccaaactttcttacatcttgctatactcttctgagccctccaaactgttccagcctctgcctgatactcagttccaaagttgcttccacatttttgggtatctttacagtagcaccccactcccagtaccaatttactgtattagtttgttctcacgctgctataaagaactgcccaagactgggtagtttataaagggaagagatttagttggcccacagttctgcagggctggggaggcctcaggaagcttgtaatcatggtagaaggggaagcaaacacgtccttcttcacatggcggcaggaaggagaagtgctgagcaaaagtgcttcttttgctgagaagtgttgagcaaaatcagatcttgtgagaattcactgtcacaagaacagcatggaggtaaccacccccatgattcagttacctcccactgggtttcttccatgacatgtgaggattatgggaactgcagttcaaaatgagatttgggtggggacacagccaagccatatcactgtctctaccaaaaaaaaaaaaaaagccaggtgtggtggctcatgcctgtatcccagctactcatgaggctgagatgggaggattgcttaagtccaggaggttgagactgcagtcagctatgaccacaccactgcactccagtctgggcaacagagtgagacgctgtcaaaaaaaaaaaaaaaaaaaaaggaaatccattcttagcctgtgtgctgtacaaaagcaggcagcaggctgaatttggcccacaggctgtggttcgccaacttatgacctatacaaatggcaattcatatggttcatcctagcgataactgtacatggtgtattagatactatatagcatgttcatatcaaatgtcatataatgtataaggtaacatatacagtataaaatagtgcctgagaaatatttgatgaaaaaatctgataagtacttagcaggcacagtacaaagtaccatgaagttgttaaatgggggatcagggtgtttgagaaaggggtggggagataggtgggcctccctcaagaaggaatgtttcaactgtgagctgaaggatgcccctgcattgcatgtcagggcagtgatggggagaaagactccaggtagagggaacccactctgcaaaggccctgagtcatgaaggggtccctggaacagtgagttggggctgaacccacaagctgcagttgtggggattgtgatccatcctgagagctctgagaacctggaatagttttcagcgcagtgtgaagggactggggctgtgttttgaagatatcccctgtctgcggttgggaggggagtcaggaaacctatttggaggctggggttttcacccaggtcatgcagataagatttattaggtgtggaatgaactgagcaaatcacatgtcttctaatggtacaccacactttttttttttttttttggttttgagacagtcttgctctgtctcccaggctggagagcaatggcatgatcacggctcactgtagccttgacttcccaggttcaagcaatcctcctacctcagcttccggagtagctgggactacaggtgcccactaccatgcctggctaattttggtatttttattggagacggggtttcatcatgttggccaggctcctctctaacttctgacctcaagtgattcgcctgcctcagcctcccaaagtactgggattacaggtacaagccaccgcgcctggcctttagtgatattttaaagactaaattcccttagagatgcctgggtctgcatttattgctactgttctgtttctcactgtgtgtcttgaggtcatcaaaagtaacctgggccttttcccttgttttctgcctcctctaggcttatgagccattaagcaaagccggattggtgtgtgggtcaggctcttcatgttttctttagcttaataagcagtttctaagggaactcattgtgtcattgtttagaatagcaaaagatgagcagcctcccaagtggcaatcagtaggggctgggtgaatacagtgggttccaccccttccgtggtagggtgggatgcttgcagaaggacataagacgaggaagccctttgtgcacagatgtgcggcagcctccaaggtccagtttttaagtgaaaacgtggagatccacttggtatatttggtatgttacctctgtgtaaaaaagcagacaagtaagaattacgtagttgtatttgctgtatttgtaagaaattccagagggataaatgagaaactaaaagaggcaattgcatttgggcagagtaactttttattgtttaccttgatatatactttttttttttttgagatagagtctcgccctgtcaacaggctggagtgcagtggcgtgatcgtggctcactgcatcctccgcttcccagtttcaagcgattctcctgcctcagccttctgagtagctgagattacaggtgtgtgcgccaccaagctcagctaatttttggtatctttagtagagattgggtttcaccacgttggctgggctggtctcgaacccctgacctcgtgatctgcccaccttggcctcccaaagtgctgagattacaggcttgagccaccgcgcccggcctatatatgtattatataaacatatgcacacgcatgcatacgtacacacatatatattttttaaaaattgagtcatggccaggtgcagtgtgggtcacacctgtaatcccagcactttggcaggtgaaggtgggaggattgcctgagctcaggagtttgagaccagcctgggcaacatggagaaaccccttctctacaaaaatcacaaaaattggctgggcgtggtggcatacacctgtggtcccagctgcctggaaggctgaggtgggaggattgcttgagcctggtaggtagaggccgcagtgagccatgatcacgccactgcactccagcctgggtgagagagtgagactctgtcttaaagcaaaaacagagtcatatatttcctattaaggtgaaatttaaaaaataaattcctatattccatcatccccagcttctgccattctaaagcattttcctaagcagctccactgtggatgtagcgggtatttcagaaaggcattagaaatgccctgggagggcagaacccggggcttcactggaggtgctgttgggctcagtctgatgtcaaggcagggacatggcaagggtattgagatgtgaacaagcattactcagcaaggtgacatgtgttcatgccttgatacacttgtttccccaccagctctatttttgttgcctgctctattggtttctttttcttttttttttcttttgagactgagttttgcttttgttgcccaggctggagtgcaatggcaccatctcggctcactgcatcttccgcctcctgggttcaagtgattctcctgccccagcctcctgagtagctgggactacaggtgtgcaccaccatgcccagctaatttttatatttttagtagagacggggtttcttcatgttggtcgggctggtctcgaactcctgacctcaggtgatcctcctgctttgggctcccaaagtgctgggattacaggtgtgagccactgtgcccagtctctattggtttcttattgctggtattgccatcaacttggtgactgagaacaacacacatcactctagttctcgggagtcagaggtccaaaatgtacggctggtgttctttccggaagcttgcagggagaatccatggcctggccctgtccagcatcaagaggccacctgtcttcctcaattcgtggtttcatgtccctccacccctgcttgtgttgtcaaatctcctttactttttttttatttttgagacggaatctcagctcactgtagtctctgcctcccaggttcaagtgattctcctgcctcagcttcctgagtagctgggattacaggtgcatgtcaccatgcctggctaatttttgtatttttagtagagacggggtttcaccatgttggacaggctggtcttgaactcctgaccccgggtgatctacctgcctcagcctcccaaagtggtgggattataggcatgagccaccacgccctgcctcaaatctccttttctgactcagatattcccaccgtcctcttgtcccttataattccctgtgattacattgggcccacctggatcatctaggacaggggtccccaactcctgggccatgaaccagtagcgagcagtctgtggcctgttaggaactgagtcatgcaacaggagctgagtggcgggcaagccagcattaccacctgaattccacctcctgtcagatcagtggctgcattggattctcacaggagcgtgaaccctaacgtgaaccgtgcatgcgagggacctaggctgtgtgctccttatgagaatctaatgcctgatgatctgagggggaacagtttcatcctgaaagccaccccccgccatccctggcaaaactgtcttccatgaaatccatccctggtgccaaaaagcgtggggacctctgatctgggacattctccccattccaaagtccttaatgatacctgcagagtcccttttgccatgaaaggtaagagactcaggttctggggacggggatgtaggcatctttacgggctattctgtgtactgcacctgttcagcttagttccaggcacatagtaggggctcagtacatctttgttgaatgacacaatcaatcatttggttaggctagagaatgtggaaggaggccgggtgcagtggctcacgcctgtaatcctaaggctgaggcaggtggatcacttgagctcaggagtttgagaccagcctggacaatgtggcgaaaccccatctctcctaaaaatagaaaaattacctgggtgtgatagtgtgtgtctgtagtcccagctactcaggaggctgaggcgggaggatcacttgagcccagaaggtggaggtttcagtgagctgagatcatggcactgcagtccagtctgggcaacaaaacgagaccctgtgtcagaaaaagagagaatgtggagggatattatagcaagaagtggatctggaagttttactagtagtggtatttattgagcacctactgtgtgctctggctcatgtttaacaaagtgcttatttgcataatgttagtattcccattttacagatgcggaaactgaggtttagttgctggcctagtattacagggtgaggagctgaagccccatctgcctgacgaggggtgtgttggggatgtggactagaagcttggtcagggagggattctgttcaaacagggctgcttagctttggcactgttgacatttggggccagatatttcccgtcgtgggggctgtcctatgtattgtggccattaagcagtatccctggcctctgtccacagagtgccaatagcactaccctcttcctaagttgtgaaaacccaggatgtttccaaatgttgtcacatgtcccctgagtgacaaacttgcccccacttgagaaccatggtgttgaaacatagatcacggcacatcaactccatgctcctcaggtcaccctgcgtgaaagtcagaatccctgcggtggcctgtgcgtcccgcactgactgtctcctccctgccttcttccttcctcgctgtcttcactgcttgttattcttcagacctgttggcctctctgcggtttctcagaaatgccaggcctggtctgacttcaggacctttgcactggctgttttctctgcttggtgtgcccttcctccagatggccatttggtttactcctctgtttccttccatcctgtatttgtttatttatttttaattgagatggagtctcgctctgtcacccaggctggagtgcagtggtgtgatcgcagatcactgcaacctccaccacccaggttcaagggattctcgtgcctcagcctcctgagtagctgggattacaggcatgcactaccacgctatgttggccaggctggtcttgaactcctggcctcaagtgacccacttgtcttggcctcccaaagtgctgggattataggtgtgagccactgtgcctggctcaatcctgtatttaaatacccgtcctcagcaaggcttgccctcttctctgagtgcttttcatcacacatgtcttcatatcctctcctttctaaaccatctgtctcttctctttaggctgtcagctccaggagggccggcccttggtccctattgttcactgctgggccctcagccctaggaaccgtgctctgtaaatggatgaatgctgtctgtcctgttactgcagtgtccccagacatatccctatgcccagcacatgcctgacccctcacaagaccctggaacatgactaagggatttatttggtgaaacatgagagtctgataagaggagaggaagtggctggggagcaaccttgcaaagatagccagggttggatggagaaaacgagggtgagtgtcagcttcataggacgggccttccacgagaggcctcatggtgcttgggagagttggggtgaaagcaggttggaacaagatgcttgctgctgacatttgggcactgatgggcagcctgacctctgctttctttttagtgcttaacaacactgaagccctgttaagacaggattcttaggactgggcacagtggctcatccagcactttgggagccctgggtgggaggatcatttgagccccaggagtttgaggccagacagggcaacatagcaaggccccatctctggaaagaaatacaaaaattaaccaggcttggtggtgtgcacctctagtcccagctacttgagaggctgaggtgggaggatcacttgagcctgggagttcaaagctgtaatgagctataatcatgacattacactccagccgaggagacagagcaagactctgtctcaaaaaaaaaaaaaaaaaaaaaaaattagttttgcatgtaactgtgttcagttctgtgtcttggacgtgaggatttgtggtacccgcctggatagagcaaggatggccgtgcccctgccttcctgggtgatggggataagtctggaaattgcccctgtgatgttactgggctttattcttagctctgctgagttagggggcagggtggggtgcagcccagccaacagcatgccagggcgcgtcactgcccacgcgatgctggcttcagccgccttcctctcacctcatggccctgccagccgtgcttgcctcctgctgtgtcggggctgggagactttagcctttctccagatgttttcaggagtgcggtggggaaatgaaggccacatgctgtctctctaaacaggattaatgttcagaagcccagcgggtgccctgacctaaccacgggcctcttgcactccttttctcagcttcccttggcttctgagctacccctctgcagcgttgtttctgagtgtggcatttaggagcaccctgtcgtcttgcctttcgtccctccaagccccgtctgttccttggttggttgtgcagaagagttgctagggtttgaatccaggacggtcctgcccctgtgactcgcgggccatcttctcacctgtttgtctctgtgttcctctctgtaaaagtgggaatcattacagtaccttcctcatagactgctagggtgataaaatggagcgatgtacatgaaacctgaacgcagtgcctggtatgcagtccgtgcttagacagggctctggttttatttttatttctttttctttgagacttggtctcactctgtcacccaggctggagttcattagcataatcacgtctcactgcagcttcccactcctgggctcaagcgatcttaccacctcagcctcccaagtaggtgggattacaggtgtgagccactgtgcctggcaccattcagcaatttttttttgttttgtttttgagacagagcctggctctgtcacccaggctggagtacagtggtgcgatctcagctcactgcagtctctgtctttcaggttcaagtgattctcctgcctcagcctcccaagcagctgggattacaggcgtctgccaccacacccagctaatttttagtagagacagggtttcaccatagtggccaggctggtcttgaactcctgacttcaagtgatccaccctcctcggcctcccaaagtgctgggattacaggcatgagccatcacacccggccatcagcaaatttttaagtatacaatatagtattgtgagctatagacactattctgtacagtagaccgtaggactgactgactcatcttgtatgaccaaaactttatacgctttgaccaacacctccctgtttcccccaccaccagctccttgcaactaccattctgttctctgcttctatgagtttgtcttttttagatgtcacatgtgagtgagatcttgcagtgttcgtcttcctgtgcctggcttatttcatttagcataatgttctccaggcgcatccatgttgttgcaaatggcaggatttctttccttttttttttagacagagtcttgctctgtctcccaggctggagtgcagtggcacgatctcggctcactgcaagctccgcctcctgggttcacgccatcctcctgcctcagcctcccgagtagctggaaccacaggtgcctgccgccacgcccggctaattttttttttttttttttttgcatttttagtagagatggggtttcaccgtgttagccaggttggtctcgacctcctgaccttgtgatccgcctgccttgacctcccaaagcggtgggattacaggtgtgagcgactgcgcccggccaggatttctttcctttttaaggctgagcgatagtccatggcatgtatagatcatgttttctttgtccacttgaccacggatagacatttagttgtctccatcttggttgctgtgagtgacgctccagtgaacacgggagtgcagatatctcttcagggcccatgtgtggctgagattaggagatcactgctgtcgtctctagttcagcagtgctagtgcctcctggcgtttagcgtccagctcaagggagtggaatttgggtgtctcagggtctagggccacctgtgcctctaaatcgcagggaagctttgtgtgtgtgtgtggtggggtgcggggggctatgggtatgtggtggggtgaatcttatttctcttctttcccttttcttaattttccgttggcaaaacagagcgccactccagacccctttcattcttgcaatatacatgaaaagtacagggcttgttctgcaaaagaagagtagccccagcgagctcagggttgagtgaagttccgcaaggatggcacctctcggctcttctgggggcttcaggacagagctcagtgtcgccaagcaggacccccactgcgggcggagctgcagggccatcaacattcattaggtggatcagtgaatgtagactctgcggtgtcacaaagcagcacctgtactcactgtgcctgtctcgggatggaatctaagtcagacatccttgcatccccacttatgggctgttccttcaccttgctggtcctcacctttctcctagagttacggggaggagtaaatgtgctaaggccatacacgccgactctgcagtggccttgaaccatgcttctctgtcacccctttcgttgccttgacaatggctgcagcctcctttcccatctcccctaggatcttctcctagggtctcttaatacaggggtccccaatccccagagcacggactggcaccagttcatgcatgccctgttaggaaccaggccacaggccacacagcaggaggtgagtggcaggcgagcgtgtgagacttcatctgtatttacagccgctccccatcttttgcatcaccgcctgagctctgcctcctgtcagatcacctgtggcattagattctcataggagcgcgaaccctgctgtgaaccgtgtgcgcgagggatccaggctgtgtgcttcttttgagaatgcaatgcctgatgatctatcactgtctcccatcacagctgagatgggaccatctagttgcaggaaaacaaactcagggctcccaccgattctacataatggtgagttgtataattatttcattatatatgacaatgtaatcatagaaataaagtgcacaataaatgtaatgcactcgaatcatcccctaccctgtctgtgaaaaatcgtcttccacaaaacctatccttgctgccaaaaaggggatggctgtctttttttcttttgagatggattcttgctctgttgcccaggctggagtgcagtggcacaatctcggctcactgcagcctctgcctcccaggttccagcgattctcctgcctcagcctcctgggtagctgggattataggcacaatggcaccgtgcctggctaatttttgtatttttagtagagacggggttttaccatgttggccaggctgctctcaaactcctaaccttgggtgatcctcccgcctcggcctcccaaagtgctgggattacaggcgtgagccactgtgcctggccagggaccactgtcttaatatgtgaattaggcgatgccatgaccctgcttaatgcactcccagggcctcctgtgagaattagaacaaaaaatccatgctctgtaccatgcctccaagattggctatgtggtggcctttggtgacttctcccgcccaatcttgggtcctagctcattggtgcagccatatcctccccccaccccaccccactgtggcctttgcctgtgccatctttctgcctggtatgtgcttcccgagatctttgcacagccagctcttcctgacccttccagtctgctaggatgtcatctgcccagaccgccactctggtgcttcctgtcctgacacccctgctctttccttcacagcaggtactgctctttgtcattatgttcttatctgtgagctttcatctttgatggactatgagtcttaagaggacagagatatcgtttctgattttcccccatgcctgtgactagcccaggtctaggcatatagtaggtgctcaataaacagtcatcgaatgatagattgaatgaatgaatgcatgacaggaaccctgcacttatctgtgttaatccgtctcttggctgccgggaacaccagctcctgcaacctggcacttgggtcacctgattgaaccctcctgataactctctaaactctgtaataggtgggttctagaattagtcccatttcacagatgaagaaatcaaggcctggtgaggtgaactgacttgctttagggcagcagggatgatttttgcctctctggagatatttggcaatgtctagagacagttttgattgtcataacttgaggaggtggggagtgctactatcatctagtggcagaggccagcgacgccactcagtatcttacaatgcacaggatggcccccgacaaccaagaattatttgggctcaaataccagcggttctgaggttgaagaagccctgcttgagggcacacatctgtaagtggtggagacgggaacctagacctggaaccttgttttgttaaccactaccctgcactgctcacatgcgggggtgggtgggtgggaagagttgtagaatgtttccatgtctgagtcaaaatcttgcttctctgctctagggagatgaatttggaatctgtgaggcctgaggccattcacttgatctccggccctggagatcttgcctccaagcgacctcaggctccatctgtctgccatgtaccttgcaaacaccttagaattctggctgggcatggtggctcacacctctaatcccggcactctgggaggccgaggcgggcagactgagttcaagaccagcctgggcaacatggtaaaaccctgaatctacaaaagatacaaaaattagccaggcatggtgatgcgtgccaggtagtcccagctacttgggaggctgaggcaggaggattgctggagcccaggagatcgaggctgcagtgagctgtgatggtgccagtgtactcaagcctgggcaacagagtgagaccctgtctcaaaaaacaaaaccagctgaccaaacaaaccaaaaggccttagagttcaagcacgtggtttagaggtggtggatctcagtgtcagactctcagtgggttcaaatcctggccctgtttcttctaggttgacgagcccaagcaatttacataaactctctggacctcagagcccttgccaggaaaggggagagttttaatagtcctgactttgtagggctgttggaaagcttaaatggactgtgcttgggaagcacttaatcactgtgcctggcgtgatcactctggctgttattattggcacccaataaatacatgctttctctttgtttccaactcagcatttagaaatgtcctacccttcaattcctgctgctatttatttatttgaagtgcgaactagctttcttattattattttagaaatcatgcagaggagaaaattcaaacagtacgaaagataatacaacaaaaaatagtagttgccttcctctccctggtttcaggcctaccccctgcagattaattagctttttttctttctttttttcttttcttttttttgcaatatgaagtcttgctctgttgcccaggctggagtgcagtggtgtgattttgactcactgcaacctccgcctcctgggttcaagcaattctcctgcctcagcctccctagtagctgggattagggcagatcatgaggtcagaaatgtgacaacagcctggccaacatggtgaaactccatctgtactaaaaatgcaaaaattagccaggcgtggtagcaggcgtctgtaatcccaggtacttgcgaggctgaggcaggagaattgcttgaactcgggaggtggaggttgcagtgagccgagaccacaccattgcactccagcctgggcaacaagagcgaaactccgtctcaaaaaacaaacgaaacatcaaattcctgactgtgtatgctgcttgcaggttatatatgaccaggcctggttctgtatctgtaaaatgggttacgttatagtacctgagtcctagagttgtgtgtgaggatgaaatgtaatgtgaaacacttagagtggtgcttggctgatgcaactaatgaatcttccctcttactctttctatagacagaagaaggcggcacaggtttcttcattgcttttcgccctttgctgaaatgtcatcttggcccagaggccctttctgtctacctgataaagaactagcacctgcccacccaccattatgcttcacccactttcttcttcttcaagccatttgctcccattgggcatacatagagttgttttttttagctgttggtagttttggccgctttgcataaagtgaaattgtgtgagagtggagactttattttacttccacatgaccttggcccatggtagtagtcgctgataaatgtccactgagcaataagaacccgactgttgcaagttacttatttatttatttttgagacagggtctcagtctttcacctaggctggagttcggtggtgcagtcatagctcactgcagcctcgaactcctgggctcaagggatcctccttcgtcagcctctggagtagctgggactaaaggcaaacgtcatcacatctggctacttttaaatttttttatttgtagaaggtggggagtctcactccattgccacctctggtctcgaactcctgggctcaagtgatcctcctgcctcggtcccccaaagtgttgggattacaggtgtgtaccaccacgcccagctaagtttttttttttttttttttttttttgagatgcagtctcactcttttgtccaggctggagtgcagtggcctgatctcggctcaccacaacctccacctcctgggttcaagcgattctcctgtctcagtctcctgagtagctgggactacaggcgcacgccaccatgcccggctaatttttgtacatttagtagagagagggtttcactatgttggccaggctggtctcgaactcctgacctcatgatccgcccgcctcagcctcccaaagtgctgggattacaggcgtgaacccctccacccggccagctaagtttttaaatttttttgtagagatacagtctcactgtgttgcccaagctgatctgaaattcctggcctcaaactatcctcctgcctctgcctcttcaagtgctgggaaatataggcatgagccactgcacccagctggttgtgagttattgagatggttgaattgggagtggatgctcaggcctcagtggaacttgtggtacacagtatgtcctcattacctcccatcagtggcagttgagattcataatcactttttctgcctgttgtctgccccatcctctctgtggccttccctcctgtcctggagttggctggctgggtccctggcagggctgcatgcgttatccctgcaggcctgcttgccttatccctgcaggccctggtggagcatctgtgcagaacctgtgccatccagatgggagcagtaagggtgtagggcaaagttagtgagctgcccggtgcacgaggacttccatgataatcagggctgaaccaggaaggcaggtcaaggccagggtcatgtacagaaaggaggtcagcaccaggatcttgtatgggaagacttagatcaatgcctagtgccttagtcatcatcattcagcccagaaaacatgacgctatgcaacaggaattttatgaacacacaaaggtcaggggccactcggacttggacggggtccccaactctttgagtgtcagggctgagggcatggagacacaacttgatcaagctggtgaagtgtccagcaaggagaagcctctgttggagggagccgggagctggggaggacatgcgctttctcttttttttttttttttgagacggagtctcgctctatcgcccaggctggagtgcagtggtgcaatctcggctcactgcaacctctgcctcctgggttcaagcgattctcctgtctcagcctctcacgtagccgggactcaggcctgtgccaccacgcctggtgaatttttttgtatttttagtagagacggggtttcaccatgttagccaggatggtcttgatctcctgacctcgtgatccacctgccttggcctctgaaagtgctaggattataggcgtgagccaccgcgcccagccgacttgcgctttctctgtaaagatttctgtgggccaggttccccaaagggcaggccctgggccagtgcagtgaccggtgaccgtgttcaggactcatctcttgtggctgaattgtgtgtctggagagttgggtccttctgattctgctcagagcgtggtgggcctggctggatttccctagattaggaagcagcctcgggtagctgtgattctttgagttgggaacagcaagtggcctgcagactgccagggaatcgtcccttccttgagcctttaggtattgcccattattcaccgtttttcccagaagcctccagtagtgagagtcgcacttcttacctcctggagttgttaaagtaaagaaggacacattagggtccctgccggtaaggaacatccaggaggcctcgataccttttttttttttttttttttttccctgagacagagtctcgctctgtcacccaggctggaggacaatgacctgatctctgctcactgcaacctccacctcctgggtttaagcgattcttgtgcctcagctgcccgactagctgggattacaggcatttgccaccatggctggctaatgtattttttttttctttttcagtagagatggggtttcactatgttggccaggctggtcttgaactcctggcctcaagtgatctgccctcctcagcctcccaaagtgctgggatttcaggtgtgacccactgcgcccagtcccgatactttgtttctttgagacagtctcttactctgtcacccaggctggagtgcctgggtgggacgatcaaagctcactgcagcctcaagcccctaggctcaaaagatcctcccacttcagccttctgagtaggtgggactacaggcctgcactaccacgcctggataatttttaaatttttttggtgaagacagggtcttactttgttgcccaggcttttcttgaactcctgagctcaagcaatcctcccgcctcagcctcccaaagtgctgggtttacaggcgtgagccactgtgcccggtcctcagatgatcttagctttgtgacctatgctgttggccgctgtaggggctgtgatggaggtgatgtgggggtggatggcaggggtgacccgtgttggctgctttctgtaacagtcatagttcatggtcagagtcagatttcctctcgtcatgccttccttcccttccttctgctccctcccacagccgccctttgggtctgggctggccatctggctctgagcaggaagctagcctgtgctcttcaatttgctttctgcaggggaaacaccttcctttgctcagcgtttcctgacctctccttccctggagttccggtgtccttaaatgctctctggtttcttctgtagcttactttcttgcttgaaaggacaacttttctttgtcctttagacttcttatctctgggcaatacagtggtggtggcagtggtgattattatcaactattagtatctgctactacggtttattgtctctagactgtatcagcacctgtcacacattgtcccattgaatcctctccagaactcttccaaatgatgtgttttcctgacttttaaaaaaattaaaaaaaaatttttatatttttttgagacggagtctcgctctgtctcccaggctggagtgcagtgctgcgatctcggctcactgcaagctctgccttctgggttcatgccattctcctgcctcaacctcctgagtagctgggactacaggtgcccgccaccacacctggctaatttgttttttaatatttttagtagagacagggtttcaccgtgttagccaggatggtctccatctcctaacctcatgattctcccaccttggcctcccgaagtgctgggtttacaggcgtgagccactgtgcccagccaaaaaaatttttttaaagaaatggggtctcgctgggtgcgatggctcacgcctgtagtcccagcactttgggaggctgaggtgggcggatcacctgaggttgggagttccaggacagcctgaccaacatggagaaaccccatctctactaaaaatacgagattagccaggcgtggtggcaggcgcctatagtcccagctactcgggaagctgaggcaggagactcgtttgaacccgggaggcagagattgcggtgagctgaaatctctccattgcactccagcctgggcaacaagagtgaaactccgtctcaaaagaaaaaaaaaatagaaaaagaaaaataaaagaaatggggtctcactgtgttgcccaggctggtctagaattcctgggctccagctgtcctcccatttcggtctcccaaattgctgggattaaatgtgtgagcctctgtgcccggcctctttctctctctctctctctctctctctctctctctctctctcctctctctctctctctctctctctgtctctttctttctttctttctttctttctttctttctttcagcctgagtctcgctttgtcgccaggctggagtgcagtggcacgatctgggctcactgcaacctctgcttcccaggttcaagtgattcttctgcctcagcctcccgagtagctgggactacaggtgcatgccaccatgcctggctaatttttgtatttttagtacagacggagtttcaccatattagccaggatggtcttgaactcctgatctcatgatctgcccgcctcggtctcccaaagtgttgggattacaggcgtgagccaccgctcctggccttccttttttttgaagcaggttctcactctgttgcccaggttggagtgcaatggtgtgattatgtctcactgcagtgtctaccttccaaggctcaggtgatctcctgcttcagcccactgagtagctgggattataggcgagttcaccatgcctggctaatttttgtgtttctagtagagacgggtttcaccatgttgtccaggctggttttgaactcctgggctcaagtgatccacccgtgtcggcctcccaaagtgccgggattacaggcatgagccaccgtgtccagcttttctgactctttttacttatcaggagactgaagcttggagaaattaagtgacttgcccaagttcacatggggttaaggcctgaatttgaatctacatctgctcaattaggaagtgagtggtcatagctagtctctacctggatggattgttgtttaattgttaaattttttcaaaataattttaaattattttattaaaaaagagggtatcattatgtttcccaggctggtcttgaactcctgggctcaagtgatcctcctgccttggcctcccaaaatgctgaggttacaagtgcaaactactgtgcctagccagattattacttaacaaccaaaacaaaggaggaaattgacggtggacaagtaagaagatcattgcaaaggttgggggcaggttgtttggggagtgtggaggaagctttttaaatgaggtacctgagttggattttgaaggatgaataggagtttgttaggacagaaagacattgcagagagaggatctagcaagaggtgactgaagaaaccatttatttgaccagcagttggggaatgccttgaaggcaggaaccacagcctttcagaatctccagtgcctgcaacagtgtctagaacattatctgacaacaagcttggtaaatacttctttaagtaaatgcctgagtaaggcacatttggggaacagggtgggagaaattgtaggagaagtagatgggacttgaatgtagaaggaaggcctcatggatcactgcaagggttggttatttttttttattttttatgttttgagatggagtctcgctttgtcgcccaggctggagtgcagtggcgcgatctcggctcactgcaagctctgcctcccgggtgcacgccattctcctgcctcagcctctccaagtagctgggactacaggcgcccgccaccacgcccggctaattttttgtatttttagtagagacggggtttcactgtggtctcgatctgctgacctcgtgatccacccacctcggcctcccaaagtgctgggattacaagcgtgagccaccgcgcccagccagggttggttcttaaaagccaatagggagccatgggaagttgtttcccagcagaagagagaaggccattagatctgccctatttattaatgcaaatatctaagtctatgaatcttcctctgagcaggaaaacgtgattgcttttaaatccatatggaaagaccctcagttttactcatgataaagagaaaaggaacttaaactacacagagatatttttcacttcagattggcagaggtcggaaacttgttatctgctgtgctttgtgaagtaattgcctttgtaccttatcagctggagtatgaattgatgttccctatttggagggcagtgtctgtctaaatgttactgtaggcaccctttgacctggcaggttccttttttgaaagtttatatatatgtgagacagagtctcattatgttgcccagggtggtttcaaactcctgggctcatgggatcctcccacctgggcctcccaaaatgctggagttacagatgggagccaccacacctggcagagaaagtgatcttatcaacactcttgcttgagtgtgaaattcaattgtttattcaatgctgcattgtttgtaagaggaacaccaatgccaagtccccaggagaccgatggaagtcaagttcatccctacaatagaatacaaagcagccgtaacaaagagtgaggaaactgttcatgtatactgcgggatgatctttaaaatctgtggttaagagaaaaaagcaaagtacggaacattatgtaacgtatgcttccttcgatttgataacagaagatgtatatttactttatttttgtataaaatattttctgaaagaagacataagcaacccatgatcattgcctctagagagaggaactgaggggagggccatagggaatggaatgagaagacttgtcccttgtacctctttgttcaaaagaaatatcaagaataaaacacatctatgttactgataaagatagtttccaaaggctgtgtgcggtggttcacacctgtgatcccagcactttgggtggccaaggcgagtggatcgcttgagctcaggactttgagaccagcctgagcaacatggcaaaaccccatttctactaaaaatacaaaattagctgggcatggtggtgtgtgcctgtggtcctagctgctcaggaggctgaggtgggaggattgctggagcctgagaggttgaggctgcagtgagctatgattgcaccactgcattccagcctgggcaacagagtgagaccttgtctcaaaaaaaaaaaaaaaagttcagtttttaatattagctaagtaaaaaaaagcaaggtatagaatggagtatcgtagtgccttttgtggcaacaaaataggtcgtatttggaatatatctggaagaatgtaagatgttagcaatggtagcttgcctgtagggtagcaatggggggctgttaatttggggagaaagacatatttttcactgtatacctttttgagtaatttgaaagagttttagcacacaaatatattacctattaaaaataattacaaagagagggagacatgggtggatgcatggatggatagttggttgggtagatggatacatagacaggtggatggattggttggtggatggatggatgaactgttgggtgggtagatggattgatgggtgaatgaattggtaggtgggtagggtggatggatgaattggtggatgggtaggtggatggatgaatgaactggtgggttgctggatgggtggatgaattggtaggtgggtggatggatggattgatgggtgaatgaattggtaggtgggtagggtggatggatgaattggtggatgggtaggtggatggatgaatgaactggtgggttgctggatgggtggatgaattggtaggtgggtggatggatggatggatgggtgaatgaattggtaggtgggtagggtggatgggtgaattagtggatgggtaggtgcatggatgaatgaattggtgggttggtggatgggtggatgaattggtaggtgggtggatggatggatggatgggtgaatgaattggtaggtgggtagggtggatgggtgaattggtggatgggtaggtggatgtataaatgaattggtgggtgggtggatggatggatgaactggtgggtgggtggatggatggatggatgggtgaatgaattggtaggtgggtagggtggatgggtgaattggtggatgggtaggtggatgtataaatgaattggtgggtgggtggatggatggatgaactggtgggtgggtggatggatggatgggtgaatgaattggtaggtgggtagggtggatgggtgaattggtgaatgggtaggtggatggatgaatgaattggtgggtgggtggatgggtggatgaattggtaggtgggtagctgaatggatgaattggttggggggggtggatggatgaattggtgagtgggtagttgggtggatggatgcattggtgggtgggtggatggatgaattggtggatggatggatggatgggttcatggttgggtgataaatatatccatgggtatacatatggatgtgtacatagataattctctggctatgatagggaggactggctgtggtggggaacactgactgtggtggggagcactggctgtagcggggaggactcagtaggacaaggagaggctggaggcagtgaagacttaggaagcagttgcatagtcctggcaaggaataatttggggctaggatcaggtcaattaaatgtttaacattggaactatgtctcttgtatacataactgcatatgtcaagtcttggtatcgttttctttctagcagggcacattcctttggaatgagcttttactggcaactgctcagaagctgttctgtatataatgaccaccaacagtttaatccttttttcagccatcacctcaggaattaacagtagtatgaaatcaattaaaataatcagtctttgagatgtcatgccttctccacgatcaacttcttctttacaaggctgtgttccaaatacgccaggccaaaaagacgtgaactttgtcctttttagggtttgtgtcttgatgtttcctggctaaatctctttgtatgtgttggccttgtaaggtttactttttttttttttttttttgagatggagactgtgttgcccaggctggagtgcagtggtgcagtctcagctcactgcaacctttgcctcccgggttcaggtgattctcctgcctgagcctccctactagctgggattacagacgtgcactaccctgcccggctaatttttatgtttttagtaaaatataaaaattatgtttttatggggggttcttgccatgttggccgggcttgtctcagactcctgactgcctgcctaggcctcccaaagtgctgggattacaggcatgagccaccgcgcccaacctaataactagatctctttaattattggaacatgtatattttgatcagattgacacttttttttttaagtgaagtgatcttatttccctcatttctcatttttaacttttttttttttttgatatggctttaaagctctgtggagctgtaagggtctgggttccttgacactccatgggggtctcaggtgatcgtgggagggctgttggaatcagagctatttggagggtgcataggccagtaggatgggaaggctgtgggagaagtgggctttttggggaccgcagccaaatggacaactgggcctaatctaaagattggcccctcccagctcctactgatggtcatgtaacaggaatggggcccagcaccaccagattttctgatttttttttttttttttgagacacagtcttgctctgttgccaggctggagtgcagtggcatgatattggctcactgcaacctccgcctcctgggttcaagtgattcccctgcctcagcctcccaagtagctgagactacaggcatgcgccaccatgcctggctagttttttgtactttagtagagatgaggttttaccatgttggccaggatggtcttgatctcctgacctcgtgatcctcctgcctcggcctcccaaagtgctgggatgacaggcgtgagccactgcgcccagaagattttctgatttttaaagttatgccagagaccgggcgtggtggctcacgcctgtcattccaacactttgggagactgaggttggcagatcacctgaggtttaggacttcgagactagactggccaatatggtaaaaccttgtctttactaaaaattcaaaaaaaattagccaagcggggtgaccgcagtcccagctatttaggaggttgaggcaggagaatcacttgaacccgggaagcagagattgcagtgagccgagatcgcttgaacccgagaagcagagattgcagtgagctgagatcatgccactgcattccagtctgggtgacaaagcaagactctgtcaagaaaaaaaaaaataaaaataaaaagccggaaatcaaattttaaatgttgggatctaatctaatttttttaaaaacaaaaagtatgcctaaaacaacagcaataacaacaagccatctatgggccaaactgtgggtggggaaacctattttgtacttcttattttatccgattgaattgtggtggagataggaaattgagaccccaaaaagggtagtaagttttcccaaagttatttagtcagttgccagattatggcttgaattaaatttaaattcttcagctgggcatggtggtgcacacctgtagtatagctgcttgggaggcagaggtgggaggactgcttgagcccaaaagttcaaggcacaggaagctgtgatcttaccaccacacttcagcctgggcaacagagcaagacctcatttcaaaaaaagaaaaaaaaaagaaaaatttaaattcttcattacagaacagctgatggtggaggtttattcttgggcaggtacatctgatctatttatgtatgtatctatgaatttgtctatttggcatggctctttagcaaaatacaggctttttttttttaagtaaaagtaattgaaacaaaatttgtttccaaggctggacagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggtacttagaataaagcctggcatacagaactgcagtttggttgttatccgtggtggtggcggtggcggtggcggtggcggtggcggtgatggtggtggtgatggtggcgatggtgatgatgatggtggtgatggtggtgatggtgttggcagtgatattggtggtggtgatggtcatagtggggaaggtgatgatgatgaatgaagatgattagaaagtcctcagttcacaaggtcagagtgatctagatgacacagggctcttcggttataagagaatatccttcagggttcctttaaatggctctctccatctttcgtactacagtgggacttgccacaggttctggggactgttaatgtgagatgagatgctacatacctttttgttgttggtgggtttttttgtgtgtatgcactgttgtgtgtgtgtgtgtgtgtgtgtgtgtgtgagagacagggtctcgctctgttgcccagggtgtagtacagtggcatgatctcagctcgttgcaacttccgccttccaggctcaggcactcctcccacttcagccgcctgagtggctgggaatacaggcacgctccatgctcagccactttttgtgtttttcatagaggcagcatctcactatcttgcctaggctggtctcgaactcccagcctaaagtggtctgcccacttggcctcccaaagtgctgggattacaggcatgagccactgcacctgacctgtatgctcctgttaagagagctttatttttatttatttattttgagacagggtctctgttgctcaggtgggagtgcagaagacaccacatacctttatcccttgttcctcatttcttagtctttctggctactgatctttttagtttgcgtgttcatcctgaaaggtccttggatatataggagccttgtctgtttcttcaaaccccgtggcagctggtttcatgctccaggcgagctcctgtcctctggggtgtgtcctgctgacccctcgcctgtgtttgtgttcgcaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgtaagtcactggggggtttcgttgtggggggtgggaaggtgcacctggacggggagtggtggttggtgataactgacatttctcttctacttagttgaccctaagttccttcttctagaaggcagaagaataatgtgggaggtgaaaactggagctctggagacaaacatgggtacaaatctttgctctgccgcttagtatttggcctcgagcaaattttttaacctccccaagcctcagtttccctgtttatgcaataggaatgataggcttgttctcaaggcattcctgggagattatcagctcttcccctcttactgagccgatctcctttttatttaattaaatatatttatatagattttttctggccaatttttaatttattttttgtagagaggggggacttgctgtgttgcccgggctggtcttgaacacctggcctcaagcagtcctcctgccttggtctcccaaagtactgggatgctcagtgtgaaccaccacgcctggcccctaattttttttttaagttggcttttattttgaaataatttaaagctacaggaaaattgcaataatgggccaggcgtggtggctcacgcctgtaatcccagcactttgggaggccaaggcgggcaggtcaggagtttgagaccagcctgaccaacatggtgaacctgtctctactaaaaatacaaaaatgagctgggtgtggtggcatgtgcctgtaatcttagcaacttgggaggctgaggtgggaggatcccttgaacccaggaggcagaggttgcagtgaactgagatagtgccactgcactctagcctgtgcaacagagcgagactccttctcaaaaaaaaaaaaaaaaaaaaaaagttgcgatgataccaggaactgctgcctgattttctctatccatcactcatagtcactgtttcctgttttttttttttttgttgttgttttttgtttttttttgacacaaggtgttgctcttttgcccaggctggagtgcaatggtatgatcacagcatactgcaaccttgaactcctggctcaagccatcctcctgcctcagctttttgagtagctggtagctgggactgcaggcatacaccaccatgcctggctaatttaaaacaattttttgtagagacagggtctcgccttgttgcccaggctgttgtcaaactcctggcttccagtgatcctcctgcctcggcctcccaaagtgctggtattacaggcatgaatctggcctgtattcactgattttttaatcttttgctacatttgttttatcatgagcttttgttctctctctctgtatgcatgctataatttattttttctgaatcatttgagaatggatgcaccttgaaacatatcccacccgtagagggctctcagtaaatactggttgaatgaatggttgtcgtggagggctttcttgtgcagtgcgccggagttgcagctagagatgagctgtgagctgagctcttgagtgttcaggcaccggggagcatggtgaccagacaaacagtcctgttggaggtagtggggcgtagcaggctgattacagaccatcacgtgccggcctggatgccagctcaccataccgaggacttgtccttattccagtggatatgtgccatgtcctaggactgtggctgatcatttgaaggctggctggttctcctatccctggggctgagctgttcgtgcaggccctgggggaggttccagggcggtctgttgtaggatatgtatgtgcttctcttccaggccttgggatttttgctgtggatcgtctgctgggcagacctcttctactctttctgggaaagaagtcggggcatattcctggccccagtgtttctggtcagcccaactctcttgggcatcaccatggtaagtaggagctggctgtgacccctgggccatctgctgggctcagtggagaccaaaagtaataactcgtaagactagaatcatagttttttaaggcaatgatcagctggagctgggatataaattaaatgtagcctttttttttttttttttttttttaaagacatgagatctcgctttcatccaggctggagtgctatggtaccatcatagttcactgcagcctcaaacttctggcctcaagcaatcctcctacctcagacttctgagtagttgggactacaggtgtgtgtcaccacgcccagcttatttttggctaattttaaatttttctgtagaaatgggatctcactgtgttgtctaggctggtcttagactcctggcctcaagtgatccttccagagcactggcattataagcatgagccactgttcccagccccagctgcagtctttggatggggcatgtgttgtccagtttgccacagtccccaccatgccctattgtcttccctgccactgattgagtggcagatgcccccttttgttgcgtttgccacactttgctcttgcattggctactttggtcacttatatactaactgcctggggtctaatggccttgagttttcactatctggcatagggggtgggttgctaagctaaataggaaactgctctgtcccgggggatacacaacttagtgagtgacagagacaaggaaacaactttattaattacagctggtgtgtattgagcacttactatgtatgtacctggcagtattcttggtgtttcacgtgtcttgaaattcattgaattttcacaacaaccctgtgagatgggtcctgctttgttcccatcttacaggtgaggaaaccaggcaagagaggttaagtgtcctgctcaagatcacaccactaatgtgcagccgagtcaggggtgggaccccagatgccatgcttttagcccctgcaacctgcagcttctgagccctgaacagagagttctcggagagtgtagcccttgagtattgtaaaaagaggagggaggctgggcatcgtggctcatgcctgtaatcccagcactttgggaggctgaggcgggagaatcacttgaggtcgggaatttgagaccagtatagccaacatggcaaaaccccgtctctactaaaaataaaaaaattagccggcgtggtggcacacgcctgtagtcctagctactcaagaggctgaggcaggagaattgcttgaacccgggaagtggaggctgcagtaagccgagatcgcaccactgtgctccagtctgggggacagagcgagacctcatctcaaaaaagaaaaagaaaaaaaaaaggagagaacaagtttaaggcaggacattctgagcagggtgaacagtgtgtccagggaggggtggaaggttaaggggaggatgcaggcagggaggacaaggtgttcggtgaaggaacacggtgtgaaggttggggggatagagtggatgtgacagaggggtcaggaaagacaacgtggagccaggttgccaaggaccatgaatctttatttttctaaattaatttttcattttttaaattttagagtcagagtcatactctgttgcccaggctggacttcactggcgtgagatcacagctcactgcaggcttgaactcctgggctcaaatgatccttctgcctcagcctcccaagtagctgggagtgtaggcatgcaccaacatgcccatctacatttattttttatttatttatttttttatttttccccccgagatggagtttcgctttgttgcccaggctgaaatgtaatggtgtgatcttgagttgccgcaacctctgcctcctggattcaagcgattctcctgcctcagcctcccgagaggctgggattacaggcatgcgccaccacgcccggctgattttgtatttttagtagagatgggatttcaccatgttggccaggctggtctcgaactccggacctcaggtgatccacccacctaggccccccaaagtgctgggattacaggcatgagccaccacccccggccagtttgttatttttgtagagacagggtctccctatgttgcccaggctggcctcaaactccttgtctcaagtgatcctcctgtctgggcctcctaaagtgctaggattataggtgtgagccaccatgccctgcccagaccatgattctatatagcacacatatgtgctgtccactctctgccaagaactgtcctaatccctttattaacccttttacgttgtaaataaggtaagcaaagtgtggtacagagaggagaaggactggcccaaggtcacctggtcagtaagtggtagagccagcttccagtctaggccccagcgtgtagcctggcacctgctttacgcctggctctcctgctgggtttgattcccctttgtgtcctcagagcctggccctgtgcctggcatgcagtaagcgttccataaatgcatggagggaatgagagagtaaagggctttgctttgtcctgaattcgggtcttgggctctgtgttctggcagtggggtattagagtggatttttttttttttttttcaatttcactataatagagacagggtctttccatgttgcccaggctagtcttaaactcccgagcccaagtgatccctctgccttggcctcctaaagtggtgggattacaggcatgagccaccatacgtggtcagctgtttttgacttgagtaggtcatcctcccttaacattccttgttcctggtcttttttttttttcctttgaggcagagtttcgctcttttttcccaggcgcaatggcatgatcttggctcactgcaacctctgcctcccgggttcaagtgattctcctgcctcagcttccccaataactgggattacaggcacgcgccaccacacctggctaatttttgtatttttagtagagatggggtttcaccatgttggccaggctggtctcaaactcctggcctcaggtgatccacgtgccttggcctcccaaagtgctggtattacaggcgtgagcaactgtgcctggccgttcctggtcttttgatcgttcatttatgcctctgtcaccctgggggaaacaggggtgatagtctgagggttggggcttttgactcctcaggggactctgagctgggctggccaagaggtgaactggcctgtgagatcctcagcctctctttatctacctgagatctctgggatggaatggaggaccaccagctcagctgtgaatgtgtcagaaacattctgactatatcccagggaaccaggatatgcaggcactggtaatatgggacaggatgcagccagcacatgttttttttttttttctttgagatagcgtctcactctgtcgcccaggctggaatgcagtggcatgatctcagctcagtgtagcctccgcctcccaggttcaagtgattctcctgcctcagcttcccagctagctgtgactaaaggcgtatgccaccacgcctggctaatttttgtatttttagtagagatagggtttcaccatgttggccaggctggtctcaaactcctgacctgcccgccttggcctcccaaagtgctgggattacaggcatgagccactgcacctggctgatttttttttttttatccctactctgtatcaagcgttggagacacaaccatatagtctagctgtgcaaacagacattaaacaaatgattcctcaaaaggcacaaagtgtttgaacgtctgcagagtgctgtgtgagggtgaaggcaggggagcttggtttggtctggggcatagccaggcttctctgagggagggatggtggaggtgaagcctgagaatgagcaagttgttaaaaagcttaaggggctgagggcagaggaccagctgcggagaaaagcacatgtaaagtcctgagggtcacagggaaaacttgagagttgtgtgtggctggagcagagatggccgaggcagagagcaggggcgatggggcagaggctgaccccgggaacgttgagcatcagggcaagtgggttttgttttctgtactgggttctctgcctgttcttttaaataaagttttattggcatgaaggcatgtccattcattaacatcttgtctatggccactttcacactgcagtggcaaagctgagtagttttgatgtagtctatggcccatgaagtccaaaatatttattacgtggtccattaagaaatagtgtggctgggagcagtggctcacacctgtaatcccagcaccttgggaggccaaggcaagtggatcacctgaggtcaggagtttgagaccagcctggccaacgtggtgaaaccccgtctttactaaaaatacaaaaattagctaggcatggtggcgggcacctgtagtcccagctacttgggaagctgaggcaggagaatcacttgaacctgggaggcggaggttgcaagtgagctgagattgcaccactgcgctccagcctgggtgacaagagtgaaactctgtctcaaaaaaaaacccaacaactcctgtcttgtgcttctctcctcagctgcttgctacctttttaattcagctggagaggaggaagggagttcagtcttcagggatcatgctcactttctggctggtagccctagtgtgtgccctagccatcctgagatccaaaattatgacagccttaaaagaggtaagtggcagtctccttcctcatcttccttcagtggacccggagggagagatgctgggtccctctggcttgtgtagaagtcatgcgttgccatgggaaccaggggctgggtaccacatgcacctagcttctcccttggtgactttcctaccccaccaaatcctcactaaatcagccccagccttttttctagcacctcctttccccagggcctgatttgtctgtgttgctccaaggggctcccatgggacctccaagggcaggagctgtgggccgatgccaggctggccccatcagcaggaaacagcaagacaggcggctccaaattttgccaggctgggatggagccgagccgggaacggtgtttgcagagtgactgttcccctgggggaccctaggcttgtcctcgcgttacctttgtcccatcagttgctgctctggctggggaagttgtttacattggctgctgtgtgctgctgctaggaattttgaggagtgtgcacttttttttttttttttttgctgttgttgaggcggagtctcgctctgtcaccaggctggagtgcagtggcacgatctaggctcactgtaacttctacctcctatgttcaagcgattctcctgcctcagcctccccagtagctgggaccacaggcacgcgccaccatgcccagctaatttttgtatttttagtagagacggggtttcaccacgttggccaggatggtgtcgatcacttgacttcgtgatccacccgcctcggcctcccaaagtgttgggattacaggcgtgagccaccacgcctgacctggagtgtgtgcttttggaataacctgctgttcctgccatcttggagctaattagagactggcatgaggcaaaggaaggaaaagaagctgaacatttgactattgattgcctacatattattatgagtgatagcagctgatgctgattgagttcatgttttcaaagtgcctcgcaggggactgtgtatgtgtcacgaataatcttcctgacctcttgcagtgacttggacagaatttctcagcctcagcactaatcgacattttggattggagactcgttggttgtaggggctgtcctgtgctttgtagacatttaggggtgtccctggcttcccctgactgggtgccataacactcccaagttaccacaaagaagatatccccagacactgccagatgtttcctgggaggcagaatcacccctggttaagaaccaccggtggtttataggtggggaatctgaggcacagaaaggttaaataagttgacaagatcccacagccagtgtgagagagccaggccttgatacagctctgtttcactcccaagccctgtcttcctcccatcaggcagcggtgagcagtgagactacccgtgatggagccggctttctgccattacatcccggggggagctgggagcccctggggagcctgcagtgtccctgtggctgagtgggtttctgccacctgctctcagaatgtgatcttggttttttttttttttttttttttgagatggagttttgctctgtcacacaggctggaatgcagtggcgtgatctcggctcactgcagcctccgcctcctgggttcaagtgattctcctgtctcagcctcccgagtagctgggattacagttgcccaccaccacgtctggccaatttttgtatttttagtagagacggggtttcaccatgttgaccaggatggtctccaactcttgacctcaggtgttctgcctgtctcggcctccaaaagtgctaggattacaggcgtgagccaccacacccagccccagaatgtgatctttttcttccttccttccccaccatgtaggatgcccaggtggacctgtttcgtgacatcactttctacgtctacttttccctcttactcattcagctcgtcttgtcctgtttctcagatcgctcacccctgttctcggaaaccatccacgaccctgtaagtgtgaccacagatgagtgtgtgtgcgtgtgtgtgtgagagagatgcgtgacacagtaccagctaacatttcttagatccatccaggatctcgttccagcctccctcaacccctgatacagggaatatcatcccacctactttacagatggaaaaactgaggcttagatgtggctgggggagctgaaggagagaatctgctttgtcattgatgaactgctgtcttgcaggcctgtaggtttctcacttggcatggtgattttggaaaatgtgagcagataattacaaatcaggtattttttatgaattctagctgtccagatgttctggaaaagtaaagttctgacagattaggcctataatcctacagggcagagctgaggagttgctggagtccccggcactccctgttgtattatactggcatgctttcctcacttgtggcaaatgcctggcccctgagggatttgagtgtgagatccttggtctattttgtcagtttcagagaaattctgtaaatatggaaacttatcagtgaggagtgtagagatggccaccgtttctgctagtagaacaaaagggaacactttattaatttcccttaattcttttcttcttttttttgagacagggttttgctctgttgcctaggctggagtgcagtggtgtgatctcggctcactgtagtcttgacctcctgggctcaagcaatcttcctacctcagctttctgagtagctggaattacaggcacacaccaccatgcctggctaattttttttctttcttcaacttttattttaagttccagggtataggtacaggatgtgcaagttcgttacataggtagatgtgtgccatggtgatttgctgcacagatcaacccatcatctaggaatcaagcccaggatccattagctattcctcctgatgttctccctacacctgctccccaacttggcttacttttaattaattaataattaaagatggggagatggtctcaaacccctgggctcaagcgatcctcttgccttggcctctcaaagtgctgggattacaggtgtgagtcaccacgcctcgcctattctttatttttttaaatagagatgggatcttgctgtgttgcccaggctcatgtgcagcttttgataagagagatctgggaaggcctgcccagaaaactgcatgtgagcggagacctagaggggtgaggtagtgggtggagcaaacacctagaggaagagtgttccaggcagaggggaataagtacaagggccctggggtggggaggtgtggagagaacagcaagaaaagccagcacagcaggagaaggctaagagacagtgggtgcctgagaggtgggacagcccccttgtgagccagatgagctgtttgggttttattgtgagtatggggcagggaggccttggagcacctatttgatgctgattcatggctagtcagctggtaatgggcggattgcagtgggagaacttttcacctctgtggttctgttgggtttggcctaaacctctgtgaggggcagaggctcaccttgtgggtgacgaaagggcttggtgggcatcagtatggaggaggaggttgatgataactaagagattttagaaacctatgtctcaggccaggtgtggtggctcacacctgtaatcgcagcactttgggaagctgaggcaggcagatcagttgagttcaggagttcgagaccagcccagccaacatggtgaaatgccatctctgctaaaaatacaaaaattagccaggcatggtggtgcatgcttgtaatcccagctagtcgggaggctgaggcaggagaatctcttgaccctgggaggcggaggttgcagtgagcagagatcacaccactgcgctccaacctgggtgacagaatgagactctgtctcaaaaaaagaaaaaagaaatgcatgtcccagtgtatgttctgaggagtcccgtgttggtatttccttgcccaaagaggagctgggttggagaaatgagcaagtgcacacatctgtgtatgtattcctgtgcatctgtgtgtacgtgtgcatgtgcctgcttgtgtgtctcggtagtcataggcatgtatatgcgtgtatgtgcttatatgtgaatgtgtgcttgtgagtgtgtttatgttcatgtatgtgtgtgtttgtgtgtgtgtgtgtctttgtgttgtgtgtgcttgcatatgtataaagttcacaaaggcaatggtgactcatgcctgtaatcccagcactttgaaaggccaaggctagaggatcgcttgagcccaggggtcaccccattttggatccctggctggtgcctgacacagaagagaggggctcatgagtcagtggctgttatatgtattgtgtatcagtgtgtgtaagtgtgtggcagccgagtgtccctgtttgtcaaatgttgggctattcttttttgtcttttgtttgttgtttttttctgttgttttgttttgtttttagacggattcttgctcttgttgcccaggctagagtgcagtggcatgatctcggcccactgcaaccccgcctcctgggttcaagcgattcttctgcttcagcctcctgagtagctgggattacaggcgcccatcaccatgctcgactaatttttgcatttttagtagagatggggcttcaccatcttggcccggctggtctcgaactcctgacctcaagtgatccacccgcctcggcctcccaaaatgttgggattacaggtgtgagccaccgtgtctggccgagccattctttagaactgggatttatacaaaacaagtcacacctcaactgggtggctgcagaccttggattgctcagggtaaacagagtctggttggggctgcctggctggcgtggggatcacccaacccatcaagcttcctctgggagcctgggaagagctctcttgccatggatggttctggaagctttttgaaggagggactttcttaatttctgatctcccttgggaatctggataaattccctttcacttctcccctgggcgtgtgtgtaccagggtgactcacagatctgacttggacctttttttgtgctttctgcattcctggcagcctgggcctgggatttgctctgccaccctgggtgacatgaagctctcagctctggcggctaaaaggctacactgttgtggggctgggacaccctgactcttctccccagtcattgttttctgtttctgtgtcatctcccccagctcggctcctcctgtgtcactgctggtcttccaagatggtggaagacactgtggtttgtctctttgcagtctcgctctgtcgccaaggctgtagtgcagtggcatgatcttggctctgcagcctctgcctcccaggttcaagcaattctcctgcctcagcctcctgagtaactgggactacaggcgcacaccaccatgcctggctagtttttgtatttttagtagagatggggtttcaccgtgttggccaggatggtctcgatctcctgacttcaagtgatccgcccactttggcctcccaaagtgctgggattacaggcttgagccaccgtgcccggctgtggtctgcctcttgtgcagtgagatccagcagggtgtcaaatgtgggtgtgcaggctgctgcatttctgacatttgtgcacctgtccaggagagaacactttgattggctgacactctctgtccaggaagcctgaacttccctctgggttcctgttcaggaaccccatggggttgccatttacctttttgcagattagagtttagaccaggagttagccagtagcccatgggccgaatctggcctgctgcctgtttttgtaaataaagttttattggaacacagccactcgcgttcatcacatagtgtctacaggtgtctggagctgcagcagtggagttgtgtagttgctacagagactgtagcacccacaaagtctaagatacctaccatctgaccctttacagaagaagtttgtccacccctggtctaagcatttctttagctctgatgactttttagcttccttttttgtcccctttccatttgcaggcattctttcttcctatgcaaggcaaggacgggaatcgacatttattagatgcttgcggtgtactggctagcactatgctaagttctttatatgcatgtctcacttgactctcacagcagtcctggtgaacttggtactatttttctcattttacagacaaacaatcgcagacataagtgccttgctcgacctgagtagtagagcagagattcgaactcacgactggctgttgtgcacaatcatgtcacttcgcttggttgtaactgctgaatgggagggtcttggctaaataatggctttgtgttaggctagaggcttcacgtggcagtatccaccttgtaacctcagtgcctaagacacagccaggcacacggtgggcctgtagtggtaatttattgttgtgttatatggggaggtgctcagtacatgtggcacgtatattatgtcttgcataagggtgaagtgtgcatgaggcctcacaggacatcagattaagctgcttctctgccttcatcctgttcaagtattaccagcaagaaagaggaaggggactgatgtatgcacagatgttctgaaggcttggcatggtgtcaagagccttatttttttttttaatgttgcattttggggggttaaatatatgtaacctaagatttgccattttaaccattttaagtatgcaattcagtgatgctaagtgcttttaaaaatcttgttcaaggccaggtgtggtggcttacacctataaacccagcactttgggaggccgaggcaggtagatcacctgagatcaggagtttgagaccagcctgaccaacatggtgaaatcccatctctactaaaaatacaaaaattagctgggcatggtgttgagcacctgtgatccctgctatttaggaggcagaggcaggagaattgcttgtgcccgggaggcggaggttgcagtgagctgagatcgctccagtctgggcaacagactgagaccctgtctcaaacaaacaacgaacaaatgaacaaacaaacaaacaaaataaccacataactacctagcaacgtagcctagcaattgagatgggggcaaggaagggtaggaaccaggtcctgtgagaatcagctagacttgtggctttgggctcggtgctcttcctttggggacgtcagcagccccttcttgaaaacgggttgcaactcgatttgttgttggcttcacctcctctctctgtcccagacctgagccctgtgatctggggaggaggacaacgggacaacctgtttgcttgttttcccatcactctcagggattgaatcacagtggagccaggaagatggggagagtccaggcttgctgctctcccatcctcagagcagcagcaggccatccatcacctgtcgcctgtcctcagagtgatcagccaaggcctggggcggctggggtcaggtcaggcagggcgtgggtgggagctggcagggctggctcctccaggccacttcgtgctgagtcactgagtcggccaatcctccccagctggccctgctcccactccatgactcagatgtctattccagccctggctgcttggtggggctcctcccatctgtccttctggctctggggctgccgaggcttttgggagcctgggcagggctgaccaagactgccagagctccggccggtccccagtctcctgccttttttctcattggcactgagtctgtggtttaggtttgggggaggagggtcttgtagataaggggatcaaggccaaaggagatcatttattaggtcccagctgaaagcagaggtccttggaccagttggaatgctcgacatcccccggaagcttgctagaaatgctgggtctcaggcctcatcccagacctaccaagtcaaactcattttaacaagatctccaggtggttcagggttgcaaatcactggtttggaacattcagtgaaagctactcagctcgtttgcagtaagaggtatttttagtcctgtctgtataatatgtaatattttccccccagcattttactatgaacattcttaaacctacagaaaagtcgaaagaattctactgtgagcagtcatatagttggtacctagagccacagttaacattttgctaaacttgctttgtcacatatctgtctgtctaaccagatagctaatcagccagccaaccggctacttttgttttgttttttgtttttgagatagggtctcactctgtctcgcagactagagtgcagtggtgtgatcatagctcactgcagcctccaactcctgggctccaatgatcttcccgcttctgcctcccaggtagcttgggccctacaggtgcacactactgtgtttggctaatttttaaattttttgtaggcgtgagggctccttatgttgcccagtctggtcttgaactcctggcctcaagccatcctcccacctcagcctcccaaaatactgggattacaggcctgagccactgaacctagtttttttgatatctgaaacttccttcgaaatatattagtattctttcatgcacccacttccaagtaaatcattagctagagtttaagatctgtttacacttctgagttttttgcttaaaatttacatacagtgaaattgctgatctcaagttagcatttgatgaatcttggtaaaggaatactttaaacccctgtcaagatatagaacactgcaaggacgccaggaagttccctcgtgccccttcatgatcagtctctgtccccacccaccaaggcctgatcttggaccgttgattaaagcgttgaaactccattttctttccatttctccgtcatgctttcagtcatttaataatcaggtgttgtgccaggggctgagctagaaagaaacagaccttgaccactgccctggaggagagatggaaggtgggtggcaggcagttgaaccaacaactgcaggatggacagtgggggctctgagggagggaagtgctgggagttgtgggggctgggagagtggtccctgactcagcctggggctccagggctagcatccagggaggagaggggatgctcaagtctaaggaatgcgaggctctggccaggtgaatatgtttggaggtggtggggtgggagggtgctcctggtagagcaactggcatgtgcaaaggtccagttgagggagcttgtgggtgttgggaatcacttggaattcggcttggctaggctgggtgcagtggctcatgcctgtaatcccagcactttgggaggccgaggcaggcagatcacctgagactaggagctcaagaccagcctggccaacgtggtaaaaccccgtctctactgatcataaaaaaattagctgggtgtggtggtgcatgcctgtaatcccagctactcgggaggctcaggcaggagaattgcttgaacccgggaggcggaggttgcagtgcgccgagatcgcgccactgtactccagtctgggcgacagagcaagactctgtctcaaaagaaagaaagaaaaaaagaattctgcttggctagattggaagggctaggatgtaagcgaaaagagaggcaagagtcagcatcagagatcaagggtgcaattatgtgtcacaataaggacttggaattttttgtttgtttgtttgttttgagatggagtttcactctgtcaccaaggttggagtgcggtggtgccatctcagctcaccgtgccctccacctccggggctcaagcgatcctcccacctcagcctcgcaagtagctgggaccatagttgcgtgccaccacgcccaagtaactttttctgtttttggtagagatggggtttctgtatgttactcaggctggtcttgaactcctgagctcaagtgatgccctgccttggcctcccaaaatgctaggattacagggatgggtgaaccaccacatccagccaggacttggaattttaaccctactgtggtgggagctgaggaaaggtttttcaccagtggaatgacacactcaggttggacaggttgtggaagatcctcaggctcaaaggaagaggatacattggacatgggggtgaggtcggtggcacttaaaaagcctttgcaggcacccaggcaggtagagagggaggctgagccaggatattcccctgtgcccactacagcatcaaaaaccagaaaaagggccaggtgcgtggctcacacctgtagtcttggcattttgggaggcttaggggggaagatttcttgagaccaatctggtcaacatagtgagaccccatctcttgaaacaaaaaaacaaagaaaacagacaagttgatgggcaaagggcatgggcaaagattctggggtgtgctccagtagaggaaacggaggtcctgggcagggaggcattttgcacagttggtaagcaacagggcaaacaaatcaccagtgtttacgttatactggcaaatctcttactgctggacatttaggctccgtctaataataaggataacagctgggtgcactgtattatttatttagtcctcacagtagggcaggatgatcagtctccccacttgacagatgaagacactgagggtcagagtggtgatgtgtcaggaaccctcccactgggttctcacgcttgaaacacagattgctggtccccacccacacagtttctgatgcagtaggtctgggtggggcccgagcatctgcggttcccaacaagttcccaggtgccaccgatgctggtgacagagctgcgtttgaggatcactgctctaaacattattgctgctgcacgcattgcctcctgctgggtgcaggggttgtggggggcactttggcagtgcagagcggaggtaaccagcagaaaacccgttagaactaaaagctgagagtgtttctgacaaacaggtcaacatgctgaaagacccagacaaggtccttaaactaccctgcgctccaagaatcagtgcctggggctgccgtacctaattggttcaaaccacagggtttctggccagctcatctggtaccaaacgtagatgtcaatatggtggatgccaaagaacacatcactctgtttggatgaatcaggcttttcctccctctgccttcagccaggacttctctgaattgttttcatttcaaatgaaagagggaccagttcacaagctgctttcatgctatctgggacaggagttactgtatttcagtgtctgaggctgggaaaccccctggaggtggctctgtcttttgtacctagtgtgtgatgtcaaaagattctccttggtttgggttaaatgacatgctccctggattacaatccagtgccccatgattttttttcctccttttttattgtcaatccttgacctacttcagaagttagttgtctttgttgtcaagtaaggccttccacgtcagatagaggctgtttccaggccgggtgcagtggctcatgcctgtaatcccagcactttgggaggccgaggtgggtggatcgcttgaggtcaggagtttgagaccagcctggccaacatgataaaacccccgtctgtactacaaatgcaaaaattagccaggcatggtggtgtgcaccatgtaatccccgctatgtggcaggatgaggcaggagaactgtttcaatttgggaagcggaggctgcagtgagctgagaacgcaccattgcgctgcagcctgggcgatgagagtgaaaccgtctcaaaaaaaaaaaaaaaaaaaaaaaggctatttcctttttttttttttttttttttttgccagtgaaggggggaccctgtgttggcctccctatcggtcacttgagataatctgaaaatctgtgtttagatccatagaagagaggcggcctgaggagaagaatttgacaaagctctttgagtgtgcaaattagaaatggcaattgctgggcgcggtgggtcatgcctgtaatcccagcgctttgtgaggccgagataggcggatcagttgaggtcaggagttcgagaccagcctagccaacatggtgaaaccccatctctatcaaaaaatccaaaaattagccaggtgtggtggcagatgcctataatcccagctactcaggaggctgaggcaggagaattgcttgaacctgggaggtggaggttgcagtgagccgagatcgggccactgcactccagcctgggcgacagagtgagactcagtctcaaaacacaaaaaacaaaaaactgtgcagtgttctgtctgtcaatgtccttgttgcatttgcagggcaggttttctaccagtggctggggacttagttttactgggccgagggaaggttaggatttgagggtcttgttaagctggatatgggctgcatttcaagcctcccctggctgtctctatcctgcgtgttgatgccaaggctgaagaagactggatttgcaggcaaaagactgtcatttgaggcctgttttcaccccttaatcactgtgtcttggtatgttgtgggggttgaggtaggcagaggttagccaaccttttctggaaagggctggctgataaatacttgaggctttgcatcccatacactgtctgtggcaacccctaactccgctgtgtagctcaaaagctgccatactcatttataatacataaatgaatgggtgtgactgttccaatgaaactttatttataaatagctggtctgtgggccatagatgcttctgatatataaagcatctggtatagtggtgtattgtgaacccactggggttttttcccccccaaacacttgagctttattgatgtatattgacaaataaaaatggtatataggttgggcacggtggttcatgcctataatcccaggactttgggaggccgaggcaggtggatcacttgagctcaggagttcgagactagctcaaggaatagagtgaaattctgtctctacaaaaaatacaaaaattagctgggtgttgtggtgtgcgtctgtagtcccagctacctggggggctgaggtgggaggatcacttgaacctgggaggtcgaggctgcaaagagctatgattacactaccgtgctccagcctgggtgacagagcgagaccctgtctcgaaaatatatttaaggtgtacagttttatgtttccatataccagaggctactgtcactgcttctattattattactactactactactcatgttaccctttctttggctgttactttgtgccaggtactattctaagtacttaccatgtttgatctcatttaatcttcaccaccaaggaactgacccaaggtcccacagctaggaaatggcaagctgggattgagccgtgccagctagccccgtgctatgcactgcttcacacagaagctgcccctccacccctgccgccttccttttcctttgttcctttgttatcagctggccgtttccagaaacggttggttaacctctgcctacctcaaccctcagtgattaaggggtgatatcgggcctcaaatgactgacctttttcctttgttgcagctctcactgattgtaattctgattgtaattatatatttgtttgcaccgtggtttacttactgtccatcttccccagggcaggaggctgaatggggcaggggtctcgctgtctcgtttgcagctccgtccgcggcacttcacccacatcctggcctataagcaagtcctgcccatatatttgaccaataaataaatgaatcattgacagccgtgccccaccccttcctcctctctctgccagccagcaccttggtctttcacagtgggtagagggcttgggctgcaggtgaaatggatttgcaattccctgataacccacccgccgactgtgggagtgggcaggaaggtgtcagctcttccggatgaaaaaccagcctgcaatgcagtgtttctacccagcctacaaagcaaacaccactacctccacgccttaggttggagaaattccgctttacgacacagtcccatgggcctcatgtcatttgtccctcctggcagtcccgggggataggtcgagcaagcagtaggacaaacgactcccattttccaggtgtaaaaactgaggcttggaggtgaagggacttgcccaaggtcatcagctagaatatagcagggctgggattagaacccaggtctgtccgggtccacggtctgatctgaactcggcttcagttggtctggaatgcaccggctgcatctgatgatcttattaaagatctgtggctgtcagggtcctccccctggaggtgctgatttagttggtctgggttggggccctaggcacttggcacttaacaaactccttaggtgattccagtggacaggcagggctgggaacttcatcacccctccgagccccagagcggagcctgatccttagccctggctgtgtatttgaatcactggaggagctttttatttagccttttatgatggaaacataaagtagacagcctaggataatgaactaccatgagctctttttcttttctttttatttatttttgagacagggtctcactattacccaggctggagtgcgatggcacaatctcagcttgctgcaacctctgcctcccgggttcaagccattctcgtgcctcagcctcttgagtagctgggactacaggcacgtgccaccatgtccggccaatttttatattttttgtagagacagggtcttgccatgttgcccagactggtctcgaactcctgaactcaaagcagttctcccgcctcagcctcccaaagtgttggggttacaagtgtgagccactgcgcccagctgccatgagctctttaccatgcattgcataggtgaacgttttaatatgtatctctgaaggacatggatttgtttattttaaatgactttttatttcgcaatagtttggctcacaaaaagttgcaaaaataacagagttcctgttgttcattgctcaactttctctaatgataacatctgaaagataagaattttaaaaactgtaactgttgggctgcatgtgatggctcatgcctgtaattccagcactttgggaagctgaggcaggaggatcacttaagcccaggagtttgagaccagcctgatcaatataggtagaccttgtcttgacaaaaaacatgtatatgtgactgtaatactaactttaataataattcattattatcaaatattccagtaatccattgtgtttgtacaatggctcattcttctatgatatcattctttatgttttagctgggatttttttatggaaaagagtttccccttcatttctttgatcactgatcactctgtggtgatcgaataaatgactgttttcctcagggaagccttctccaaccctggtgaaccaaatgagtacatttgggaaaggtggagaaaatacttgtttctttccgctttttctgcgttcaaacaatgacctggttcactgacaacatcagatgtttctctttatttccagcgtcaatatgaaatttgtgtacataaacatgtaaggctgggcgcagtggctcaagcctgtaatcccaccactttgggaagccacggtgggcagatcacttgagtcaggagttcgagaccagcctgttcaccaacatggtgaaaccccatctctactaaagatacaaacattagcccagtgtggtggctgatgcttgtaatcccagctacttaggaggccgaggcgggaggatcacttgaacccaggaggcggagtttgcagtgagccaagatcacgccactggactccagcctgggcgacagagcaagactccatctcaaaaaacaaaacaaaacaaaaaccttgcttggtatgtttcagcctgttgtacttattctccttgtcaaagctcaaattgtccctcttttagcctgcagcggccacttctgcttggctcttgagccttttaacaatcctgttcatgcttagtttccttgttgtccggtgtgacaagatgttcttggcttaccttgcatatttcctgcccagccacttttccaagaaaaatctggaagtttaaaacaaaaacaaagcttcagtgccccagtcgcacccagaaccagcttaatcagattgcctggtgcgggtagggcccggatacagtatttttttaaattttatttttattttgtttgagacagggtccctaggctggagtgtagtggcacgatctcagcttactgcaacctccgcctcatggattcaagcaattctgcctcagcctcccgagtagctgagcttgcaggcacccaccaccacatccagctaattttttgtatttttggtagagacgaggtttcatcatgttgcctaggctggtctcgaactcctgaccacaagtgatctgcccgccttggcctcccaaagtactgggattacaggcatgagccaccacacccagccaggatacagtattttttaaaaagcacgcccagccttgaatggaaaaccactggacgagagtatgccaccttatcgggctctgtaaatgccttatatctgcacaaggctggaactttgagtggagtccttggctaaagctttcattactgcctggtgacctctcttccctctgctgctaaagcttgtgtttcagaatttagacccggatgcatccatgttgaaagccaggctttgtctgtcatcccaggagctctgtatcggtccctttccttgcctgcatgttgttgacttggggctcatcttcatttctctgggaaatgagttctttgatagcttgcttagaatctctcagtacttcccattgcccttagaatgaagaccaaaatatgtggcctgcagtgtagactgtgcacagcctccagtgtagactactcaggccccttcttggttcctggagtctaccatgctttcttctaccaccgggcctttgcacacactgctgtctgttgggaatgcgttgcctttccttgttacttagttctcatctactcacccttcaggtgccagcttgactgtctgcctcgggggcgccttctctgaccttcgtacaccagatcagcccccatgcacttactttgtctcattggtaatatttctctcccttcaggacacacatcaaggcccagaagttgtagttttgcatttgttcatgtgatcatttgatgcatgtctctctctggagcctgactctttggggctcacatcctcactccaccgcttttagctgtgggaccttgaacaaatcttttcatctctggtccccagtttttaagttaaattaaattttattttatttttattttgagacactcttgctctgttgccaggctgtagtgcagtcgttcgatcatggctcactgcaacctccgcctcctgggttcaagcgattctcttgcctcagcctcccaagtagctggaactacaggcgcctgccaccacatccagctaatttttgtatttttaggagagacagggtttcaccatgttggctaggatggtctcgatctcttgacctcatgatctgcctgcctcggtctccgaaagtgctgggattacaggcccagtttcttttaactgcaaaacagggatgatataatacttttatttatcttgtgaggtgaggatgaagattaaataaggtagtttgtgtaaagcacttagaaaagagctagctactaatagtagagaatcttggcaggtattactgatgattactgcagtagaccacaagctccatacaggcaggggtcatttctgtttgtttagatttgtatgcagggtgcttggcacaagggttgtgctcaggaaatacttgttggatgaacgaatgaatgaagtggagataatagtaataccatgtttatagaattccatgaggatataaaataatgcaagtatataagctcttggtagagtgtctagcacatagtagatggtcaataaatattcagtgactgaatgagtaaagtggggacaatagtaatacccgctcatgaggttgtcgtggggatataaggcaaccctgtagtaccttgtagaatgcctagcacatagtaggtgctcagaaaatatttgttgaatgaatgagtgaagtagggatgacgttaacaccaactcctagggttgttgtggggatagaagacaaggcaggtctatagcatgttgtattgtggttgcacatggtagacactccgttgattgaaactggaagagctgccatgaatttctttctcctggctattaggagagggtccttttggggtgcagaatggtgtggagctgacgctagtcctctggaaggaagagtgagcagctgactacttgctaagctctgacctggatgaaaagtcaaatcattcctttccctcttcctcccaaacctgtgctttctttccactagaatccctgcccagagtccagcgcttccttcctgtcgaggatcaccttctggtggatcacagggtaaggccaggccccccagacctcagggaggtggtggggagtgaatgaatgaatgaatgaacgaatgaacatgctcagctccccctccccaacttctccctcctttgctcttctgcagagttgtcttgaatctgcctgtgctggccatgtggtctcagagacaccaactctgtccggcagttccgtgaacttgaatgtgataaacacgtgagccgtgagcagctgacacctctgcagaaggctttgcctgggacagccatatgctggactgcttttgctttagcttcagatttgggtttttaaaatattaggtatagttattattgacattgtccccctcctgtcccccacgccttagaaaaataatactgtctcaccacaggaagtgtgggttaaaaaaccacatgtgcagatcagcagtgcaggagacatctagaggtaaccagtgtcaccattttagtatgccttcttctggtcgtctttcttttttttttgagacggagtcttactctgtcagtctcagctcactacaagtctccgcctcccaggttcaagcgattctcctgcctcagcctcccaggtagctgggattacaggcttgcgccaccatgcccggctactttttgtatttttagtagagacagagttttgccatgttggccaggcttgtcttgaaactcctgacctcaggtgatccacccgcatcgacttcccaaagtgctgggattacaggtgtgagccaccatgcccagctaccttctggtcctctttttgtatatctttttctgcccgttgttaacatcttagtggggattgtttgaagaatctttttttgcccctaataagcatcatcttttttttttttttttttttttgagacaggctttcgctctgtcgctgaggctggagtgcagcggcacacttgtagctcactgcagtcccaatctactgggcttaggtgatgctcctgcctcagcctcctgagtagctggggctacaggcacactcccccatgcccagcagatttttgtactttctgtagagatggggtttcatcatgttgcccaggctggtctccagcttctgagctcaagtgattctcccgcctcagcctccagagtgctgggattacaggcgtgaaccaccatgcccggtctcatccttgtcttaatgacaaacatcgttttaaaaaattagatgttttaaataatttcttcaagttactattaaaaagcatcactgggacagttgatgtaatttgttcatgactacaggaccccggatgcatgctaataacattcattcttgttttggaaaattgtgctctagttacataagagcatgtcctggattggaagagaatacctccagtttttcttgggtaaaggcatgtagaggctgtatgttaactttttttttttttttttttttttttgagatggagtcttgctctgtcatccagggtgcagtgcagtggcaggacctcagctctctgcaacctctgcttcctgggttcaagagattctcctgtctcagcctcctgagtagctgggattacagggacctgccaccacatccagctaatttttgtatttttagtagagatggagtttcactgtgttgtccaggctggtctcaaactcctgacttcaggtgatccacccacgtcagcctcccaaggtgctgagattacaggtgtgagccaccatgccagccctttaactgtttaagtggttcagaaaaagatgatgtgtttgcatgtgtgtgtgtgtttgtgtgtgcatgtcaatggatacagacagagaatgatactgcaaacgtggcaacgtgttaacaatggtgagttgagtgaattcttagtatgatttgagtaatttttctataagtttgaaattattttagaacaaaacatgaaagtattttaccttttattataaaagtgtttagtctgctgggcacggtggctcatgcctgtaatgttagcactttcagaggccaaggtgggtggatcacctgaggtcaggagttcgagaccagcctggcctacatggtgaaaccctgtctccactaacaatacaaaaattagccgggcagcacacgcctgtaatcccagctacttgggagggtgaggcaggagaattgctagaatacaggaggcagaggttgcagtgcactgagatggcgccattacactccagcctggatggagtgacatagaaagattaatataataaaactcaataatctcatcacccagatttcatgcttactaatgctttgtcatgtcagcctttttattttttaattttttccttcagcctatttttttttttttctttttatagggtctgactctgttgcccaggctggagtgcagtgacacaatgacggctctttgcagcctccacctcctggccttgagcaatcctgccacctcagcctcccgagtagctgggactacaggtgcgagccatcatgactggctaatttttttatttttacttttcgtagagatagtctccctatgttgtccaggctggtcttgaactccagggctcacaaaatcctcccacctcggcctcccagagcgctaggattatagacatgagctaccgtgcctggcccatatcagccttttttaatttaaaattttaaaaagttggcggggcacggtggcttatgcctataattccaagacttcgggaggccaaggtgggagggttgcttgagcccgggggttcaagaccagcttgggcaacatagggagactcttgtctctacaaaaataaaaaataaaaaaaaaattagccagtcataatggcttacacccaaagtcccagctactcgggaggttgagatgggagaaccactctagaccgggagctggaggctgcagggagctgcgatcgcaccactgtactccatcctgggtgacacagcgagaccctctctccaagtaaataaatgaatgaacgaataataaaaaataaaaaagagctatcctgatacttcgctcctaaatcatctttttttccctaagtcttttgtatgcaccactaaaaaaaaaaaaagccatttttcctgcatgacccaacagaatgagctgtaattagcttgtaatatatgcaaatgtccatctgcattctgacttcccaagctgcatggctgccttcatttgcagcgggcagctgtgctgcagaggggagcagcatcagcaggcgtgtggagtgagtgagccccgtcctccccctcctcctgtcattgactctcattgcctaacccccttgtgtcttggccccaggttgattgtccggggctaccgccagcccctggagggcagtgacctctggtccttaaacaaggaggacacgtcggaacaagtcgtgcctgttttggtaaagaactggaagaaggaatgcgccaagactaggaagtaagtgtgagtttccttgtcctccaggatgccctggtcacctcctttccactcctgtggcctcaatccaggatggggccctggcagtgctgcctgttactagctttgtggttctgggcaagatgcctcacttctcctcctggcctcagtttgcttttctgccaaatggggtaggatctcacatgtcattaaagcaactgggcagagaaaagaagaaagaagctgggtgcggtggctctcgtgtctaatcccagcactttgggaggccaaggcaggcggatcacttggtcgggagtttgagaccagcctggccaacatggtgaaaccctgtctctactaaaaatacaaaaattagctaggcatggtggcaggcgcctgtaatcatagctactcaggaggctgacaggagaatcacttgaacccaggaggcggaggttgcagtgagctgagattgtgccactgcatactagcctgggagacagagtgagactccgtctcaaaaaaaaaaaaagaagaaaaatgttgtccaaacaggcagttgatgctgtctgccatggcgcgtgactatccctccttgagtcagtctcacttttttctgtctctttctgagcatctggcatcctgcatgttcttgctgtttgaatgttctgtccaacatgcccagctgaccacgtaagtctgtttagccaaagaagccccatttgagggtgattttggctgtactggattttaggctctaccccctatgtaaggcgtgccccactgcaccacctctgtcactcttcgggaatcaggccagtgcctcccctgcacataccttaactcatcaaatctgagacaccattagttgcgtgatgcgttattattctatgtaacagtaagaaagaaaagcagctgccaattaaacaaggacataagacttgtctcgagcccggacgaactggaacatgaaattgtgggtgacatgggggcagtggattgcggccatgggggtagtagaatggctgtttttgttcctgttgcctgttctggggtaagtttactacgataaactgtggtggggccagtgtggtgcattggattccccacagacccattggccttacagggaaaaaccccagaccggggttctgttcctcattctattccggggatgcccaggatacaggccttcagtcagacccagatggtgggtgggaatctggacatccatgtgccagccactaggacatcagcagaggacctcgtgactccggtcggaggctgtttgggtggtccaggtgatgggagaaattgtctcgtgggaggcagatagagcttgggcctctgtgactgagcattgtaaggaaatggcccatgtccatgacccagttgaaggtttttggcaggcaaaggtggggtccctgtttattacagttcttcatggagacagaactagtaggatggatggatggatggatagatgatagatagatggatgatagattgatagatgataggtagatgatagacggatagttggtggatgtatacatggtaggtagatggatagatgatagatagatggatgattgatagatgatggatggatggatggatggaggatgagaggggatctactagggaaactggatcatgtgattatggaggctgagaagtcccaccctaggtcatctgcaacctggagaacccaggaagctggtagcatggctcaggcctagtccaaaagtctcagacccagggaagctgatggtggaattctcagtccatagtcaaaggcctgagaacctggagtcattgggtaagtcccagaggccagaaatcctggagttctgatgttcaagggtgggagaggatgacatcctggctgcagaagagagagtgcctgcatttgccattactctgactttttgttgtgtccggaccctctgctgattgggcggtgccacccacatggggcgaggatggatcttccttagtcagtccactcattcaaatgccagtctcgtctggaaacatcctcacagacacacccagaaataacactttaacagcaatctgggtatcccttaacccagtcaacttgacccctaacatcacccatctcatctggattccttcagcctcacctgcagcatcccccccgctaagcaggccacatttgtagtgtgggcttcagcattcctcatcatccacgcctctgctgatcacctggctcggcttcctctcatggaagacggatgcccacctttgtgtcccctggagcttgtcaggagagcaggttgctggagacaccatgggagaggccaatatcacagccttgggaggaggacagagtttgaatccagaagctcctccactggcctggctcttaatccactgagcagatgaaactgactgctgcttttgtgcttagcgacgtttagtccctgagggttcagagagtggaacaaaagagacacactctagttgggtgccatcgacattctatatgggagacaggacgttggttgtgaaacatgcattgacaagaagctttggagaatgatggtgttggggtgagataaaaatgaggaaatgagggtgagagtaaccgaggaagcttttgtgtgtgtgtgtgtgtgtgtgtgtatgtatgtgtgtgtgtgtgtgtgtgtgttttctttttttttttttttttttgagatggagtctcattctgttacccagggtggaatacagtagtgtgatctcggctcactgcaacctctgcctctcgggttcaagcaattcttctgccccggtctcccaaagtgctgggattacaggtgcatgccaccacgcctgactaattttttgtatttttagtagagacggggtttcaccatgttggccaggctggtcttaaacttctaatctcaagtgatcctcctgccttggcctcccaaagtgctgggattacaggcatgagctactgtgtccggctgagagaggtgttttagatacagtggtcaaaggttctacccagtgtggccatgacccttggtgagcatgtgcctgtccctccctaagtctatctctggctgttttcgagcctctggcatcctgagtgttactgctttttgaagtgtttttgttcaacatgcccagctgaccatgtatgattgttttgagaaggtcacatttgagcagagacttgcattggagggagtgagccttgtgtgtatctggggaaggaagggctttccaggtagagggagcagccagtgcaaaggctctgaggacactcgtggtgcatcagggggcttgtgtggcttgaggaaagtgagtgagggggagaaagggaggagatgaagcaggagaaggatttgcaggggtctcctctgagagttaaggtgggattccaggtgcagtgagaacacaggcgcaggttttctgcagggcagtggtgtgacgtgagttctgttgtttgtttgtttgtttgtatgtatgtatgtatgtatgtatgtatgtatgtatgtatgtattttagagacagggtcttgctctgttgctcaggctggatggcagtggcatgataacagctcattgcagcctggaaattccgggctcaagcagtcctcccacctcatcctcccagagtagctgggattacaggtgcacaccaccatgcctggctgatgaattaattaattaattttatattttatatttgtttttttgagatggaattttgctcttgttgcttaggctggagtgcagtggtgctgtcttggctcactgcaacctccaccccccgggttcaagcgattttcctgcctcagcctccggagtagctgggattacaggaatgtaccaccatgcccggctaattgtgtatttttagtagagatggggtttctccatgttggtcagtctagtgtcaaactcctgacatcaggtgatctgcctgcctcggcctcccaaagtgctgggattacaggtgtgagccactgcgcctggcctttttaaatttattttattttattattattatactttaagttttagggtacatgtgcacaatgtgcaggttagttacatatgtatagagacaggtctcactgtgttgcccaggctggtctccaagtcttggcttcaagcagtcctcctgcctcagcctcccaaatagctgggattacaggtgtgagccaccacacccagctgagttctggttcataacaacccaggctgtcctggggaaggtggatatttagggacaagagtgaaggcagggagaccagggtgggaacctcaagggctgtccatgaagtcccttcatgcctcaccgggagccgccattgtatttatttatttattttttgagacagggtgtcactcttttgtccaggctggagtgcagtggcacgatctcggctcactgcaacctccatctcctaggctggagtgatcctcccacctcagcttccctagtagctgggactacaggcacgtgccaccacacctggctaattttttttttttttttttgtagagatgatatctcgccatgttgcccaggctgttctcaagctcctgagctcaagcagtccacctaccttggtctcccaaagtgctggtattacaggcgtgagccactgtgcctgactggagcctccatttttcacccagagcattttctgagaattcagtgagatatatgatatgataagctgtgccctagccctgagtacatgctgggcaggttttaattgtacaagttttatttattcatctgtacactttgatcttgccagggaggatgtggtgagaactgggtcttggggcttgaaagcgggccacctgagaagggtctggctctgtgagtaccttggtgtttagagatcctcagcgtggagccaggggatcatttacttgggacattggtagacggatcgcttgctttattcccagaggcataagccagatctggcacctgtaacccctgtgaacctggagagagtgagaaggaaaaccctgtcctaggctggaatttcctggtgtggccccttacactcagatcccttttgttaaccagagaaaggaatgcagctcgtgcagctctgggctgctgggtatcctaggctcggggatcaggtgatggacgccagggctgggggctctgcatggcttcctggatccttttaccacctctcttcacccatgagtgactccttctcaaaagtcaggtgtggctgggcatggtggctcatgcctgtaattgcagtacgttgggaggctgaggcgggaggctcacctgagttcatgagttcgagaccagcctggccaacatggtgaatccctgtctctgctaaaaatacaaaaattagccgggtgtggtggcgctcacctgtaatccagctacaggggggctgaagcatgagaattgcttgaattgtttggatttaaaaacccagtgcttcattggtttgtgtgtagtggttttatgttctcttttgtgtatggccactcagagcttagggccattttggactgtggtttctgctggcatgaatgtgaaatgcttctgtgactctggaagagtttggcagttttttttttttttttttttaagttagacacagtgaacataccaccagtcacccccttcccaggcatccagccaacagagctgagaacatatgttcataaaaggctggtacaggaatgttcttagctactttgtgataacccaaactggaggtaagccagacatctattagcaagtgaacagacagatgcaccagttatgtacatctgcacaactgaatactaagtgatgtacaagaacgaactattggccgggcacagtggctcatgcccataatctcagcactttgggggcccaaggcaggcagatcacttgaggtcaggagttcaagaccagcttggctaacatggtgaaaccctgtctctactaaaaacataaaaattagctgggtgtggtagcgcacacctgtaatcccagctactcgggaggctgaggcaggagaatcgcttgaacgcaggaggcggaggttgcagggagtcaggatcgcaccattgcactccagcctgtgtgatagagcaagactccatctcaaaaaaaaaaaaaaaaatccctataagataaagactacttttttggtgacagctttattgagatattcatacaccgcacaattcatgtatgcagaacatacaattcactgatttttagtgtgttcacagagttgtgcagtcatcatcacagtcaattttatttatttgctttttaagacagagtcttgctgtggcgctgaggctggagtgcagtggcacaacctcggctcattgcaaccccctcctcctcctgagttcaagcgattctcctttctcaccctcccaagtagctgggattacaggcaaccgccaccatgcctggctaattttttatatttttagtagagacaaggttttgccatgttggtcagggtgttctcaaactcctgacctcaagtgatccacccgcctcgacctcccgaagtgctggcattacaggcatgaaccactgcacccagtcaaaaaaaaaatttttttttagaaatagggtcttgctgtgttgctctggctggctggactgtttttttttttttttttttttccactgatgtatatatgcctatccctttacctgtcttgatgattgttgttcttttttttgttttgtttttttctttttgagactgagtctttttgcccaggctggagtgcaatggtgtggtctcagctcaccacaacctccgcctcctgggtttaagcgattctcctgcctcagcctcccaagtagctgggattataggtatgtgccaccatgccgggctgattttgtatttttagtagagatgaggtttctccatgtttggtcaggctggtcttgaacctgccgacctcaggtgatctgcccacctcggcctcccatagtgctgggattacaggcgtgagccactgcgcccagcctattgttgttctttctttttgagatggagttttgctctgtcacccaggctggagtgcaatggcctgatctccactcacagcaacctccacctcccaggttcaagtaattctcctgcctcagcctcccaagtagctgggattacaggcacctgccatcatgcccggctaatttttgtatttttagtagagatggggtttcactatgttggtcaggctggtctcaaactcctgaccccaagtgatccagccaccttggcctcccaaagtgctgggattacaggtgtgaaccaccactcctggccatgattgttattttgtattgttttgaaatcaggaagtgtgaatcctccaacttgattcttatttttcatgattgttttgactgttctggatccttgagtttccatgtgaattttaaagttagctcataatttctacctggcagccagctgggcttttgatggggattgccttgactctagatcagtttggagccatcagttttctaagtctttaacttattcaactcgtttaatcttacctaccttggaggtaggtcctacttttatcctcatttcacagaggaggaaactgaggcccagagagcttaaggaccttgtctgaagtcacgcagctggccagtggccaagccagaccttgagccggtggctctggagcccgtggctctggagcccgtgtttgtaaccactgtgctgagctgcctctttccctgggcttgttgtctttgactctgccttccctgaagggtgacattccctggccatgtccctgtggtagggggctgcatctctggcagaccccacaacggcttcacctccttgtgttccaggcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagtaagaccccttccctcccaggtgggctccattttccctccttggctttgatctttcagttgcatcagtcataaccctggggtcatgctgtgtcctgaagtgggctcatagccagatgtctccatttttactttagcttttttgaaaaaaatagagacagggtcttgctttgttggtcaggctggtctcgagctcctgacttcaagcgatcctcctgcctcggcctcccaaagtgctgggattgcagatgtgagccatggtcactgcctagctttactttatgctttacttaattaccatattagtgaagaccacatcgtttgcaagtaacagaaacccactaggctcccctaaaacccaaatggggaggatatggcattgtcttgggaaaccaagagcaaggaaatgccagcagatctcatgaaaaaactgcaaccagggttgggcgcagtggctcatgcctataatcccagcactttgagaggctgaggtgggaagatcacctgaggtcaggaggtcaagaccagcctggccagcatggtaaaaccatctgctaaaaatacaaaaattagccgggcgtggtggtgcacgcctgtaatcccagctactcaggaggctgaggcataaaaattgcttgaacccaggaggcagaggttacagcaagctgattgcatcactgaactcaaaccttggcgacagagcaagactttgtctcaaaaaaaaaaaaaaaaaaaaaaagaataaaaacaacaacaaaaaactgcaaccaggaactggggagtcagaaaggaagttgcctctctcctacctggctctctgctgctctgtgactcaggggctacacatcccttctcttttcctccctacctctttacctcgtgttccctatgcaattcctttgggtgacttgctggtgatgagatatagctagagcaattagtgcacaaccccaaggcagaggcctcttttatgagcagtttgggtcacctgcacagccagatcaccactgtggacttgtttttccatctatgaaattgaagtgatagtgtctagctcatctggctcaggagaaagttgcagtgccaacactgaagctctcttccctgcccccacgtgtcacaagtcattccaggccctctctttgctcctttgcaggttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggtaggggacgctgtgccattggcatgtggcccgacttccacatcccctcctgcagccctgggttactctggggccagcgtggggatttccagcccagcttctggagcagtaggatgagggtagcttccgtgaccttaggtggcagggacagcacgcatcaggcattgtacgttaggaaagctgatttcaagggtgggcgtgtagatgtctttgtgtatcagctgtgagtaattgagtttcttagatggatcagtggcccttgttgtggggaaatccaagtttggatcctcattctgctgttaacattctgtgtttcagcttgttgtcactctttttttttcgtttttttgagaccaggtctcactctctcccccagactggagtgcagtggcatgatattggctcactgcaacttctgcctcctgagttcaagcgattcttctgcctcagcctcctgagtagcggggactacaggcgcctgccaccacgaccggctaatttttgtatttttagtagagacagggtttcgccatgttggccaggctgatcttgaactgctgacctcaggtgatccgcctgcctcagcctcccaaagtgctgggattacaggcatgagccaccgcgcccagcctgttgtcactcttaatttgaactgagcaggtggcacattccttgcatggtaagagtatgtagcaggcatttgtgtacatccaatttcaaaggacctaaattaccttcttgatccctataaatttttttttttttttgtctcgaggtcaaggaaactgcttggctcctaggttaggaagagacagtcttgcaggtacttgatgaactagaggagtgattctcaggcctgtctgtgaattagactcacctggggagcttaaactgatgcaggccaggcactgtagctcatgcctgtaatcccagcagcttgggagaccaaggtgggggaatcactggaggcttggaagttcaataccagcctggtcaatatagcaagaccctggctctgcagaaaatttaaaaaaattagccaggtatggtggtgcgtacctgtagtcccgtctactcaggagattgagttaaaagaatcacttcagccccggagttggaggctgcagtgagtcctgatagcatccctgcattccggcctgtgtgacagaatgagaccctgtctgaaaaaacaaaaaaacttcctgacacctaggttgcaccagaccagtgaaattgcgattgctgtggtggcacccaggtgtcattgtttttgttttttatttatttttatgttttgagacagggtctcgctctgtcacccaggctagagtgcagtggcatgatcttggctcactgcagcctccacctcctgggctcaaacgatcctgccacctcagcccaccacgtagctgggcccagaggcatgcatcaccacgcctgctaatgtcttagtgtttttaaaactcacgaggtgatagtgtgcaatcatgtttgagggctagggacattttcccccaccagggcacgtttggcaatatctgggggcattttcggttgtcccaactgggggcgagggcatgtagtgggtcgaggccaggtattgctgctaaaactcctacagtgcgcaggacagccccccaaagaattatctggctccagatgtcaagaatgccaaggattagagaccctggcccacaccctcagtccttcagtgggatctgggaccagtagcactgacacagcctggaagcgtagaaatgcagaatcccaggccacaccccagacttgcagaatccaaaacaactccccccaccccccaccactccccccagaaaaacccggccgcatgtgtgcacattaaagcatgcgaagccctggtttcgaggacacctagggtcccttgccaactgatgagttcaaggttgggaggcactgagcaccgcggataagaatgtgggctttgagatgacacaggcgtcctgggcagacagataggtcgggaggggaggaggagagatctgcggcatttctgcccctgagagtctccttcctctccgtgggtctggagggagagtcaggcctcttcagctgccacactcacccaccttccctctcctttgtcccacaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctggtgtgtgtttaacgccgtttccctttgcatgcagggagggacttctacgtgtgggcagtgggccgagggagtgggtgttgatggtaatggcatgtagagctccctggcagttccggctgtggttcatattttattttccagcctgttaaccaattcctcagtattttgttcctttcctgaattgtcaggttgatgttctccttggtggcatggcgttttcattttctcttttccttgacagtgtcagtaattaactaccctacaatggacgacacatcatatttctccccttgaatcctcccaaacgctaaccagactcacttattcattagtccctaattatggtggtcaaaattctctcaattgcaagggatataaatctgtcttaaagtagcctaagtggccggttgcagaggctcacgcctgtaatcccagcactttgggaggccgaggcgggcagatcacctgagatcaggagttcgagaccagcctcaacgtggagaaaccccgtctctactaaaaatacaaaatgagctgggcgtggtggtgtatgcctgtaatgccagctacctgggaggctgagacaggagaattgcttgaacctggaaggcggaggttgcggtgagccgagattgggccattgcactccagcctgggcaacaagagtgaaactccaattccaaaaaaaaaaaaaagtagcctaagtaaatagagggaactttggggctgcatgtatctcagaaatctggggactagcttcaggtgtggattgatccaggagatcaagcaatgttgtcagtactcagtttcacccactgccctgttgtcctctgagttaacatcattctcagtggtacttccctacatggctccgtagctttgggctgataacatcctgatagataaaggtgccagagaaaagacaaggcagcatttctctgcacagccagagtcagtctcagagagcactctgattagcctggcttggtcctattcacacccgtgaaccaatcactgtggcccaggaggcagagttctctcattggccagcctgggtcacatgtcctctcccatggcagaagagatgtgattgacagcccttccatgtggagagggagagttcccaaaataaaatgataagcaaagaggctcatagcacaacacatgccttgtgctttgctacctctggatctttgccacgtacctttccttccttcttcctaattgatgaaagcctgctcatcccccaaggctgtaacaaacactacttccattgatttaccctcccttctcaattagatggacttcttcttttgaattttgagtcccaataactttagtataggaactcatctaataatactttctgaaatagttttttttgttttgtttttgttttgacatggagtcgcgctctgttgcccaggctggagtgtggtgtgccatcttggctcgctgcaacctctgcctcccagcttcaagcaattctcctacctcagtctcccgagtagctgggactacaggcttacaccaccacgcccattaaattttcttttttttttgtatttttagtagagacagtgtttgatcatgttggctaggctgatcttgaactcctggcctcaggtgatctaccctctgtggtctcccaaagtgttggaattacaggcgtgagccaccgtgcccagcccactccctgaaatagttttgttttgttttttttgcatgctcagtgtactgcctcctctttgaagggtaacatgttagctacttgcagacatatagcagctgacttttgtgtcttctgtgggtacaaccccagcagggcctgatgcataatgggcacagctcaaattattatctgttattgaaagagaagggctggacgaaatggctcatgcttgtgatctgaacactttgggaggccaaggcgggtggatcatctgaggccaggagagcagcctggccaacatggcaaaaccccgtctctactaaaaatataaacattagtcaggcatggtggtgtatgcctataatctcaactacttgggtggctgaggcaggagaatggcctgaatccgggaggcggaggttgtattgagctgagtttgtaccactgcataccagcttgggcaacagagcgagactctgtctcaaaaaaaagaaaaaggaagaagaaaaaattactggtttatttggctgtagtttggtttttttttgtacatttgtagagcagaaggtgagtaaagtgtttctaataataaaactcagaaaaaacaccagaatttaattgtctaataggctgggtacagatataggtggcatgcgcctgtaatccctgcactttgggaggctgaggtggaaggattgcttgaagccaggagtttgagaccagcctgggcaacatagtgagaccctgtctctacaaaaaaaaaaaaaaaaaaaaaaaattagctgggcatggtggtgcctacctgtggtcccagctaccgtggaggctgaggcaggaggattgcttgagcctaggagtgcagaggctgcagtaagctaggatcacaccactgcactcctacctgggtgacaaggcaagaccctgtctctagaagaaaaaaaaaatctaaataaagtgtcttttcaagcaggtgtcttggggagtccacttttgtaaaagtgctactatgggaaaaatatttttggaacatttgttctagaactgccttcaggattggtttatgaaccgttaagaaaattgtctaacatcacgttttgttttagatggtagttgcttgagctcagcactgttgacacttggggccagacagttctttgttgtgggggctgtcttttttttttgttcttgttattgttttttttgtttttttaagggacagagtcttgctctgttgcccaggctggagtgcagtggtgcgatcatagctcactgcagccttgaattcttggcctcaagcagtcttcccactttgtcatctcatctagctggggactacaggtgcacgccaccatgcctggctaagttatttatttttttgtagaaatgggggtcttgctgtgttgcccaggctggtctcgaacttctaccctcaagctatcttaccactttggcctcccaaagtgatgggattacaggtgtcagtcactgcacctggccacaaggctataagttaatacagcaaaattagcaaggaattaaggcacacatggggcggtgttcaagagaagccaggtgcaggcttccaggagtccccagcagagtcacaggttcactaattctctggcaaccatgatgattatgtgtgtgaaatgttgccaaccagggaagcttggtaggagctcagttcctgggtttgtattaggggcaggtcacataagcagcctttgcttggcacataccaaaagtctagactcccagagggaaagcggtgttcagcataaaccatattgtttgtacaaacagttgaggcacactgagctactctacccaattctgttaatggtggaaaccctgtaagtatgcagacactagccaagggctaaacttgtaagcagccttcaagcaggaaaagcaatcaggtggtcgtgttcacacttttctgcttactaccttattacctttctaaaaatctaagctgggtgtgatggctcgcgcctgtaatcccagctacttgggaggcagaggtgggaaagtcgcttgagcccatgagtttgagaccagcttaggcaacatagtgagaccttgtctctacaaaaaatcaaaaaaatagctgggcatggtggtgtgagtgtagtcacagctacttgggaggctgagttgggaggatcacttgagcccaggagatcgagagcagtttgagtaacatagtgagaccttgtccttacaaaaaaccaaaaaaattagctgggcatggtgatgtgactagtcacagctacttgggaggctgaattgggaggatcgctggagcccaggagttggagaccagcctgggcaatgtagcaagacctaatgcttacctgtagtcccagctactttggaggctgaagtaggaggatcactgatgcaaatagccactgtactgcagcctgggcaacatagcgagacctcatctcctaaaaaaaaaaaaattagaatcctgcagttgtaatttgcaaaactcatgtggccccaagggcttgggagaaaggagcgtggacctgcttattcttcaagggattgggaggacctggagagatgctcaggaatgaaaccacaggctcttaacaccctattgtggggtaaaagtaacacaccttgccctgaacttggtcagcagcatccacgtgggatggatcaaccggggaagctgttacgggccctgttttcttctgtctggtgagtgatgaagagtctcctttccttccttagaatctgggcccttccgtcctggctggagtggcggtgatggtcctcatggtgcccgtcaatgctgtgatggcgatgaagaccaagacgtatcaggtaaggcatgtgtctctgcgggcccccaagccgggccctaggcagaggcctctccatgaggattttagtccagttccttctgctctgtccctggggttctcagccttgcctgccagttggactcacttggggagccttaacaaatgctgatgccccggctgcatatctgggattctgattcacttattgtgggtggggtctggacatcaagatgttttaaagcttcccaggtcattatattgggcagccaagattgagagctcctgacacatggttagaccttgtaggccggtgactggaatcagaaggtctgtgagcctctgagaaagtccttgtttcccacggtcttgtttattatgtgtatgtgtgactcagctttcaagagttgagtacaaattaccccctacttttttcccccttattagctcttaccttataggatacatgctgttaatctctttatttaaattaaaataattaatttctaaaatggggccttgctgtgttgcccaggctggtctcaaactcctgggcttaagtgatcctgttgcctcagcctctcaaagtgttgggattacaggtgtgagccatcatgcccggctttcagctttttatttttggagatattttgtattttaaaaagtttgaatacccaagtaatagagtgatgtttcttattataaaaaagtccaaatcaagccgggctcacccctgtaatttcagcattttgggaggccaaggtgggtggatcgcctgagcttaggagttcaagaccagcctgggaaacatggtgaaacctgtctctaccaaaaatggaaaagttagctgcatgtggtgatgcgtgcctgtagtcccagctacttgggaggctgaagcatgaggatcacctgaacccaggaggtcgaagctgtagtgagccatgattgtgccactgcacaacagagtgagaccctgtctcaaaaaaaaaaaaaaaaaaaaaaaaaaaaaaaaaaaaaaaagtttaaatcgtacaaaagtacataaattaaaaggggatacccccttccctactctctcaaccactgcaaatatatagaagcaaatccttctacaactttctacgtatgtatatacagacctgattaatggtatagtttggtttgtttttatatatgtgggtttttttttttgtttgtggagatggagtctcactttgttgcccaggctagagtgcagtcgtacgatcttggctcactgcaacctctgcctcccgggttcaagtagttctcctgcctcagcctcccgagcagctgggattacaggtgcccaccaccacacccagctaatctttgtatttttagtagagatgaggctttaccacattggccaggctggtcttgaactcctgacctcagatgatccacccgcctcggcctcccaaattgctgggattacaggcatgagccaccatgcctggccattatatatgttttgtgtgtgtgatattattaccatatctgtttttacctaaatgggcccacgtggcagcatgatttttgtcctttagcgccctgctttggggacctctctgtgctgtgccgtatagcttcaattcattcttccaacccggtgccttttggtctataatggagatggtgcagtttatttctttgctcttctgttgatggatatttatggtgtgctgtggaatttcaaatgggagcactaggctgcactgacgataccacagggagatgagtttcaggacatgggcctgttggaaggagaggcctcacgtggtagggttgggtgggatgggtgaggcaggggctttaggattgagtcacccttcagtctcttgatgtgtaggatgccctgagtggcccgactcaacccatttcagtccctggcctccagatcatgtagcttatattcttcccatctgtgacccggggatgactgtagcactaaatgataagagttcttgtgattgttaagtgtctgaatacatgtaaaatgcttagaaaagttgctgggatacacaaaatcctgggtggtagtaaaagtatttaacaactgcactgcacaagtatccactatttggaaccagtgctagccagtacagaaacatttcactattttaacaaccatgggccaggcacaggggctcatgtctgtaatcccagctctttgggagcctgaggcaggaggttggcttgtggccaggagtgcaagaccagcctgagcaacatagcaaggtgccatctctacaagaaatacaaaaatgaactgggtgtggtggcatatgcctgtggtcccagatactaaggaggctgaggtgggaggatcgcttgagcccaggaattcaaggctgcagtgagctatgatcatgccactgcactccagcctggatgccagagtgagatgatgtttccaaaaaaaaagaaaactgggctgacaagaaataagaaaacaggctgggtgcggtggctcacacctgtaatcccagcactctggtaggccgaggttggatcacttgaagtcaggagttcgaaaccagcctggccaacatggtgaagccccgtctctactaaaaatagaaaaattagccaggcgtggtggcaggcgtttatagtcccagctactcaggaggctgaggtaggagaatctctttaacccgggaggcagaggttgcagtgagccaagatcgtgctactgcactccagcctgggcaagagagcgagactccgtcacaaaaaaaaaaagaaaaaatacgaaaacagagaagaaaaacaccaccaccatgtctcctgtgtttgggtcagcagagtagggactgaatcccttcttttctgtacacctgaagggtttttcttgcctctgttcctggattctaaattgagtatgtttctccaatgtctaacctaacgtgatttgaaggggttttttttttcttgatagcggggtcctttggtgtggtcttggggctcaagagtagggctagtagggattacagggtcagctctcccaccctcaggaggcccatttttaatagacggtgaagttgaggcccagtgcggtggctcacacctgtaatcccagcacaggagtttgagaccagcctgggcagcatggtgaaaccccatctctattgaaaagaaaaaaaaaaatcaatataaaaaacatttacatgtcaaagtatataataaagtttatgagaaaaatagctggtgatgttgagtgatgggctgatcccagggtcgccccagatgtgttgactgcccgtctcttccaaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtgagtgaagccacatttttcctggccctcattgtttgatgttttattttctctgcgtacctgaatatttttaaaaggtcactatgttgcccaggtgcagtggctcatgcttggtaatcccagcactctgggaggccaaagcaggtggatcacctgaggtcaggagttcaagaccagcctggccaacatggtgaaacccagtctctactaaaaatacaaaaaaataagccgggtgtggtggcgcatgcctgtagtcccagctactagggaggctgaggcaagagaattacttcaacctgggaggcgacggttggagtgggccaagatcacgccagtgcactccagcctgggcgacagagcaagaccttgtctcaaaaacaaacaaaaaagtcactatgtcagcaaggccttccctgaacacttggtttaaacatttgccatcttctccattctcctttgttttattcacacttagcagcttctagccaacctgtgtaggaaccgttcgttatctatttactgtgatataaggagcttgtgccagaatgtaaaccagtgccccctgcttcctgcattaagatagccttgcaagacaaaaagtgcgagctgagtcgaacggcacgcttggtgccatagttgatctacattgtggtgctgcgtccttattttgtcaccaactggtcacaaagtgtggattgtcagtgtctcataggccacatgtcaagtggcatggtctaaacacactctaaaatttacttattttgggctgggtgcggtggcttgtgcctgtaatcccagccctttgggagtccaaggtgggtagatcacttgaggccaggagctcgagaccagcctggccaacctggtgaaaccctgttactgcttaaaaaaaaaaaaaaaaaagaaagaaaaaaaaagctgggcatggtggtgcatgcctatattcccagctactcaggaggccgagacatgagaatcccttgaacctgggaggctgaggttgcagtgagccgagatcgagccacggcactccagcctgggcaacacagcaagaccctgtctcaaaaaagtaaaaaaaaaaaaaaataagtaaaataaaatgtacttattttattgtctgcttttcccccactaggatgtcagctccagatgggcatttttgtcgtttctcttgactgctgtatcctcagtatataaaacagtgcatagcaggtgctgaacaaatattgtcatccattgtaaaaaaaaaaaaatacagaaagatataaaatgaaaagtatattgtcctctcttccatcagttcctcccttctaaagtgacagtttcgtgtacgcttttagagaaaaatggacaagcatataggtatttaaaaatactttgacagatataaatggaatcatactgtacatagtgttctcttttctttggttaacaatatatagtcttggttcgttcattctggtctacttcattttagttttttggggggttttgttttgaaatggggtctcgctctgtcccccaggctggagtactgtggtgcgatcatagctcactgcagccttgaactcctgggcccaagcaatcctcctgctttagtttcctaagtagctgggactccaggtgcactgctaccactcccagcttgtttcatttgtgttcatgatggatgcttgtctgacgtgcagatgcgccctgctggaattaccctttctcccattccttgcaaaaacaggttgttccctgttttttttgctgttatgatccatgctacactgaaagttctggtacctgtcctggggtatggtaatgggtctatccctgcctagctggctttgaaaagtttaaagacaacagtgcaacttacaatttgcaaagttggccgcaaatcaggagaccatacagagatggactttggaaattccctttttaagcacagttaaaaacagttaatggtgaaggatgacttcagatcatgccccatgtttgttttttctttctgtctttttattaactgtgtcattctttttgtaatgttgtgctcattacaactattccttcttggtcaggttggcaaattatatgtttttctggcaagtttctgtgaagcagagttaaacatgtttatgaatatgaacttttctgttaaactaccatctgcttcatctttgttgagtttcaggtggaatgtctaaggaagctccagctgtttcagcatttgcgaaagcgtgttcatgctcccactgaattttcttagtcttgccttacttctctcagggtctggaactgcaggagagatggtgttcaaattcaagcctgcatcagaatcacctggagagcttgttattatattttattatttattcatttattgagatgaagtcccagtctgtcacccaggttggattgctatggcactatcttggctcactgcaatctctgcctcccgggttcaagcgattcttccacctcagcctctgagtagctgggattacaggcatgcagcaaccatgctcagctaatttttaaaatatctttagtgtagagatggtgtttcaccatgttggccaggctggtctcgaactcctgacctcaggagatctacccgccttggcctccgaaagtgctgggattacaggcatgagccacagtgctggctgttagcttgttactataaaactcagctttctgggccccacccaaattttcagttttagtaggtctggttggggcctgagtatttgctttcctaacatatccctaggtgctgctgcttctggttcaggttgacatgtagagacaccggagtggatcctcactgcctaaagtctggtccgtggaccagcagccatggcatcacctggtgcttgttaacggtgcagaatttcaggcctcagcccagatccactgaaacggaatctgagttgtaactagttctctaggtggtgtgtatgcacattaaatttcgagagagactggcagaaagtaggagtaaagaaactttttctgtaaatactttcggaattccgggccatacagtctctgtcacaaataccagtctcttccagcgtagtgcaaaaacagccttagataatatggaaatcgatgggtgtggctgtgttcctgtaaaaaagtatttagagacaccaaaatttgaattttatagaatttgcatgtgtcatgtaatattgttttgatttttttaacttttaaaaaatatgaaatctggctgggcgcaggggctcatgcctgtaatctcagcactttgggaggccgaggcgggcgggttgcttgaggctagcagattgagaccagcctagccaacgtggtgaaaccccgtctatactaaaaatacaaaaattagctggaagtggtggtgcgcacctgtggtcatagctactcgggaggctgaggcaggaggatcgcttcaacccaggaggcagaagttgcagtgagccaagatcatgccacacactcctggctgggcaacagagtgagaccctttcctgctgctgcccccccaccccctcccagccccccacaaaaaaaaattagccaggtgtggtggagcatgctggtcatccaagctttttgggaggctgaggtacgggaatcgtttgaacccgggaggcggagatcgcagcgagctgaggtcacgccactgcactctaagcctgggcaacagaacaagactctgtctcaaaaaaaataaaaaaaatgaaatcaatgctgagctcatgggccgtatgtaaacaggtgtgggccaaatgtggacctgagccatccttgttggccagcccctggcttagaggactggaatgttcttctgagaatcaggacacctgccacattctactgccagctcacagtgtgaccccaaagctggtcatctcacctcgctggctctagattttgtcacatggaaaatgaaggggttagattccaagcatgtcaaatactgggccctgtcctccttcctcatgcccacagcagacacccacagtcactcatggggttctttcccactgagttatgttcaagcagccctccaggtgactggtgccagtggcctagagttgagcaagaaatgacatcttgttgcccttctgtaactccatgttccctaagatcacttccagctccaatgcccctgcattctgccttgtacattgcattcttcttacactccaataccttgactttaccggggtgcgttgatgaactctctctttttttgttttttttgggactgagtctcactctgtcacccaggctgaagtgcagtggtgccatctcagctcactgcaacctccatctcccagttcaagcaattctcctgcctcagtcccccgactagctgggattacaaacatgcactaccatgccttgttaattttaatatttttagtagagatgggtttttgtcatgttcgccaggctggtctcgaactcctgacctcaagtgatctacctgccttgatctcccaacgtgctgggattacaagcgtgagccaccgcgcctggactctcctttttttttgagaaggagtcttgctctctcgccaggctggagtgcattggcacgatctcagctcactgcaatctctgcctcttgggttcaagcgattctcctgcctcagcctcctgagtagctgggattacaggcgcctactaccatgcccagctaagttttgtatttttagtagagacggggtttcaccagggttcaagcaattctcctgcctcagcgtccgagtagctgggagtacaggcgcacgccaccatgccaagccaattttttgtatttttagtagagatggggtttagccgtgttggccaggctggtctcaaactcctggcctctagtggtccacccacctcggcctcctaaagtgctgggattacaggtgtgagccgccatgcccggtgggtcttactttataaagtaggaagtaatgtatttgcatatggtgaaacataattaaagctgcaccagatggtattcatacagccggacttcgcacgtggccacctcagcctgctgacattcgccaacaggtcatcctttgtccctgtgttgtagggcctggactgcacattgcaggatgtttcccagcatctgtggcctctacctgccagatgctaagtcgtacctctccctcttcttcccagtggtgacaatagaaaatggctccaggcattgcgaagtgtccccttgggggacagaattctcccagttgagaaccacagtcaatagtgaaaggcccaagcccttcctcctaacaccagtcaccttgcttccctctctccatgtttcttgtgtgtttttccagagtccacgtctgtatcactgtaatggtggatacatgtcatacatgtagttatggttacttgattctgtttactttacttttatacaagtgatagtaagagtcatacataaatacatacaaaatggctttttttttctttttttctttttttttttttttttttgagatggggtctcacactgccgcccaagctggagtgcagtgacatgatcttggctcactgcaacctctgcctcccaggctcaagtaatcctccaacctcagcctcccaggcagctgggactacaagcatgcaccaccatgcccagctaatttctgtaattttgcagagacagggtctcactttgttgcccaggatgttttcaaactcctgagctcgagcagtccgcctgcctctgtctcccaaagtgctgggattgtaggtatgagccactgcacctggccttgatggcattttgaaaggtcttgtctcagaggaaaagatacaagccagagggcgctggtgatgaggtttggtctgtgccttgtgtcccgcttaggaggggatgggcagcgtgttctcacagctttttgctctgcacattggattcgttggcaaaacccacagtttccaggctgtcaccaaactttgcttatcacttcctgccctgttccccattaggaaaccacagcagaagatgcttaagagcaggactggcttttcttctcttttttctttctttctttcttttttaaagagacagggtcttgttttgctgtccaggctggagtacagtggcttgatcacagctcactgcaacctccaactcctgagctaaagcgatcctcctgcttcagcctctggagtagctgggattacagatgtgaaatactgagcccggctaccggctttacttaaccttttcttgagctttcttgccatttagtttcccggagtttccagagacagagtttgttgagctgtttggcaagaaacagatgggcctgggtgtcagctggggagaccttgtcctggccgaggcatcgaagcctctgactacattaggataaaatatgtggcctttagttcccctggaaggtgcctgagtgttttttccactggtgtgcattcctgtgcttcaaagacgatgaggtgtttacccagcggtaggtgtgatggaacacagaggccggggaaggccagggatgccatccagggactgatgggactgtttttctggaatggcaaacctggcatttaccacgtccacctaatgcactttcctaaaatagcatcgccaggcagccgtcaatatttaacattttctgtcttggatgatttgtgagcttcttgccttctgtttaccctgaatctccctttgttagaataattcatcattctctatggtaatgatctgtcctgtagttctctgctgatcatatcctagggcccatggagacactgccacgaccatgtcattttatttatttatatatttatacatttctgtatttttgagacggagtctcattctgccgcccaggctggagtgcagtggcacaatcacagctcactgcaacctccacctcccaggttcagctgattctcctgcctcagcctcccgaagagctgggattacaggtgtgcgccaccacacctggctaattttttgtctttttagtagagatggggtttcaccatgttggccaggctggtctcaaactcctgacctcaagtgatccgcccacctcggcctcccaaagtgctgggattgcaggtgtgagctaccatgcccagtcagaccttgtcattttgtgcttgtaccagcaaagcatagggaccttggcaaatagttcatgctctgtaaatgtatgtaggtaaatgaataaatacatgaatgaatgagaggttgaaataaatcatattaattaggaactgtcttgcaaataacagaaacctagcttaaatcaactagagtaagagaagagggggatttttgagtcacaaaactaaaaagtctagaaaaagacttttaagcatgaatggggttccaggcatggctggatctaggagttcccaagataatgttgggaataacaacgtctctgactctcagctctgctttcttgatggtggtttctttattagctggtagtttcctgatcatcctgtcacctcagcaacccctgtgaacagagagtcttactcttttcccctaatatttcctgcaaagctatgggattgagtctcattggttgtggtcgatcacatgcttcttcctgagccagtcactgaggccagggagataggatgcttgggtcagccagggctaggtcatgtctttcagggcttggggccaaggtagggggtgagggaggaggttcatctgtggctgaagctcataggttgacactgggagaagttcagttcccccagagaaaattgcatgttgccataaacagagtaatagatgccaggtaggcaggaagagcaggtaactgcacacagggcatcaggatttttagggagtgggctggagtgtaggggttccattcattggttttccacgtttctcagaaaaggcacctaggggacaggtgctcctcactgtgtatgaagggcttttgcaccctagaccctcgcctattacaaggcgaactccagtctcctgctgcctggagccccagtcattgtgcccgtcctaccagcctcttcggatttccaaacactgcctgcagggaacctgttaaagcctgtgcttccactagactgtgcgtctcagggttgccaagcccacctcagtccccagcgcatgatgggtgctcagttaccacctgaggggtggatggctagatgacctcctccttctggagaagccaggaccatggacctgaaaggggccgcatgatgttgtcctgtcccctctctgtgtgtgccctgtgctgccagcagccggcatcgattggtacttggctcaccaagggggctggtacgttttggtggtgagatgcctgaggcctggtttgcttcactgctgaagagacacctgtgatgtgctcttctgccctcaggcaaattcacctaccccgtccccacccatttatccactcccacccatccattatctatccagcagacattcactgagcaccatgatctgggctctgtcctaggctctgacaatacagcagtgcatactacaggtaataatctccagtcatggaacattcatttttcacggagagaaacagacaaggaaaaataggcacaataaataaatcctagtgctagagaaagccatcctaagtgctatagaaagaaaagagtcagatctttggaataagggcggcttgcagttttaagtagggtggtccaagctcactgagaaggtgacacttgaggaaagacttgatggaggtaaagaggccaaccagggagtagcaagagcatgtgcaaaggccctggggcattactgtgcccattcataggtgggataaccatggaggctgaaacagtgggagtgaggggagagtgacagatgacgccaaatgaggtacagggaagggactttacaaatcagctgggccttgggatctgagtcagcactttgacttctacactgaaaaataggttgactttggagaggtacttttttaaaaattacttgtttagagatgggggcctcactctgttacccaggctggtgcgggggcacagtaatagctcactgcagcctcgacctcctgggctcaaatgattctcctgcctcagcctccctagtagctaggactacaggtgcatgccactatgcttgacttatttattaatattattgttgttttgagacggagtcttgctctgttgcacacgctggggtgcagtggtgcaatcttggctcactgcaacctccacctcccgggttaaagtgattctcctacttcagcctccctagtagctgggactacaggcacatgccaccacacccggctaatttttgtatttttagtagagacagggttttgccctgtcagacaggctggtcttgaactcctgacttcaggagatccacctgccttggcctcccaacatgctgggattacaggcatgagccattgagcccagccacctggcttattttttaaaaaattttgtagagacacagccttgcttttttgccctggctctgctcgaacttctggcctcaagtgatcctccctcctcggccttgcaaagcatttggattacaggcatgggctaccatgccgatcgaaatgtatttttttaacggaggtataattcaccatttaaaagtgtgcaattcagtggtttttttgtgtgatgtgtggtggtgtgaaggtcacccagtgggttttttgtataaatgataatgacaatcaccactaattccaggacgttttcattaccccaaaaggaagccctgtacctgttaccagttgctccccaaatcttccattccattccaggcaaccagtaatctgctttctgtctgtctctgtttatctactgtggacttttcatataaatggaatcaaacaacaggtggccttttctgactgttttctttttttttgagacgaagtgtctcccttgttgcccacctgaagcgcaatggcatgaccttgcctcactacaacgtttgcctcctaggttcaagcgattctcctgcctcagcctactgagtagctgggattataggcatgcaccaccactcctggctaattgtgtatttttagtagagacggagtttctccatgttggtcaggctggtctggaactcccgacctcaagtgatccgcccgcctcagcctcccgaagtgctgggatttcaggtgtgagccaccccgcctggccatctgactggtttcttagcatgatgttttcaaggtttatccatgttttagcatgtataagaatttcactcctttttatggttgagaagtctatcatgtagatacatgtagaccctttcgagtaaagaatatctctgggctgggcatggtggctcatacctgtaatcccagcattttgggaggccgaggcagacggatcacttgaggccaggagctcaagaccagcctgaccaacatggcgaaaccccatctctactaagaaaaatacaaaaagattagctgggcatggtggtgggcgcctataatcccagctacttggagactgaggcatgagaatcgtttgaccttgggaggcagaggttgcggtgaactgcgatcgcaccactgcactccatcttgtgcaaaagaatgagactgtgtctcaaaaaaaaaaaaagtatctttaggtaagatgccagtgttgcgttaccgcttagaagatgggagccaggatgggtgcagtggctcatgtctgtaatcccagcactttaggtggccgaggcaggcagatggcctgagcccaggtgttcgagaacagcctaggaagcatagggagaccctgtctctacaaaaataaaaaaactagccgggcatggtggtatgcgcctgtagtcctagctactcgggaggctgaggtgggaggaatgcttgagcccgggaggtcgaggctgtggtgagccatgattgcaccactgcacccagggatcatgcgtccctgtcgtttcgagcaccttgcctccctcttgacatcggagcctggaaaatttctgtgccatggctcagcgtcatctgtcttgttaatgtcagagccagaacacgaaccagctctggcttcccgtgggaccgggctctcgcttgtgtgaccacgttaatagattccttggaagaatgatctaaggaatttggaccaaatcttccaacaagaaataaaaacagctgccatctgttgagttttactgtgcttgggccctgtgcaaataaacaccctacataagtgccaacagcccttaaaagcctatcatgacttccattttatagatgagaaaataggggcttgcctggagaggtgaaataactcaaccagggtcccacagcggaaatatggcaaagtgtatggtttttatttttaagctgtatgaccttccaggaagtaacaatgaaatggcagtgctgagaccctgaaaatacatgggccgatggccagatggcagggctatttgggtaaagtgggagagacagctcccttgaatggtgagagggaggagtcaggtggccccctggatggaagatggtttcaggcagaggaaacgtcaggggcaaaggcctggcttggggattgtgcttggtgcttttgaggaatactaagaatgcccctctaggacatctctgagaaagttgatgggagaggccggctctttgggctcccggtcgttgatttatccagttcattcccagagtgtttagtgagcacctgccatgtgccagatactgccccaggtttttccacgagctccagcagctggtcagttgtggccacctggggagggcccaagcgcgtctccagggcctgtcactgctcctaggatgatgactctcactcggggcacagcagtcagcactgggcgttctgcttgcaggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggtacagggggaagctggggcgacttccgagagggggccttggggttctaggccacgaaagcatggaagtgcccccgagcgcagcctctagatcacactcccggtcgggctccatgaggcccggacaaaggctgccatgctttcgtctggtcatgcctgaaagaaagaaaacacatttgacttcttgacagagaactcgcacttgagtatatgaatcaagtttaatgcagcagggctttcccatgctctggaagaatctttccgaaatactctgttctcttcagcctgttcctccgccattcctatcctttttttaaaaaacgtagctcttgtctgacttgattgattttacaacccactgataggtcttgaccacccacgctttgagaaaccccaaccttacagccgggcgcggcggctcatgcctgtattcccaccattttgggaggctgaggcgggtagatcacctgaggtcaagagttcgagaccagcctggccaacatagtgcaacctcatctctactaaaaatacaaaaattagccaggtgtggtggcgggtccctgtaatcccagctactcggaaggctgaggcaggagaattgcttgagcccaggaggaagaggttgcagtgagccaagatcgtgccattgcattccagtctgggtgacacagcaaaaactccgtctcaaaattaaaaaaaaaaaaaagaaaaaccccaaccttacggccgggcatgatggtacatgcctgtaatcccagcactttgggaggccaaggcaggtggatctcttaagcccaggagtttgagactagcctgggcaatatggtaaaaccctgtatgtaaaaaaaaataaaataaaataaaataaaaataaataaataaataaataaataaataaataaataaataaatatgtttgaaaattagccaggcatggtggtgtgcccctgtactcccagcgactcagaaggctggggtgggaggatcagctgagcttgggaagttgaggctgcagtgagtcatagtctcaccactacactccagcctgggtgaagggagtaagaccctgtttttttttgttttttgtttttattttttagaaacaatgtagaccatgtagaatctctaaaattcctgccattgactgtgtaaggaggggtggctttctgttttgtcacacttgggcactactggaagctcctgtcacttttctgcactgttttcacattctttttccgagcattgcgaacatcccttttgaaaactccattttaactacataggcaaatcaaccgtaaaatttggtagtacaaggctgatagcaggctttgtcaaaaacaaaaaaatccattttattatgaaaaatgtcaagtgtacacagaagtagaatagcttaaagtttgtaaactggcattaaaagaaaaagaaaaagaaaaaaaaagccaagcatgatggctcacacctgcaatcccagcattttgggagaccaaggcagacagatcagctgaggtcaggagttcgagaccagcctggccaacatggggaaaccttgtctctactaaaaatacaaaaattagccagatgtattggttggtgcctgtaatcccagctaatctggaggctgagacacgagaatcgcttgaacctgggaggtggaggttgccgaggttgcagtgagccgagattgtgccactgcactccagcctgggcgactgagtgagactcagtctccaagaaaggaaataatacaacatgaaccccgtgtacacatcactcagattcaacatcggcattttttggctgggcgcagtggctcacgcctgtaatcccagcactgtgggaggctgaggtggtaggattgcttcagcccaggagttcaaaatcagcctgggcaatgagacccttaatctacaaaaaataacaaaatgggtgtggggtgcatgcctgcagtgactacatgggaggctgaggcagaaggatcgcttgagcctaggagtttgaggctgcagtgagttatgtttgcaccactgcactccagcctgggcaacagagcaagactctgtctcaaataaagaaaccaaggttgggcgcagtggctcatgcctgtaatcccagcactctgggaggccgaggtgggcggatcatgaggtcaggagatggagaccatcctggctaacacggtgaaaccctgtctctgctaaaaatataaaaaaattagccaggtgtggtggcaggtgcctgtagtcccagctactcggttggctgaggcaggagaatgttgtgaacccgggaggtggagcttgcagtgagccgagattgcgccactgcactccagcctgggtgacagagcgagactccatctcaaaaacgaacaaaaaaacccaaaacattttgccacagttgatttatctcattctttttcagtatccctcccttgtccctctttcccttcatttgtttttaatgctaaactctgctatctatcccttcattctttcctttctttgccgaataattttaaagcaaatctcagaccccttacattctacccacaaatatttcagcatgcatttcttcctacataatgtaataccatcatcatgtctaagcaaactaacaataagtttttacaataatactcagcccatatccaagttttctggaatatctcagaaatgcctgtcccattgggctgtttgaattggctctgttgcatttgctgttacgtttccagagtcccttttccaccaggcctctgcccttttcttcttttatttttatttttatttatttattttttgaaatggagcctcactctgtcacccaggctggagtgcagtggcatgatcttggctcactgcgacctctgccttcccaggttcaagtgattcttctgcctcagcctcccgagtagctgggattgcaggtgcgtgccaccatgccaggctaattttatgtatttttttttttttttttagctgaggcggggtttcaccatgttggccaggctggtctcaaactcctgacctcaagtgatctgcctgccttggcctcccaaagtgctgggattacaggtttgagctaccgtgcccagccattcgcccattttttctgaaataccttttgtgggcttttaaaacaaagcagaaccaaacctgtttctttttttgttttgtttaattctaaagtatacactggttctaagaaatgtgggaccttcagaaataagggagggtgtgtgcccctccacacctggggaaacccttgaaagttaaccttggttggttttgcaaaaatgctttttaaaaataactctcccctgccattgctctctgtacaggcgagtgtctccctcaaacgcctgaggatctttctctcccatgaggagctggaacctgacagcatcgagcgacggcctgtcaaagacggtgtgtgtgtgttcagtcctggcttctggaagtggccgccttcccatctcccactgggtcctccctacttgcatttctttcccttggctgccctcaggtttgactctgcccagccgcttgtctgcgagaccccgggggacaagggttctgcagagcctgcagaagggaagggaagcctggcctcctgggcttctgtcctgtctcacacttcccaggagggtgaacttgcacttgcatttttgttttcttgctgagggtcagcagctgcttgaggcttccccgtgggagtcactttccaaggctttgaccttgattctattctgggctaaatgaggactctggaggctggccagcctccatcacccacaagctgtgtagacttaggtctgagcctcagttttatctagataagggaaacaaaagtacctttctttggctgagtgttacttggatttttttttttttttgagacagggtctcattccatttcccaggctggagtgcagtggtgcagtcacagctgtcactgcagccttgatttcgtgggctcaggtgatcctctgaccttagcctcccaagtagctagaactacaggcacacacagcaccatacttggataatattttggtatgttttgtagagacagggtttcaccatgttgtccaggccggtctcgaactccttagctcaagcaatccacctgcctcagcctcccaaagtgctgggcttataggcatgagccagttctcctggcctttttttttttttcaatattaaattgttttatttggagagacaaggtcttgctttgttcctcaagttggtcttgagctcctgggctcaaggatccctctgcctcagcctcccaaagtgctgggatgacagatgtgagccactgcacctggccatgcatttttattggcaggtttgtttgttttgtagcttgttaatttatcgtttcccagcccatccccctgagccagggatgttgtttgtaaccatctctctaggcacttaataataaatattaggccgggcacagtggctcacgcctgtaatcccagcactttggggagctgaggcaggtggatcacttgaggtcaggagttcgagatcagcctggccaacaaggtgaaaccccgtctctactgaaaatacaaaaattagctggacatggtgttgggcacctgtaatcccaactactcgggaggctgaggcaggagaatcacttgaacccaggaggcggaggttgcagtgagccaagatcgcgccactgcactccagccagggcaaagagtgagacttcatctcaaaaaaaaaaaaaaaaataataataataaatattaatggcactaagtgcagtgacacgttcacttataaagcctctgtcatgcacatgccattccaaggatgtcaatgtcccaacttgtccattactcaccatggtacccctggaggagggtgatggaaacccccattttccagatgaagaaactggtctctgaaacttgcctgagattgcacagctgatcaaaagaagaaccagcattcacacccacagcccatcggtagagtccatgctcttcctggccatagggtgttgcctcactgagatttactgagcacctactatgtgccaagcattgtgagaagtgctctgtgtgcactgcctcatagacaccccatcacagccctctgaagttgattgcatgattgtcagccttattttacagatgaaaaagtgaggcacaggctgggtgcagtggctcctacctataatcctagtactttgggaggccaaggctggaggattgcttgaggccaggagtttgagaccaccttgggtaatgtagtgagacctcgtctctacaaaaattaaattcaccaggcatggtggtgcacctgtagtcctagttacttgagaggctgaggcaggaggattggctgagcccgggagttcaaggctatagtgagctatgatcatgccactgtactccagcctgggtgtcagagtgagaccctgtctcaaaaaacaaacaaacaaaggcacagagaagttaactaacttgcctgtggctacccaggtacgaagtggtagccccaggattcaaacccatacagtctggctccagagtccaatgtcagaagattgaatgtgtgtaaacgtcggttataccgcgtgagctgtgtctggcacctcgcaggcgctcaggtatctttagtggcacctaaaacgtttgacacgtttgacacagcacctggtgcatagaagatgataaacagatcctgggagttgtcacttctctggtctgagcgagatggtctcagcatcttcagctcagccccctggtgtggggttttttatcctgggcgctactgacatctggagacacattgttctttgtggttggggactgtcctgtgcactgtgggatgttgagcagcaaccctggactctacccattagatacagtagtatccatcccaattttggcaaccaaaaatggctccagacattgccagatgtgccttgagggacacagttacctccagttgagaaccgtggcccaagtggatgctggactcttcctcccaacactcctgggctgtggtcatctggtttctgctgtcccagtgtcccacatcccctcacatcataaggcaatgattccatctactctggggtcaaatttctctgctaaccacaggctgaaatttgaggtggccggcggtgggtggggggtggtttcttggtactgaagttgttcacagctcaatgcaagcatcaggaaacccctaggcccctgggtgccgcccgcaccccagcccctccttcctgccctaatagtggcctcctaggtggttggacttcctggaatgtttagcacgctctagccagtgggggcccccttggctgctcccagctcccaagctaaccgttctctgcaacctctctgtctccagtggcttttcttaaattccttaaatagcaactcccagtttcctcattccacgtccactcgtagaagagctgagggagaaagttaatctaggttaaccagcaccttcctctctctctaggttttttgtttttttgatgcatggaggaagttatttcttcatttgacaacttaaacaaaaaatactcctgtattatctccagatggtcttaaggtggctcataattcagagagctgcttttctgttttttctttttctttttttttttttttttgagacagagtttcactctgttgcccaggctggagtgcaatggcacgatcttggctctctgcgacctctgccttggtttcaagcgattctcatgtctcagactcccgagtagctgggactacaggcatgcgctaccacacctggctaatgtttgtatttttagtagagatggggtttcaccacgttggccaggctggtctcgaactcctgacatcaggtgatctgcccgcctcggtctcccgaagtgttgggattacaggcatgagcccctgcgactggcctgcttttgttttaagtgagagacatgaagtaaaaggaaaataacaggaagaagagtaaaagaagacagaggtgctaggagctttagaagtgtggagctggccgggcatggtgtctcatgcctgtaatcccggcactttggaaggccgaggcaagcagatcacttgaggccaagagttcgagaccaggctgagcaacatgtcaagaccccacctctacaaaaaatacaaaaaaaaaattagctgggtgtgatggtgcacatcctgtagtcccagttgctcaggaggctgaagtgggagaatcgcctgcgcctgggagatggaggttgcagtaggccgagatcgcaccactgcgctccagcctgggtgcagaagccagatcctgtctcaggagaagacagaaacatggaaccagttaacgtgggctttgtctccgacactctccccttccctgtgccctcgtaccacacttcctgttccgtatcctctttttttgagtttatcgtgatggatgttttagaaagatccacctgctgtgatgtgctgtgtgtagagtggtgtggctgggggaggaagacagaggacctggggagaagggtgaacgacctccctttgcacctcaaggagggcccagcggtctgatgctggccaccccagtggagagaggtttgcatgtggacgccagctgtttcccactgaccttggccactgctcggccctcccagctggagctgccccgaacctgcctgagaagggccagggcatcgagagcattgagtaattctcatgcggcccccgcctctgcagtcatctcccaagatgatcgtccagatggcgcaaccccatcttacaaggacaaagctgcttgcagtttccttctgctttctgggtctggggctgcctccagaactgcaggttgagtttcttctttcagaacccgtggctgatgtcaccagataataatgcctagcgccattcgtgccaagcgtctggggttgaaccattcaagcagagaaagagagtgttctgtgcatgtggagtcgcacagctcagcctgtccctgacatgtctctgtgctttgtaggcgggggcacgaacagcatcaccgtgaggaatgccacattcacctgggccaggagcgaccctcccacactgaatgggtaagccgggacgtggacacacgtgatggtgtggagagagccacagggcttttgttaaacgtggattcgaattcccaccgtgctccctctctgtgaccttgaacaactcactttgcctttctaagacttagcttacccatctggacaatgggtgcagatacacctgcttaggctgtcgtgagaagcagacacacatgcctagcacagagggttccctgggattgtaagttacagcagccttggacagctagacttagacaatacaggagattcttggcttgcgtaactgggaagttctactttcaggtgcggtgtgatccagggactctgccgtcagaactttcttcatattttctgtgtttcactttctcctggtctgctttatcctcacgcatcctctccccttgtgatggtaaatggtcccaacagctcccactgtgtatcccactgttaggagaactgcctgcttcttattgacccagattgggtcctgtgccctctgtgaggcaatcgctatgccttcagacactgagtgtgctgattggccagtctcagtcaggggctgtgatgctgctgaactccagtgcccctcagctgcccagctcaccctttcttgccagctttctatctggcaccccacaccctacagtccttacctttccaaagcacatgatgtctaggaaattgaccttatccccaggcaacttgtcaagcacctctcattttgttctgaccagaggccttgatcaacagctttttaggcccccttaaggaatccgcaaaacacaggggtgatgggacccttttagaggtttagctcatgcctgggtagccaaatcactgctgtattttatgatgaaggagagaaactctccagagaaaacaatctgtagaaggcctgcattgaaaattcatgggggtactgcatgcttaggaagttcttccttatgtctaacttaaatcctgcctgcttcaattgtagctgttctgtcttgttgagctgcacaactaatctgtatctgtgtccctttcctgacccagtggttttcctgttcagttaccttccccccatgagcccccagaacctttctctaacccttttctctcatcagcctgtaagaatatttcagtctcacgtggacagtggcaggtactgtctcacgtggacagtggcaggtattgtctcactgggcttcctgcccactcaggccccataatcctttcccctcccagcacaggaacaaaaagcctgatgagtgtcaccatgcagcagtgtcataagaatgaaacaatcagtgacagcaacgactatcagcatttccactaatactctgaaatcagaaaggtggcagttaaaaagcacagaatcccagcactttgggaggccaaggtgggcacatcacctgaagtccgaagtctgagaccagcttggccaacatggtgaaaccctgtcactactaaaaataaaaaaactagctgggcatggtggtgcatgcctgtaatcccagcactttgggaggctgaggcgggcagatcactggaggtcagcagttcgagaccagcctggccaatgtggggaaaccccatctgtactaaaaatacaaaaattagctggatgtggtggcgctcgcctgtaatcccagctacttgggaggctgaggcacaagaatcatttgaacctgggaggcacaggtttcagtgagccaagattgagccactgtactccagcctgggccacagagtgagactcttgtctcaaaaaaataaataaatacttaagtaactaaatacagataaataaaaaataaaagcacattccatataagtgagtccagcaaaggtttggatgtgccctcccttccctgggaggatggaaaccctgctctggaggtgccgtcggcagtgggagtggcctggggttgacctgccccattgacagccggtcttactgggtgaatgctgagcttattttattttgctttctgctgttcgttaaaggatgatttcaatagagacatcttcctgaaattcaactcagatttattcatatgcgtttcccttttcaaccctttggtggctcccggctggcagagttcaggtgtcttagcacagcgtccttccagggcatatttcaaggtgctcccaggtctggccactacctacctcagtgccatcgcatccctggttacaccctgtgccttcacccctttacacctttctccggctctccacatgtttctgtgtgtgggacactcctgctttttgtcagagttttttggtttatttattttctgagacagagtctcacgctcttgcccagatcggagtgcagtggcacgatctcagctcactgtaacctccgcctcttgggttcaagtgattcttgtgcctcagcctcctcagtagctgggaccacaggccctgccaccaccacgcctggctaatttttatatttttagtagaaacggggtttcaccatgttggccagactggtctcgagctcctgacctcgtgatccgcctgcgttggcctcccaaagtgctgggattaccagcactggcatgagctaccgtgtccggccccagtttgtcttgaggtgtcctctcctttcagaccttgcgtcatgcccccagtaaagtttctgcctctccgaggggcaaaaactgttccagaagcccactgtgacaggatccctcaggttactccctgcctcacttctctaagggacacctgtcacctgcctcccacctggaggccccctgagacaggtcactgaactgaactcagcagtagaaatggaaggaatgttgaggccttcagtgtttagtacagtcttgccttctgtctttctctttctctacttggggtaaattgaggctcggtggccatgggcattagcccggcaggcctcattcagcgtggctgagccaggtgtgttgtgtcgtttcagcatcaccttctccatccccgaaggtgctttggtggccgtggtgggccaggtgggctgcggaaagtcgtccctgctctcagccctcttggctgagatggacaaagtggaggggcacgtggctatcaaggtaggatgaggaccagcggggaggggcagtggggaagctggtggtctgaggaaaagctcagaaatgatggtgtttcttttgactgtccctgtgccagaagcgaaagcagcaacgtctcttttcctcctcctcctgtatctttccactgtctctttctctctcgttctttctgttctgttccgtgctgtcctagaaggcaggattttggtatcatttatttccatctgtctcccagcacttaaaatagtgcccagtatatagtaggcacttaataaatatttattttgttacctctttattaagctgttattttattattattattatcattattattgtgtttttttttttttgagacagggtcaggctctgtcccgcaggctggagtgaagtggcgtgatctcggctcactgcagcctctgcctcctgggtccaagcgattctccctcagcctcccgagtagctaggattacaggcatgcgccaccatgtccagctaatttttatatttttttagtagagacggtgttttaccatgttggccaggctggtctcaaactcctgacctcaagtgatctgcacacctctgtctcccaaagtgctgggattgcaggtgtgagccaccgcatttggccacttaagaaatacttagtagacacacgaagactccctggtacgcagcctgtgtctccttcccttgcgtctctgcctgtcactgagtgtctcttggtctgtttgggtctttttggattgttctttatctttatggatctctgagtatctattcttataaatgtaacaaaacaaaaatgtttatgtggttggaatattttcttagaacattttttaaagggaacagtttaaatttttagtgttgaattcttaatatggagctaaaagaagactgcagttttactgcttttaaatacacagtgtactttgaagtaagttgaaattccccaggagtgagcttaagaggctcctttacaaataatccccactggaaatcaacagcctttgtttgcatttagttcactccccatgaaggccttttcctagtgtaacgacacgtccctggaagttttgctaccagcatttccaggagtgtggtctgcagccagctcatcttgcaggacatttgggcgataaagaaccccaggctcaaagaagcgtgggaaataatgcatactccagccccctccctcttggagacttacagtaaacattagcaaattaaaggctctgacaagtcctgcaaggagaaaaaatctattaactgtttaaccttatgtgtcccaggtgtacttgtccgcacctctttagtgtctgtgcaactgcacatttgtctcttggaatctgcctttgggaatgtcaagtttatgacgttgtttgttgttgtgggttttgagacagagttttttttgttgcccaggctggagtgcagtcgtgtgatcttgactcactgcaacctctgcctcctgggttcaaccgattcttctgtctcagcctcttgagtagctgggattataggcacccaccattactgcacccggctaatttttgtattttcagtaaagacgggattttaccatgttgacctgggtagtctagaactcctaacctcaggtgatctccccatctcggcttcccaaagtgctgggattacaggcgtgagccaccgctcctggcctagttaatgacattgtttttatttcagagcaaaaccctttctttgattatacagtgcctttagaaagtatacattgtggttgggtccaaattaatgacctttagctgttgttttaagaaatgttttatcattactttcaagttcctgccataaaataagatgaatgaaccatgagagctagattaatggaagaaaattccaaatcccgatgggatccacattgctttctgtttccttaaccccagctttctgctatcctggcactattagcatttcaggccagatgattatttattattggttgtttggcctaggtaaggggagtgctagaaatgtatataaaatatttatcttttcccaaatgttttagttggtgtggtttgtgtatattatgtctgaaatttctgtgggttctatggtaaggcaccactgttgacattttggctttttaaaagttaggatattcaagtcagcaggttaattatttgagaatttagagtaagaatgagggtacctgggacctgctgtcagctttgccctctctagaattcccttattcaagaatcttctggctgggcgcggtggctcacatctgtaatcccagcactttgggaggctgaggcaggttgatcacctgaggtcaggagtttgagaccagcctgaccagcatggcgaaaccccgtctctactgaaaatacaaaaattagtgggcctggtggtgtgtgcctttagtcccagctactcaggaggctgaggaaggagaatcccttgagcccggaggcagagactgcagtgagctgagatcttgacactgtattccagcctgagcgacagcaaggcttcgtttcaaaaaaaaatcttcaggggctccccttgcccctctgataaagcccatgctccccaccaagtataggcccccttgctgtccctggtgtgttttctgccagtcgttccctcacaggattgatcgatgttcctgtcacgctggcctttctgttccttgaatgtgccaagtacttttcacttccaggccttcgcatgtgctgttccctcggacttgaatgctcttccctcttctcctcatgaaactgactcattcttcactttttggttcttgtctaaacatatgtttgagctgagcatgatggctcatgcctataatcccagcacttcaggaggccaaggcaggaggattgcttgaggccaggagtttgagaccaggcttagcaacatggcaagattttgtttctacaaacgtaataaatatatagagaattaactacctcagcattttcattagcaaaatacacaaaacaaatatccttactctagcctttattctcatgctgtttgtgatacctgacatatggaaataaaaataagcctttgaaatggatgcttgatataggagtctttgcttcaatttttagcaaggatatttcctcaaagatccttcccggatgtcccaaactaggtcagtcttttaatttttttgagacaggatcttgctctgtggtccaggctggagtgcagtggcacggtgcaatctcagctcgtggtacctccatttcctgggctcaggtgatcctcccacctcagcctcccaagtagctgggactacagatgcacagcgccatgcctggctaatttttctattttttttagagatgggatttctctatgttgtccaggctggctttgaactcctgacctcaagcagtctgcctgccttggcctcccaaagtgctgggattacaggcatgagccactgcgcctagtcaagttagactcttaaaaagtgtcatatatctttttatctttgcgtccaccgtaactgtaatcaagtagttttccgtcacctgagggacttccactctttggaagcaggggttttgatcaccgctgtaggcattgagttaatagctagctactaagtaaataactgtaatcttatcaacgaggatatcaactctttgactcctgatattggagtcagtgattcacctgctgtgggttctgatcccagccctggcatctgttgtcctttgtgagtcagtttccctcttgccaaagcaatagttgtgatgaaaatgacttgtgaagtgaggccctcctagcaggcgggtgggccagctgttgtctcgttgatcagatctgtctgtgtgtctgtctcacctcgttctccatttgcaacttagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaaggtcagtataggttggatgttggcccctgaatcagtcagctgttgccgcgtaacaaatgctctcacaatctcagtgggctgtgagtctgctgctatcagctgacccggcagggctcagctgggcggctctgctgcacgctgcaggccagctgaacttgggtccaggctgtgggtgtggctcaggtctcacttacagagcttttgctggggaccggggtgaggggtccacagctttccaaaggggggctcttctcatggtggcagcagaggcccaagataggccccccagaaagcatgcaatgtcccttaaagtacactgtcccttctactcacaaagcaagtcacttggccaagctcaaaggcaagggaccaagaaggaagtacattctacctttgtggtcacatgactgcagagtcacatgacagagggcatgctgttgggaggaggggagtcgatgattcatatgttcacagtccctgtcaagatagccataatactgaaaatagcacaatagctaacacttactgagcattttctctttcttttctttctttctttttatttatttatttatttttgagatggagtcttgctctcttgcccaggctggagtgcagtggcacgatctcagctcactgcaacctctgcctcccgcgttcaggtgattctcctgcctcagcttcctgaggggctggaattacaggtgcatatcaccacactcggctaatttttgtatttttagtcgaggcagggtttcaccatgttggccaggttggtgtctaactcctgacctcaagtgatccgctggcctcagcctctcaaagttcttttttttttttgaaatggagtctctctctgtcgcccaggctagagtgtagtggctcactcttggctcattgcaacctctgcctcctgagttcaagtgattctcctccctcagcctcttgaatagctgggactacaggcccctgccaccacgcacagctaatttttgtatttttattcgaggcagggtttcaccatgttggccaggttggtgtctaactcctgacctcaagtgatcggctggcctcagcctctcaaagttctttttttttttttgaaatggagtctctctctgtcgcccaggctagagtgtagtggctcactcttggttcaacctctgcctcctgagttcaagtgattctcctccctcagcctcttgaatagctgggactacaggcccctgccaccacgcacagctaatttctgtatttttagtagagatgggatttcgctgtgttggccatgctgatcttgaactcctggcctcaggtgatctgcccgcctctgcctctcacaatgctgggattacagatgttaaccacctcgcccggcctataacttgagtattttctgtatgttgggaactatgctaaacattttacacgtaattcttccccacagcaagcccatgggtggaatttgttgttatacctaggtaatcattgaggaaaaaggaggcacagagaggccaagtgacttacctgaggccacacagccacagagctgcagagagcatggttcctgtgtccatgttgttacctgctcattttgtcatctctaaaagggccattctctgcctctcaccactgcagaccctccctcctgctgtgctccatctcccaggttttcctgctgcttcacagcaacccccagcccctgcccacctccacaccttggtctgagccttcaaggcctggggtgcctcccctgctgcttgcctggccactttgctctggcaccccatggtggtcgtctggtgtgtcccctcttggaagaccaagagtgcaaagcactggcccatttctgtttttagttacaagccaggggctctgtcggctttcttacgtggtgaatgatgtttaaaaattgagataagcctgcagctccttggaaataaaaaacgaattattggctgggcgcggtagctcacgcctataatcccagcactttgggagaccaaggtgggaggattgtctgaggtcaggagttcgagaccagcctgggcaacatggtgaaaacccacctctactaaaaatacaaaaagttgccaggcatggtgccgtgcacctgtggtcccagccacttagggggctgaggtgagaggattgcttgaacctgggaagcggagattacagtgagctgagattgtgccactgcactccagcctgggcgacagagtgagattctgtctccaaaaacaaaaagaaggcacgtggctgccaggaccccacctcagtgcatgggagtcagggcaggcatctcaggagggactgggcagtaacctgtgatttccagccaaatagggaaacgacgttggcttatctgtcatggtgggagctggcgctgctgctggtccatgcattgtccttcctcctggtgactgggatgtgggctggatttcagcatccccaggccggagccttgcttcacctatatgtggctttgccagacagtgacagatccagagtaagctggcaaacatggcagctgtcaccaacagcagcagtaacaataatatgaccacgtccaccagcgccttccatgagactaagggatcacggccttcccactggtcaacatgatttggtgccgtcagccatcctttgctgagcacttgctgtgcaccacgtgccctgctcagcacctcacgggagattcaggttttctcttttgcccagttgacaggtggggctaaaccctgtgcctgtgatcccatccttggtggtggtggagctggggcctggctccaggtttgtgcaggcgtgacctcatgccttcagcatcaaacttaaagaagaggaggtgggtgcagctctgcagggccttcacccaggacctgctgtgtcctgagcaggctctatgcctttctttctttcttgtttaaagagacagggtctcattctgtcgcccaggctggagtgcagtggcccagccatagctcgttgcagcctggaactcctgggctcaagccatcttcccactcagcctcctgaatagctggaactacaggcgcacatcagcaggcttggctaattttttcttttcttttcttttctttttttgtagagacagggtctccctatattgctcaggctggtctcaaacccctggtctcaagcagtccttccaccttggcctcccaaagttctgggatcacaccacactcggcctgcttctacgtattgtgagtctcaagatttcccaggaaacccactcctgtgtgtgtctctccccagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaaggtgcctgctggcggggtggggcttggtgttgggccgtctcgccctttggttaagtcagaacgtgtcccctttaggagtcctttactttctctggctttctttgtttttaattggactttaaagaacacatttctcatgcttgtcttggaagccttcctaagacagccgtcttgtacttgtctttataggggtaagtcctccgcgcagagttaaattcattgcctctccatggccaagggaggcctctcttcctgattaagtcacagggctggcttcttagcggggaatcccactccaagacattgcctgtgacctagcaggctgcattttcttacttgcagaggtgtctgtgggtagaggggtcggaaaattgccacaacaccttaacataataggaaatagttcctgtgttctttttatagggcagttgtggtaatgggtacacactggctcttttttttctccccctgattttatttttttgaggtggagtttcgctactgttgcccaggctggagtgcagtggcatgatctcagctcactgcaacctccgcatctcgggttcaagcacttctcctgctttggcctcccaagtagctgggattacaggtgcccaccaccacgcctggctaattttttttatttttagtagaatcgaggtttcaccatgttggtcaggctggtctcgaactcctgacctcaagtgatctgcccgcctgggtctcctgcaatgctgggattacaggcgtgagccaccacacccggctgtttctgctgattttaaaactaacacatccccatggggggcatatagattaagaaaaacatgaaaaagaaaaatggaagcagttacacacattccactggttagaggttttgtatttttttcaagtctttttgctctgtgtataaactttttaaatagggttatcttgttccacgtatatatacaggaaacatcgtgctacatgacctcttgtaatcgttcccatacataccactaacattctgtgtaaacatattttaaaatagtacaaaacatttttgaaaattactaagtaatacatgcccattgtaacaaaattgaaaagtacaagaatatggatatcttcttataatatatgtgtgtatgcgtgtgtgtgtgtgtgtgtgtgtgtgtgcatgtatataaagtaaataaagctgggcacggtgagtaatcccaacacttttggaggcctagaccagtggatcacctgaggtcaggagttcgagaccagcctggccaacatggtgaaaccccatctctactaaaaatacaaaaatcagccgagtgtggtgatgcatggctgtaatcccagctactcgggaagctgaggccggagaatgtcttgaacccgggacgtggaggttgcagtgagctgagattgcgccactgcactctagcctgggtaacagagcgagactccgtctcagaaaatatatctaaataaagtaaataaaatagtccctcttcatcctgcatccctaatctttaattcttctcttagagagcaagggttagcaaatctggcccactgcctgctttttatatggctcttgagctaagaatgatgtgtgtatttttaaatagaagaaatctaaacaggaagaatattttatgacatttgaaaatcgtattaaatttagatatcagtgtccataaataaaactttattggaacatggccaatgtattttttttctttttttttctgcagacagggttttcctctgttgtccaggctggagtgcagtgccacagtcatggcatggtagcctccagctcctcggctgaatcaatcctcctgccttctgagtagctcctgggaccacaggcatgcagcaccatgcctggctaatttatttttatttttattttgtggagacaggtctcactatgtttcccaggctggtttcaaactcttggcctcaaggaatcctcccgttttggcctcccaaagtgctgggattacaggtgtgagccaccgcacgtgtcctgttctttaaagcatcgtctacagctgcttcaactcggcagggctgagttggtgccatggcaactgtaagatccataaagctgaaaagattgaccgttagctgtttaaggaaacatatgctgacttctattaatagtttgatgaatgtcttcccaaactttcagatttgcagataaaatgtatgcatgtgcatattttgtagtggttttgggggtggctgacagcgggagttgttttagaaaaaaattaagccagagctgggcacggtagcgcatgcctgtagtcccagcacttttgtaagccaagggcgaatggatcgcttcagttcaggagttcaagatgagcctggacaacatgatgagacccctgtcttgacaaaaaatacaaaaattatctgggcatggtggcacgtatctgtagtcccagctacttgggaggctgaggcaggagaatcgcttgaacccaggaagcataggttgtggtgagccgaggtcgcaccactgcactccagcctgggcgacagagcgagaccctatctcaaaaagaaaaaaaaaaaagaagaaaaaaattaagccattgggctgggcgcagcggctcacacctgtaatcctaaaactttgggaggccaagataggcagattgcctgaggtcaggagtttgagaccagcctgggcaacatggtgaaacgccatctctactaaaatacaacaacaaaaaaatcagccaggtgtggtggcgggcgcatgtaatcccagctacgcgggagggaggctgaggcacgggaattgcttgaacccgggaggcggaggttgcagtgagccgagactgtgccactgcactccagcctggacaacaaagtgaaactctgtctcaaaaaaaaaaaaaaaagccattgcatacaaactgttttgctgtggcaccatccttttattcctttacacacttgtatggttccctccctacctcttgtcattcaggtttttgttaaaaaataaccttccccattacctttgttaaaattgcaaaacccgcacacttggtacacccgttcccctttttgctgtgtttttgccattcagcaagcactattctactagtgttcgtttctcctgcggccctggaatctggggcaggggtctttgtttccttccccttccccagcttttagctcagcacctgaggcgtggcaggccctttgcacatgcatgttacaggaccgtgtgcacaggttcagctgctcctggatgctgttatcgcgggtgcatgtcccaccttcagacctgagttttgcccaccaggtgttcgtcggctcattcctcctttagtcttcactctgccaagctaggcagtctcacacatgtgcactcacgtggccgggtgtcccctttgcccacagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggtaggggcagccccagggttccacccactcagggtgtctggcaccttgaagggccacattggcctctttgaggttgccaccagccacttggggaaggcggctcctcagggcatgagggtgggagctggatggagccccctaaagaagcaatgtggaaaaccaccttagtccctgcagtgctgaactgggagagagtctcggtgctttatggccaggggatgggagcaccaggcttcagctcagctgacctcagggcagggtctagcgccttcctggaacatgaccttggacctgatgagtttcagggtccttatggcaaaaatgggaatgatggtaattaaagtcctggctctcggggctgagagaaactgaggacatacgtgacacaagagatgtgagggttgtgaggtgaagcacggagttaagctggcaggctcgggttggtgacgtctgggttcaatccccggccgctcatctccccagctatgtgacctgaggcctgcccttcagacccatctgagcttcactttcctccctcataaagcagttcagcagggccagacgtggtggttcccagcacttgtaatcccaacacatagagaggctgaggtgggaggatcgctccagctcaggagtttgagaccatcctcagtagcatggcgaaacctcatctctacaaaaaatacaaaaaatttgccaggcacagtggctcacgcctgtaatcccagcactttgggaggccgtggtgggtggatcccttgaagccaggaggaattcaagaccagcctggccaacatactgaaaccccaactctacaaaaaaaaaaaaaaaaaaattcagatgctattaagtgctttggaggggaaacaaaaaagacaatgccatgggctgaggagtgatgggtgtcattgtggcaactcaggcaggggatagggaaaccctctctggggaggttgcattggcatgggaaggagccagcagggagaagatctgggaagtgttgtgggcagagggaacagccagtacaaaggcctcaggaccagcatgagctcaatttgtttacaaaacaaaaagggtggtgtggccagaccatggtgtgccaggacgtggggggcaggagaagaggtcagcacagtgattgtcctgcagggccttccaggtgggttttggtctaactgccctgggaagccactgagtgtcagagaggcaaagtgaccagccccaggatacacagcagctgctggcagggttggttctcaagttggtctctgagtttctcatcctttgcctggggtgggagctccttctctgcagaggtcctagtgatctctaataagtgctttcttgagatgtaattcacacacgtaggctgggcgcagtggctcacgcctgtaatcccagcactgtgggaggctgacacaggtggatcacctgaggtcaggagttggagaccagcctggccaacatgatgaaaccctgtctctactaaaaatacaaaaattatcctggcgtggtggcgcacgcctataggcccagctactggggaggctgaggcaggagaatagtttgaaccttggaggcggaggttgcagtgaaccgagatcgtgccactacactccagcttgggcaacagagcaagacttcgtctcagaaaaacaaaacaaaacaaaacaaaaattcatacaacatacaattaacccacttaaatcacaaaatccaaccatcaccacagtcaggtttagaactttttttaatcacccccaaaagaaaccccaatccatcagccatgactccctattttccccagcacctccgaagccctaggcaaccactaatctttctgtctctctagatttgcttattctggacatttcatataaatgccatcacaataggtggaatgttgtgactggcggcttttacacttagcgtggtgttttcaaggttcgtctatgttgtagcttcatttccttttattgcggaataatatgccattgtgcagatagaccatactgtgttgatctgttcactggttgatggacattcaggttttttccactttctgactcttgtgaatactgctgtcatgagccctggtggttttaaaggaaaagttggtggccgggtgtggtggtttgtgcctgtaatcccaccactttgggaggccaaggcgggtggatcacttgaggttaggagttcaagaccagcctgggcagcatggtgaaacctcgtctctactgaaagtacaaacattagctgggatggtggtgcacacctgtagtcccggctattcgggaggctgaggtgggggaatcgcttgagcctgggagtcaggctgctgtgagccaaaatcatgccactgcactccatctggcctgggtgacagagcaagaccatgtctcaaaatacagttggatttttgtttcttgccagtgcatgatagctgacattcccttcagcttttaaattatttgattagactgaatttctgcatgttcattcccttgtggttgggaagttctaccttgagtctagcctgtttcttcttgctgcagaatccccctttgtctatctctcagcccgagcaatgcattgtggcaacttctcggtgactttttcactgacctgcttggcaggctacttttaggtgacaataccctttgtgctctctaaatcaaaatgtgtgggtttagctgaatcttttgcccagcgtgaggtctgtctctctacccttccgtccaggtgagcaaaaaatgtccttaaactctcttggccccagataggttccgcacccccgcctttctttcccagctgctagagtatccaagcagtgtatacagaacatggaaggctgccagatgctttgtgatttttgtacacatcagcacttaatttggtgatgcaaatgccgcccaccaccctggcacctcgtgcgttcattttcccagtttgacctccctacctcctgcctttgaggttacatagaagtccttggcagtgggtcttacatcaaactggggcacccccctctctcaccacccacccttttccattgctctggaggggccctggctataaagtcttgacatcagggtctggtcttgcccagccttagccaactcgaagcgccaatgaccttgggtttgtttaaaccacatttttggctcttcctaaaggggaacttttttccttgttggattaatcagctcttttttttagaacacccaggctgaaggggtgcaggtgttggtatttggtttgggagaatccttgaggggggatgggcaggaaccaggcttgtgaatggggccataccgacctctctcccgggatattcagtttactgatttctaagaaatatatcttttttactgtttgtctccctctctccttttttttttttttttttttttaacttttaatggcattccttttattcctaatttattcccatgccataagcttttgtttcttcaatttcttctgggatatatttttcttctgtgcagcctccccttccggtttaggaacagtttgttccctttcaggcaggatcatctggatgtggcagagtgagctcacgtatgggttaatccgaccgaccctgagctctgtaggtccggcgacgcaacttaggtgctttcttcagttggatatgctcaaggaccagagaatctgcatctgaacccttaagttcagtgtgactctctgtatttttaagcatgtgcagcagaaattcagtgctctttttgggccgccgaccttgtggccagccccacttcttggcctgggtacatctaccaactccaccattataatgtcagaatggtacatgttgtttctgtaaagtggcatctttctgatactttgtggccttttgtacgtgcatacctttgatggcctgggcgctttcaggagtgttctttttctttttcttttttttgagacggagtcttgctctgtcgcccaggctggagtgcagtggcgcgatcttggctccctgcaagctctgccgcccaggttcacgccattctcctgcctcagcctcccgagtagctgggactacaggcgcccgccaccatgcccagctaattttttttgtatttttagtagaaacggggtttcaccgtgttagtcaggatggtctcgatctcttgacgtcatgatccgcccgcctcggcctcccaaagtgctgggattacaggcgtgagccactgcgcctggccttttttttttttttttttttttgatacagagtctcacttgttgcccaggctggagtgtagtggcacgatcttggctcactgcagcctccacctcccgggttcaagaaattcttgtgcctcagcctctcgagtagctggagttacaggcatgtgccaccacgcccagctaatttttgtatttttagtagagatggggtttcaccatgctgaccaggctggtctcaaactcctggcctcaagggatcctcctgcctcagcctcccaaagtgttgggataacaggcatgagccaccatgcccggcctcacaaatgttcttaaggtgaacacgaagatttgaacctcttgatctgcatgattctgtggtgttttctggataaagtgaatagtgaaccattttcacagattgcctcaagccccttaggggaacaaatttttaagggatttaaaaaaatggctcattaaccttcatacctggaaggtaaaacacatcttcatgactctggtttctttcttaggaacctaatacctagagcagtggttttccatcaggggcaaattgcccccaccctggggacagttggcaatgtttggagacatgttgggatgtcaaaactggagtggggtttgcccctggcaggcaagcagggtagaggccagcgatgtcgctaaacatcctacagcactcaagacgaattcccccttaccctgccccccgtgacagggaatccccttgccaggacatccaaagcaccacgagcaagaaaccctgtgtgctccgacttcacactgctgaattcttcccttgtcctcttgggagaaggatctttattccaacaatgtggccatttttctcttttaaaaaattttatttatatatttttatgtttttttatggagatgggatatcagtctgttgcccaggctggtctcgaactcctgggctcaagcgatcctcccaccttgacctcccaaaatgcaaatgctgggattataagcatgagtcgcggcacctggcccgtggccatttttcaaaaccttgcttgaaccatctgttaacctcatggcaaatatttttccctcttaagtatttaccgagtttttcttaatgattataaaagcaacatgtgctcatcgtagacatttgcaaactacaaaagagtacaaagaatcaggaaaaaaggtggctcatatgtgtaatgccaggactttgggaggccaaggtaggcggatcacctgagggcaggagttcgagaccagcctcgccaacatggtgaaaccccatctctactaaaaatacagaaatgtcaggaggctgaggcaggagaatagcgtgaatccggggggcagagcttgcagtgagccaagattgtgccactgcactctagcctgggtaacagagcgagactgtctcaaaaaaaaaacaaaaaaacaaaaaaaaactcccgagaaagaacatctttctgccctcactgcccagaaggggagctgttgttagctttggcatctttttcacctgtccttccttcctaggccttctcccttgacaagattgagagtatatcttagagttttctcatctcctgccaccttttgatttcttttcttaacagtgggccataagcacctccccaagttacacaaattagttgtcagcacagagcagctgccgagagagttcatcagacagacccccacattccttctggctgtcctcagaggccggatttcttcctcttttgaggatgaagagctttctctgccgaggctgggggaggaggtcagtgaggcagccagtgaatgccgtttttggtcaaaaatgaggcgttgactataaagctgtgagttgaattcttccctccggggaggctggcctgctggaccttgcccaagcagagttccagaaccttcttgagtaaaggcagtgttggtggaataaacagtgagaggactggcaacggaatacacagacccggggcagcacttaacgtacgtgggtcaagggtagaaacagcacctggcttgacagcatccaaaacccaacacctggtggttgcatgaactcagtgacagtcactgaattacaagtttcgtgtgtttgctttaaaaaaaaaaagaaagaactcttgctactttatagcattctccaccctggcccccagccttcatgtccctcttcttccctgctttgattactttgtggcacttattgctgcctggagtaaattatggatctacttgttcatttattgttgatctcttcctttggaatttaagatctgagggttttgtttgtttgttttgttttgttttgtttgttttgggagtctcacgctgttgcccaggctggagtgcaatggtgcaatctcggctcactgcaacctccacctcctgggtccaagtgattctcctgccgcaacctcccaagtagctgggattacggatgcctgccaccacgcccggctaatttttgtatttttagtagagacggcgttgtgccacattggtcaggctggtcttgaactccggacctcaagtgatccacccgcctcagcctcccaaagtgctgggattacaggcatgagccatcgtgcccggctgctctgagggctttttggttgtctctccatccccaggactaagaaaagagcctgacacatagtagacactcagtaaatgtgttaaatgagtggatgaatcgcaccttggctgttcaaggcatgtcctgcataagcagtgggtaggccggagggctttggatgtttacactgcagataaatacctcagactaggagaaaataggagtggatttcaccccctctcaggtctgctttagaaagcagctttgtcagtcctgcctatgagaggggcccctctggcattgggaagtcagctctgcttcttgacttgactatacacttgtcagtctgcccatctgtctgtcgggtgtgtacagagtgcctgctgtgtgccacaaggccacctggtacgtgagcctctgtgtggaatggtgccccccacgttgagttgtgcagtgtgcatcttgtgtaactgcacttggccacctgctgtgccaggtgctggtgatacagtaatggatatgacccacttcatgcccttgagagctcacagtctgatgggagagacaaacgccaaacaattaagggtatcatagtgctaaatgcagtgatggagggctgcttgagggcctgggaaatcacagagaaggagcccccatcccagcctgggagggtccagggtgatatctgggctaagtcaccttttcttctcctcttgggcacatgtgcatctggctctgtgtggggccagcccctctcaggagcagtgtctgtcctcaaaggggctggagctgatgcccatgccacctcccagtgtcatgcctggcctgcctactgtaatactttatttcttttcctctcctgcgtaaaaacaagcctgaagactgaaggttggtctgcattatttgtttagctctatttatggttaaacacagttatgactttggccaggcatggtggctcacgcctgtaatcctagcactttgggaggccaaggcaggtgtatcagctgaggtcaggagtttgagaccagcctggccaacatggcaaaaccccgtctctactaaaaatacgaaaattagccaggtgtggtggcgggcacctgtaatcccagctatttgggaggctgaggctggagaattgcttgaacctgggtggcggaggttgcggtgagctaagatcacgccacttccctccagcctgggctaaagagtgaaactctgtcacaaacaaacaaacaaaaacccaacacagttatgactttggagaaaggggttggtcttgtgcagtgtgcttgtcccggatccacccagcacgtgtgggatggggaaactgacgcacaaatggagcagacccttcagccattcttgcctctccccctttagaaaagacactcccttcactcctttatttagataggggcttagggcgggagtttcgctttgcttcttaacaatatcttgggtcttctgaattcccaggcagcacagtgatggacgaggaggaagcaggtcagtactgcccgggttggagttggcttggctcatagaatgaggccagagacgggccgagactgtcgctgcatgtctggggaggtgccgtcagatgtctgtgttttcacccctccggttgttcattggttcatttagcacacatttactgggtacctactgtgtgtctggctttgaggctggcactgggggatacagcctgagtccccagatccctttattgtcactgatgaccttgggtaagctctactgtttcatgcatcacgttaccgtgaccagcatgccttgaggggaccatgcttatgaagtgcctggcacacagtggatggacaataaatggcaacagtttgattgtgagctgccacgcatagatcctggggcacagtcaagacacacatgggcccagacaatgcagggtgatcagcgcctgttggggaactgcagcaggtggtggtggggaccctgaagagggatgtcgcctagtggaattccagtggccagactggacccatccctcctgccttctgcagtgtgtggcttagggtcccagccaagggctttttttgtaagcagcagaagctgaatctggccaccttaaacaaacagagggtgtttcctggaaggataccaggtaactcatgaatcaaaggcagaactgagcaagtaggactcaggaaatgggaactctgggagactagactcttttaggacaggtgaacttgaactgtctttggtccttgtagaccactgatgacggttcaaatcctgggagaggggcttttatggggcgacctcagacagtgcccaccttggctgggggaatctgaggcaccctgattgacaggcccaccaaggctgtaggaagagggagagctgatcccttcaaaaagccaacagggggccaggcacagtggctcacacctgtaatcccagcactctgggaggccgaggtgggtggatcacctgaggtcaggggtttgagaccagcctggccaacatggtgaaaccccgtctctactagaaatacaaaagaattagccaggcacggtggtgcatgcctgtaatcccagcttcctgggaggctgaggtgggaggatcgattgaacccaagaggcagaggttgcagtgagccaagatggcaccagtgcaatccagcctgggcgacagagaagaccttgtctcaagacaaggaaaaaaaaaaatgctgagaggatggtggactaactgatgttcagattcctcctcttaggcgcttggtcctcctccgtgcagagtggaattttccagctgcccagttcgacctgtgggctaattggtgggttgagagggtaagacagccttagcgagcactgcatgcctgcagaagctcccagctgaccatggtggctgcgctcagtgacgaacaggagaagtgaaggctgaggcttataggagggtggcctgaggctgctggtaggagagcgggggggctctctgcggcatgcagcctccagatgggggtccctgggagtgttctggaacattctcatccctgcacagagaaagatggttaagggcatggctggttcccagtgtcacacatgtgtgtgaggacaggctgcatgggaagtcctgcttggtatcattcttccttcctgggtgatgtggctatttgtgttttgtttgttttttaagttagtgtttagttagtttagacaaaacaaaacagatgctgacattaaagggaatgtttaaagcagagtttctcagttcctggctgtgcctagaattctctgtagaacctgtttaaaaatgtatttagtaataagcaacacgggggtcgccatcactgaacacttgctgtgccaggcactgcgtgcagtctcgtttcaccctctcgcaaatgaaggttgggtctgctgttcctgttttgcagatgtggaagatgaggctcagacagatttatcatttccccaaggggcacagccaggaagtgagagaacacttcccacatatcacagttcctggagctctaatcgagactcatagcagggactgggctggacacgagggcacctgctcagtttttaattttaattttttggtttattttcttttattcgtgttttttagattttttttttatttttattttttatttttatttttagacagagtctcgctctgtcacccaggctggagtgtggtagcatgatttcagctcactgcaacctccgcctcccgggttcaagcaattctagagcctcagcctcccgagtaggtgggattacaggcatgcaccaccacgcccagctaatttttgtatttttagaatagagttggggtttttccatgttggccaggctggtcttgaactcctggcctcaagcgatctgcccgcctcggccttgaaagtgctggggattacaggtgtgagccaccgtgcccggcggccacctgctcatttataaagccccccgtgactcatttacaaccaagactgagaattcctggcatggagtgcctccctctgtccaggaatgatctgcagccccctcttcccttccaggtgtgtctgtgtctccctgtggctgtttctgcaagattttgcatttttgagctctgcttttattcatgtcatcacccgagcatgttcccagggtcaccctgaccatgctgctggctgcgtatttatcccttttgtatcttctgtcctgggtcctctcccaccttctctggggtcagccctgtggtgccttacattgtgctgctttctctcctggcaccaaagaatgaggcagtcagtgcggagtgggggcagtagtcatcatcatcactgagttattgtgaaccgggaaagagatatgatctgtgttgacacgacacacggtgcccaagtgcacttgataaatgttggctgtcattgtcattgttgatgttccggtgattattgttgatgctgggtggattcttcctgggatcagggcagatatccagctgctgtgtcccttggtgtccttatcagtgtccttcctaattctgcaaccaaggcatctgccagggctggggtctcatctgaagactcaatcagggaagggtccactttgaagctcacctggttgttggcagaacttggttccccagttcaaatgttgaaatactttattactgtggaaacagccactgccccaggtaccttttaccctgaactcttgggacctctctgtggtctaggaactgaagggttaactcctggcactacaggggtctccgggcctctgcctgttggctgatggccttgtcaaattggttatctattttgaatatcacttcttctttcaatgcttgggaatcacggggctatgccctttccctcatgcgtttccttgcatcctggtcctaggaagtgagcttaacatagcagggctactgttttctgggctgggttttacccattgctgctggcacaggatgctggctcaggcccagtgccctcagtggatggagccttctgcacagttgcaaagcactgtccctaccccaagggactgagctccagataccacctgccccacaaccagacagcctgttcatggcctctgcagagcaggtctcctactttctgatcatcctggcggccaggtgctctgtggtctcctcactgaagtggccggtttttgttgcccttggttttagcatctgcctcatataaccccacttgccccctttgtctctcttctgccaggggtcacgggcgtcagcggtccagggaaggaagcaaagcaaatggagaatggcatgctggtgacggacagtgcagggaagcaactgcagaggtaagggcggggaggaaggccccaacctaaggaccctgccctgccagtgggaggacaagaggaggaacaaaaaaaggcctcagccccctgaggtcctggaaggcctgggcttttaccttccctcccaaatcctccaaggaccttgcttttcagagtacagaggcccaaagaaggaatgtggcactctttttgccaggtggcacaactcacacaggcctcatgatttaaccagctgtccacgcttctgacactcgggctccctacatggtgtgggtctttgctcaggtctcttggcggggcctggaaggttcaggctttgtgaagcagcatttgatttaaaactgtctcaaggccaggtgtggtggctcctgcttgtaatctcagcactttgggaggttgaggcaggaggatcgcttgaggccaggagtttgagaccacagtgggtaacatagcaagacctcatctctacaaaaaaggaagtatgctcgtgtttgattatagagggcttccttagatccctggggatttatagcgtatgcagtatattaaccatcctagcttttaaaaaactggctaagtcggccaggcagggtggctcatgcctataatcccagcacttcgggaggctgaggcgggcggatcacctgaggacaggagttgaagaccagcctggccaacatgatgaaaccctgtctctactaaagatacaaaaattagccaggcatggtggcaggcgcctgtagtcccagctactcgggaggctgaggcacgagaatcgcttgaacccaggaggtggaggttgcagtgagccgagattgcgccatggcactccagcctgggtgacagagcgagactccatctcaaaaaacaaaaacaaaacaaaacagcagcagcagcagaaaacagtaaaacaacaacaaaaattgacaaagtcggagcctaaacgtatcagaccgcggagatctgagaaaggatcccggacctgcagttgctacaggggtcaggagagagcaaagaccatgcggcatagcacggtgcctggaacagacaaacacttcgtagatgtcgcttttgccatggttatcatccggacatggttatggtccggaattggtgggtcttggtctcactgacttcaagaatgaagccgcagaccctcacggtgagtgttacagttcttaaaggtggcacgtctggggtttgttccttctgctgttcggatgtgttcggagtttcttccttctggtgggttcgtggtctcgctggcctcaggagtgaagctgcagaccttcgcggtaagtgttacagctcttaaggtggcgtgtctggagtcgttcgttcctcccgctgggtttgtgctctggctggcttcaggagtgaagctgtagaccttgatggtgagtgttacagctcacaaaggcaatgtggacccaaacactgagcagcagaaagatttatcgcaaagagtgaaacaataaagcttccacagtttggaagggtaccccagtaggtggccactgctggctctggcagccagcttttattctcttatctggccctacccacatcctgctgattggtccattttacagagagccgattggtctgtttttacagagtgttgattggtccgttttgacagggtgctgattggtgtgtttacaacccctgagctagatacgtaagttccccacatccccactagattagctagatatagagtgttgattggtgcattcacaaaccctgagctagacacagggtgctgattggtgtgtttacaaaccttgagctagatacagagtgctgattggtgtatttacaatcccttagctagacataaagggcctccaagtcagcaccagactcaggagcccagctggcttcaccaggtggatgccacactggggctgcaggtggagctgcctgccagtcccgtgccgtgcgccctcactcctcagcccttgggcggtggaagggactgggcgccatggagcaggggcggcactcgtccgggaggctcgggccgcgcaggagcccatagcggggaggtggggaggctcaggcatggcaggctgcaggtcccgagccctgccccgcggggaggcagctaaagcccggtgagaaatcaagtgcagcagctgctggcccaggtgctaagcccctcactacccgggctggcggggctgcccggcagctctgagtgcggggtccaccgagccgacgcccacccagaactagcgctggcccgcaagcgccctgtgcagctccggttccctcccgttcctctccctccacacctccccgcaagctgagggagccggctccagccttggccagcccagaaaggggctcccacagtgcagcggcgggctgaagggctcctcaagcgctgccagagtgggtgccaaggccgaggaggcacagagagcgagcgagggctgcgagggctgccagcacgctgtcacttctcaatcttacacagcctaaattctagtgggagactccagacagtgcatgagtgtagaaggatgtaagattttctgtcgaggtgtgtggatgtgtgaagtcctaggtcatgaagcaggaagccccagctccccatttgaattctagattccatccagagttggttccagttgctccctctgccactccctgaaaactcactcttgctttcagatttgagggccacttccacctcactaggccttaactaaagacctttgcacagatctcatgggtaaggaaagtttacccaatcccaggcgctaattcaaagaggggaggtggtggaggtttattcggccttcaggaagtgttttcaggggacacagttctgggggtgcagggatgactcatatggggctcttgacctcagttagcttataatcttgtgcaggagataagtgggtagaggaaagtatagaaatttccacggcagtgagccgcagctgtgttttgcatggtctccataatttcttttcttttcttttcttttttttttttttttgacatgagtctccctctgtcgcccaggctggagtgcagtgtgcagtggcgcgatgtcagccactgaacggaaaactgtgggcgacgcaatctgtgatcatctctgggggtctgcataaagctcatgaccactgatgtgcgaaaagtgcttttttttttttttttgagacagggtcttactcagtcgctgaggctggagtgcagtggtgcaatcacggctcactgcaatttctgcctctgggattcaagcgattctcctgcctcaacctcccaagtagttgggactgcaggtgcacggtaccacgcctggctaatttttgtatttttagtagagacggggtttcaccgtgttggccaggctagtcttgaactcctggcctcaagtgatccgcccacctcggcctcccaaagtgctgggattacaggtgtgagccactgcacctggccaaataatgctttctgagtaacacgcttgcatgaaggagcagtcaggcaagatcccaccccagtgcccaccacatttgtaaaacaagaaaatcgaactagctgggtactttgccctatgtttttcatcatatgttacattttgaatctttttcatgtttgaaaaatgatctacgatgtgccctttctgttatatcttttattggcttttttttttttgagatgaattctaattgatctcagaaaaaaaaaaaaaaagcacgcactttttatataccagttgtcatgggctttttgcaggcccccagagatcatcacagattgcgtttcccatgggtctcattcctgcctgagacactgcctttctctgggtacctataaacctggagagtgacatggtggggtgtggtgcatatattcatatatatgtttacatgtgtgcatgtggaaacactccgtctcttatgccatggttcagacccacaatagcagtcccagcagggagccctccgaccctgcccaaggcatctgtacggttgacacccttgtgctttgcttctccagacagctcagcagctcctcctcctatagtggggacatcagcaggcaccacaacagcaccgcagaactgcagaaagctgaggccaagaaggaggagacctggaagctgatggaggctgacaaggcgcagacagggcaggtgagattcgctccttaagtgatgacagtggctggagtttatagagcgcccactgtgcactgggcactgtgcaaagtgccttgtctatgttaactcacctgtccatcacaacacacctgtgaagatactatttgcagcaccagaaactgaggccagagaggctaagtgacttactcacggtcacccctggtcagcggcagaactgggatttgaaccctggccaactccagggttagtacttgtagtctctgctctattgactgcctgagcagctcaggggggtctcattcgctagaggtgagctggatgctttaaatcagggcttcctgcaacgtggggttcagttgtgcatgagatggtgtccggttgtgcacagacgcattaaatgacagaggaatgtttgtttcatttctttttttaatttttatttttttgagatggagtctcactctgtcaccaaggctggagtgcagtggtgcgatctcggctcactacaacctctgcctcctgggttcaagcagttttcctgcctcagcctcctgagtagctgggattacagaaacttgctaccttgcccagctaatttttgtatttttagtagagacagggtttcaccatgttggccaggctggtcttgaactcctgacctcaggtgatccacccaccttggcctcccaaaatgctgggattacaggggtgagcaccgcgtcctgcctgtttttcatttctcatttggtcctaatgattacgtccctgagaaagtcccagttgggtcctaccctgccttctcaacctatcaaccactatcctctctttgtaacaaggagaccgggttttgagctcctgttttattgtttttaaagatcgtctattttgggcaagtgttaataattctccatttatggtggtgatccaaagtttatttttaaaaataaatgtggttttttttgtttttgtttttaaagggaatggaatttttaaagtaggtaaaaaataagcatgcagataaagaaaaacaaaaaaaaaaacatgaaaggtggtagccggggagtggggctggggcactttctcttagatctgcccggatgtgtccagagcttccgaggactgtctgttcctggcttcttccttaacttgtcatcagagtcaggaccgtaacaaggggcagaggtgactctggtgtcctctctcgccttacccttagtgaccctccaggaagccagagaagttaccccaaatcgcaggacatgggaaggaagggccagagatgccaggcccatttaatcctcatttaactccaattttatattcaaggaacatcaaagccagggggcttgttacttgtcaaagttggacccagagtggagccaggcacaacacgcttatcgtttctttgtgtcttttttttttttttttttttttttgagacgaagtcctgctgtgttgcccaggctgtagtgccgtggcgctcaccgcaacctccgcctcccgggttcaagcaatttacctgcctcagcctcccgagtagctgggactacaggcctgcgccaccatgcctagctaatttttgtattttcggtagagatggcgtttcactatgttggccaggctggtctcaaactcctgaccttgtgatctgcctgcctcagcctcccaaagagctggtgctgggattataggcatgagccactgcgcccggccttttttttttttttaatttgttttcttttttttttttctgagacaaggtctgactctgtcacccaggatggagtgcagtggcacaatcatggctaactgcagcctccacctcccggattcaagtgattctcccacctcagccttccaagtagctgtgactacatgtgtgcacccccacgcttgactaatttttttaatttttttgtggagatgaggtttcgccctgtcgcccagactggtcttgagctcctgggctcaagtgactggcccgcctcccaaagtactgggattacagatgtgagccaccacacctggccacacacttgtcatttctgacccccgagcccaccacattccactactcatgagaaagaggttcctgaacgctgcaggctaatttcagggacagcaggcaacttggccgcatgacaaagccaagtggtgaaataaacacattcttaattatgacctgtctcctcacccacatttttcattttccagaatggggacttgaaaactcaaaaggaagcagccagttacacatcagacctgttatctttcacctgttacctttcagctagaccgtagggtcagatgatttttgtttttttttctggtgaggggcagagcctcactgtgtcgctcaggctggagtgcagtggtgtgaccaacgctcactgcagccttaagcttctgggttcaagagctcctcctagctcagcttcctgagtagctgggactataggtgtggaccaccacacctagctaattttaaaattttttgtagagacagggtcttactgtgtttcccaggctggtctcaaactcctgggctcaagtcattgtcctgccttggcctcccaaagtgctggcattataggtgtgagccaccgcacccagtccagatgattttcatgacccaaaattcagcatgaaaagcttgaaatgacaatgagcacagacacgggtaaagatccctggaatttcttgaaaccaagtcaggtggtttaggtgggggctggcctaaagcagattgccctgtctctcatgtcaggcggctagacacatttgtttagccccatgctgggctccacagggaatataggagggaaagaaactccaaccttcacctcctggagcgaactgggcactgggaagatgggtgagatggtattctgtgctcagagtgaaaagagttggaggaggctggcccagttgtggtgttgaggtgacatttggccttggttgccaggcaacatgtcacacgttgcttaaaactcattggtggcttctgctttctgtcagtcttggctaaaagttggaatcctgacccgagtctcccatgccatgtgtggtctgactgcgaccggtttttccagcctcttgttccttgctgccccatgatctcctggctccagccaccagtgccttctctcagttccccagatgcactgtgttccctcctacctcagggcctttgcacatgctggttctgccaccttttttccattttcagctggtttaactcctttttttttttttccccctggaggcaatgtctccctctgtcacccaggctggtgtgcagtaagtttggcttggtgcaacctccacctcctggcttcaagcgacccttgtgcctcagcctacaggcatgtgcccccacgcctgactaatttttgtattttttgtagaggtgagatttcatcatgttggccaggctggtctcggattcctgacctcaggtgatccacttgccgcagcccctcaaagtgctgggattacaggtgtgtgagccacgatgcccagcactctttatttttttttattttttagagacagtctcactctgtcacccacgctggagtgcagtggcgcattctcggctcactgtaacctccgcctactgggttcaagccattctcttgcctcagcctcccgagtagctgagatgacatgtgcctaccaccatgcccagctaatttttgtattttagtaggcaaggggtttcgccatgttagtcaggctggtctcaaactcctgacctcaggtaatccacccgcctcggcctaccgacgtgctgggatcacaggcatgagccactgcacccagccttggtttaactctttaatgtcacttcctcgaagaaaacctcccccaatacctctctagactgcattaggtcaggttgtctgattttatactcacgtggaattgtgcaccgtttacagcccttctctgtgatgacgcatttatctgggatgattttatgggagcctatctcaccacgcgactggaagctccatgcatgagggcagagaccctgagtttgtctcttttttttgagacggagtctcactctgtcgcccaggctggagtgcagtggggcaatcttggctcactgcttctacctctgcctcctgggttcgaggaattctgcctcggccttccaattagctgggattacagatgccgaccacacacccggctaactttatatttttaatagaggcaggattttgccatattggccaggctggtctcgaagtctctacctcagttgatctgcccgcctcagcctcccaaaatgttgggattacaggtgtgagccacggcgcctggccctcgactttgtttactgctgactttgttgaatagctaaaggggaggggtgttctacgtaggagcaaaggcaggcagctgggtggcacagtgctggtgaagcccccgaccttgtggggctggggctggggctgggtgcgtgcatgtgctaagctgccttatctcctgtgatctccaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaaggttggtgccgctgtctcccaccccgcctgatttgggcccctgttgtggctttgtctaattatagaaatggatccttagagtcctcagcgttttgtgggaccccaaaccaagccaaacccagaaaaatggtagctgtcagctagtagacactcagatatttgtagagtgggtgtttgagtgctttgttcatatgggccttggtggtagacgggaggagtgctccagtgtgcccattttacagatgaggacagttgagaacagaggcctctggaagcactgagggttgggaggacccccttgagcatgtttgctttgtcacagtgacagagcttccatgaggtctcatttgcggacttttgcctgctgagtgagggcggaaattggcttatactagtaattcccaattatgggcagtgttgtccctcagggatgtttgacaatatctggagatgcttttggttgtcaaaagattgagaaaccctgctgttggccaggcatggtggctcacacctgtaatcccacactttgggaggctgaagtcaaaggattgcttgaggccagatattcgagaccagcctgggcaacatagtgagaccctatttctagaaaaaatagataaataaaataaactacaggtcacgtggtggtatgcgcttgtggtctcagctacttgggcagctgaggtcacaagattgcttgagcccaggagtttgagcctacagttagacctatgattgcaccactgccctccagcctgggtgacagagcaagaccctgtctcaaaaaataaacaaaaaaaaaaaaaccctgctctatactgttctgtgtggtcctatgggagtcctcaaatgcagcagcgttgatattaacagctggcatttactgagcatttacttggtgcttggatttgttctaaacacttccacgtgttttaacttattttatccttgcagcagtcctgtgaggtaggagttaatatttccctcattttggagatacagaaactgaggcccggagaggttgagtcagttgccaaaagtcacacagctaatacatggcagcattggcattgaacaaggcagtctggctcaggagctcacgctgttatccactgtgctacgcagtatgtgagccatgtttgcaaatacacatgtatggtccatatgatatatacacagtaaatggatagtcttgacacatttgagtacttctgtatgccaggcacattgccaggtggggacttcacattccacagtgctccgaggtcagcgtcattgtcccattttacagatgaggaaactgagagattcagtgaccagtaggaggtcccatagctggtaagtggcagagatgggatttggcagcattggctccagagcctgttacttgagcccctgcctattgggtgtcttcccgattaaagaggccgagatggaagcctctctgttcctaggaagttgctgctctggaacacacagtgcgctcctgtggattgtttgagagaagcaccagtgtctcaggatctccaggaggtggctttgggaaaacccagcggtagcagagcacacatggactccttgagtctctcaatccctcccctcccctctccttgccattaggggaaaggactgtggcctacaaattataattgagggaaggtagagaacagagagggtgtggtattacctgaactcacacagcaacaacgtctgttccagagctgtgctgtctggtgcggtagtcacaagacacaggtggctattttaatttcagctgttaaaattaaataaacgttgggcgcagtagctcacgcctgtaaccccaacactttgagaggccaaggcgggtggatcgcttaatccaggggttcaagaccagcctgggcagcatggcaaaaccctgtttctacaaaaaatacaaaaattcgctgggcgtggtggcgcatgtctgtaatccctgctactcaggaggctgaggtgggaggattgcttgagcccaggaggtcgaggctgcagtgagccgtgatcacagccctgtactccatcctgggtgacaggatgagagagaccccatctcaaaagaaaaataaaattaaagatttattcgattagactagacacgtttcaagtgctcagtagccatcatttcagaaaattatctcagcactgttctaaaacagcgatccctagcctttttggcaccagggactggtttcatggaaatggtgggtggtgatttcgggatgaaactgttccaccttagatcatcaggcattagttagattatcagaagaagcgcacagtctaggtcccttgcatgcacggttcacaatagggttcgcactgctaggaggatctaatgccaccactgagctcacaggaggcagagctcaggcgctgatgctcaggaggtgaccaccactcacctcctgctgtggggcctggttcctaaccggtcatgagctgctgccaatctgtggccccggggttggggacccctggtctagaagaatatggcatggggattaagagcaggctgtctggattaaaatcccagttctgcttctgctaggcacagtatactaagggcaaaggcgttcacctatctggacttcagttttcttatctgtaagttgggtagtaatagaagttattcagagtcatcataaaaatcagttacatgtaaaacccagcacagtgcttagcacataggaagtaccctctgaataatagctgccattatcatcatcattattattactatttttttttttttgagacggagtctcattctgtcgcccatgttggagtggagtggacgcagtcttggctcactgcaacctccacctcccggattcaagcaattcccttgcctcagcctcccgagtagctgggattacaggcgccaaccaccacgcctggctaatttttgtatttttaggagagacggagtttcactgtgttggccaggctggtctcgatctcctgacctcaagtgatccacccacctcggcctcccaaagtgctgggattacaggtgtgagccaccatgcctggttcatcattattattattattagaagttgggagtccaggcctgcctcgtccacatggccactcctccctgcagtgcctggtcagctccctctctgcattgtggagttttaactccgagtgtctgcagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccaggtaaggggtgaggtcttagtgttcgggacaagccctactgtgcattatataccagtgttacctaaagccttgttttatcttaccatgtccccagtgtggtgcttttgaagcatgtagatttgtttttgtcagtttcgaatacctaaattgtttttttgctcacaataacaaaatgcactttttttgtggaatgcagttttttcctaagttttacttttccacctgtcaattcaaaaaggaaacaaaacctatcactataaagacaacttcattattaaaatttctttttttttcttgagacagagtctcgctctgtcacccaggctggagtgcagtggcacaatcttggcttactgcaacctccacctcccagttcaagtgattcccctgcctcagcctcctgagttaacaggtgcgcaccaccacggccggctaatttttgtatttttagtagagacagggtttcaccagtgttggccaggctggtctcaaactcctgagctcaggtgatccacccacctcgacctccccaagtgttgggattacagatgtgagccactgcgtccagcctaaaatttcttcaagtataaaattctttagttcttaagcctcctgcaggaggcaggaactaaacaaaaaacatgactaatagcagcctaaataagatagacgttttctttttctctgtcataatagaaatttagaggtaggctgttcagggctggtatggcagcttcatgagtttaatatcccagatacctgcttttatttaaaaatttaaaaaatcttaccatatttatacaagcctttcattctttctttctttcttttttttttttaatttgacatggagtctcgctctgtcgcccaggctggagtgcagtggcgcgatctcggctcactgcaagctccacctctcgggttcacaccattctcctgcctcagcctcccgagtagctgggactacaggcgcccgccactacgcccagctaattttttttgtattttcagtagagacaaggtttcaccatgttagccaggatggtctcaatctcctgacctcgtgattcgcctgcctcagcctcccaaagtgctgggattacaggcgtgagccactgcgcccggcccctttcattcttaagttggcctcatggtccaaggtggctgctggagctccagccattatatctatatttcagtcagtgagatcaaggaagggaagtagggcaagggagcatatgggtgctgaatcagcactactcccttatctgcaggcacacattctaagactcccccaatggatgccttaaactgcagatagtattgaatcctacatatcctgtttttttctgtacatacatacctatgataaagtttaatttataaatttggcataatagattaatagcagtaatttataataataaaatagaacaattataacaatatgccagtatcactacttctccacattagaggcgttatttttattacttttttttttgagacagagtttagctgtgtccttcaggctggagtgcagtgatggaatctcggctcactgcaacatctgcctcccgggttcaagtgattctcttgcctcagcctcccaagtagctgggattacaggcatgcgccacacccagctagtttttgtatttttagtagagacgaggtttcaccatgttggccaggctagtctcaaactcctgacgtcaagtgatccgcccgcctcagcctgccaaagtgctgggattacaggcattgacccactgagcccagccaggggcattattgagtaaattcggattacttacccataagcactgcagtacaatggccgtcagtctgataaccgatatggctattaagtgactaaactgacagggagggtctgcagcatggacctgctggacaaagggatgattcacaccgcggatgggactgggggggatttcatcacactactcagaagggtgcacaatttaaaacttacacattatttttggaccacagttgaccatggataaccgaaaccatgtgtgttagtttgtcctcatactgctatgaagaaatacccaatactgggtaatttattaaggaaagaggtttaattgactcacagttccgcatggctgaggaggccatggcagaaggagaagcaaacatgtccttcttcacatggcagtaggaagaagaatgagagcaccacgaagtcggggagcccccttataaaaccatcagatcttgtgagaactaactcactatcatgagggttgggggaaactgcccccacgattcagttatctccacctggtccctcccatgacacatggggattaagggaactacaattcaagatgaaatttgggtggggacacagccaaaccatataaccacggaaagtgcaaccttggattagagggacacctgtacatctaattgtccagaacttagtcatgggaccacctctattcacaagggaccctggaaagtgccgtgttttagctgggcacattgcacttcccagcaaaaactttcagttgggcctaggcacggtggctcacgcctgtaaccctacccctttgggaggccgaggcgcgtgtatcacctgaagtcaggagttcgagagcagcctgaccaatatggtgaaaccccacctctactaaaaatacaaaaattagccaggtgtggtggcatgtgcctatagtcccagctgctctgaaggctgagacaggagaattgcttgaacctgggaggtggaggttgcagtgagccaagattgcatcactgcaatccagcctgggcaacagagtgatactctgtctaaaaaaaaacagagaagtttctgttgggaaaggagaaattgtgtaggcagtcagtcgtctctgctgcatcccttctgcagaaacggttatatgttctttgttctttgaacacatgtggtttcttaggatatcgcaggatagataatgttttcaattgacaggtggagcatcttgctaagtgggagagctgagagtgcaacctcaagtctgtccaattccaaaactgctgttaccgctaaaggattaaccgcagcacaattgccagtagggatgggttgtttagatgggagcattccagctgcaaagcaaaacaagagtaagaaaccatgaggctcaccatatctcaaaccacgctgcacagctgttcaggtggcatccagggggccttggttcaatcatgtggcccctgcgccccaccacactgtggcccaatgattgatgagaacgaacagtgatggaatcagagagagtaggtccagttcctggagtctcgttatatcctcttgaaattggtgccagcttttttttttttttttttttcccctgcatttaccaaatatgttatctgtgttcatacgcaagctggaaaatttcctgaaagacccaaaaagaacaaaacaggccaaatgcagtgttgaaggcaacttaaatgtctgccaatagcaggaccttgggtacaccgtggagcaatgtggctttgagcagggataattagaagacgcagctgttggagcaccaaggatttttatttttcaacaacaaaggaaatgattttagcaaaggaccaagttctaggtgcactgtcgttatcaccgagatgaaatgcataatgtgtgtgggcaggactggaagggaggcagatacatgaaaacatcgtctttttaagggttgagattatagaatagttaattttttaatggcttttggctaaatttacatttatcctctcactaggcagtctcattcctaagtgtatattaaaaaaaaaaaaaaaaaaaaaagagcaaaggcagtgcttagaatgttctcagcatcttgattcataatcgcccaaactggaaacagctcaaatgtccattaacaggaccgtggagaaataaattgtgatataattatacaatttatggttgagtagtaaaaaggaatgaaatgctaatacacaacaatttgggtttatctcagagatgttatagtgatcaaaagaagccagacgaaaaagagtaggtactgtgagatttcatttatatgaagttcggtcgggtgcagtggctcatgcctttaatcccagccctttgggaggcctagacaggaggattgcttgggcccaggagttcgagaccagcctgagcaacatgggaaaacctggtctctacagaaaatacaaaaattagctgggtgtggtggcgtgaacctgtagtcccacctgcttgggaggctgagatggaagggtcacttgagcctcggaggcggaggttgcagtgagctgacattgtgccagtgcacttcagccttggtgacagggcgagttgtctgaaaaaaacatcagatcggcagggcaggtggatcacctgaggtcaggagtttgagaccagcctggccaacatggtgaaaccccatctctactaaaaatagaaaaattagccaggcacggtggtgggcgcctgcaattccagctacttaggaggctaaggcaggagaattgcttgaacctgggaggcagaggttgcaatgagccaagattgtgccactgcactccagccagggtgacagagcgagactgtcttaaaaaataaaataagatcattcctgaacaaatattcatctcaggttagatttttccagtaagtaaggttcagaggcagtggcaagtggaggaaagtgaacaggtaacacacttgagagcgatttgcatctggattgttcagaaagcaagctggtaagagaggaaggagatgtggtccagggtaagatggggcagatcacctgggccttcagccatgcagaggggtctggatttcatgggaggcggtgggaacagctggagaagaaattatatctgatccacattccaggaattggcagaacagctattctgagactgcgtggggttgtgcggtacctgggttcacttacatagcttctggggccccagaagactctccatctgtgggttgcaattaacgcccgtgccgccacccaggaagaagctgccaaccacagaggccttgtaaaagccacctgctgctattgatgctttttgttggactctgccccaaagcagcccagtacacctggcccagggcaggatgcagggaggccgagttcctagcaaccctttgttagttttcccagctctcctgtcgataagcaattgtaggcaccttgtggaatcaggaaccccgggctcaccagttccttttgcgtagatgagaaaaacctaggctaggagagcgcagtgtcctcacatggctggtgcagcctctgatccacagctccacaaagcttgcagaaggtggttggcttttgttctgaatctaacaagacttatcgggaggctcttggtgcctggcactggctgaatgcccaggttgggggaggcagagcagatgaagcatctgcccgcgagggtgggtggagctgcttgtgaaacgtatcatcgtagcccgggagctgggacactgaagcccggagaaggtgctcatggaggatgggaagggcttcccgaggaagtgacatctgtgctcccatctgctgggtgatgaggaatggcctggacgggatgggcatggtgggtggaggcaggcggcctgtgtgcagggaaggaaggggagagttacaggatgagatgagttgagggaagaagcatggttggcaactctaacagcgctgggaggccatcggaggggggtgacgagattgaccctatcctcatgggcatctcagctgggctgagtgtgctggaaccggccattgcatggacacagtcactcctgaggggatgtgatcaacaggcggaattctgtcacttaatgataacaatagtcaccagctaactgaatgcttactgttaggtcaaactatatgaaactgctaatacttatttcttatctacagaaacagctatttcctgtggttcaacctagtattaccaggcactgtgcttagtgacatcatgcatatctatatgatttatgaaataatgtgtccacgcaaatacacatcacatgtaagactgtaactcttacatgtcaccctcacaatgaccccgtgaagcaagctttgttttgtttcgtttgttttcttaataatattttatttttgtagagatggcattttgccatgtgcctgggctggtctcagactcctggcctcaagtgatctcccgcctctgcctcctgaagtgcgggtattacaagcatgagccaccccacctggccgagcaagccttgttgttcccattttacagataaggaaactgaggcttagagaagtaaagtgttagtcgtgtttatattgccagtcagtagttgagtcaggatttgaactgaggtctcgttgacctcaaagcctatgctgaaaaccacactgctggttccagaaaaccctagaggtgaaaggcttcagagaggcagtacagggtagaggttagcactttgcagcccagatggcctgggtttgaatcccagttctgccccttgctagccatgtgaccttggggaggagattaactagcttctttgtgccttagtctacccatcacatataggaatgagcacctcaggttttttgtgaggattgaatgaactgatgtttgtaaaactgcttagaacgatgcctggggctgtgggctttgtataagcgtgagctattattgtcactgtccttgtcattggtggtgctattcctgtggttcaccaggtgagtgggcacccctgtgagggcagcccggctctaacattttgcctcctggaggtatcggttacgtctagatgttctccagcacagccctgccctgggaggatggcaggagggaaccttcatcaactccccgcgtctgttctctaccccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtgggcatggtgggcctgcaggagcgggtggaggaggccgccttagcaccttgtctctttgcctcgatcttttcctcgcaccttgagctgggtataaagccaaaccccggccttgcagaaaggatggagaggcttgatgagcgcggaggacagatgaatcattaagagcagacagcggcactgtagacatgcagtgcccgcggcatttaagtgcagggacacagctcttctggagtcagaaagccctgcaagtgcttcccgttaactgtcatcctagtgatgcaagactgccagcgaccgactctgctattgagtatcttcataccgctgttcccgtctgggggtgatcatgcacccctgggtgatgtgtgtcagaagcaatttactaatactaagctaaaccatatgagattgtcatcttgtgggccagatgtcatggctcacgcctgtaatcccagtactttgggaggctgaggcaggaggatccattagattccaggccagcctgggcaacatagcaagacccccatctctcttaaaaaaaaaaaaaaaaaaaaaaagtagcccatcatggtggtgtgtgcctgtagtcctagcttctcgagaggctgaggctggaggatcgtttcagcccaggagttcaaagttgcattgagctatgattacaccactgcactccagcctgggtgacagagtgagaccctgtctctggaaaaacaaaaaaaggagatgggggtgggagattgacatcttgtggatcacagataatagcatcaatccaaaagaggcagaagtttgctaattatttgctgaatttagagaagtgtccctctcacccatttgcatccttatagacttttctgaaaaagtgacagcaccccagaggtgtcccataaccattagcccgtcttacacactctaatcccatagcgtaagtctgggtgggctaaccctgaatgattacagaccttgacttcccttcagaatttttagggagtttgtcacaatctggctgtgtctgtcggagtagtgaggatcagtcacttggttcataagggctgcaatggagaaaagatcaacaccccatcttcctagaatgctttatattttagaacattaaaataatagttctagtgctatatgatatcatacgaagcctagctttaaacaaataagatggccaggcgcggtggctcacatctgtaatcccagcactttgggatgccaaagtgggtggatcacctgaggtcaggagttcaagaccagcctggtcaacatggcaaaatcccatctatattaaaaatacaaaaaaattagccgggcatgatggtgggtgcctgtacttgggaggctgaggcaggagaatcacttgaacccaagaggcagaggttgcagtgagccaagaccgcaccattgcactccagcctgggcaacgagagcgaaactctatctgaagaaataatagaagagaagagaagaataaaataaaaagtaaaataaaatagttctgatggtacatgataccatactaaacctagctttaaacaaataagatgaccaggcacattggttgacacctgtaatctcagcactttgggtggccaaggcaggcgggtcacttgagcccagcagttcgagaccagcctgggcactctagggagaccctgtctctaaaaacaaaacaaaaaaccaaaaatttgccaggtgtggtggcatgggcctgtagtcgcagctactcaggctgaggcaggaggatcactggaacttggaaggttgaggcggcagtgagctgtgatcatgtcatccacactccagcctggatggcagagtaagaccccatctcaaaaaaacaaaatgacagaaaacatgatttctgtttctattttaaagggtaaaatagtatattttaacactttgaaatgaagagtctgggcttgggaacgttacaatgatgtttactcgtactagttacgcactcccctcccagatctgtctcgtaacaagagactgttattttctacttgtttttagccaaaaggccgagaaacgatggttattttaaatccctagtgtctcttacagttgatgtcttcttagtatttaggaatttccaggacatctttttgttgttgttaatgcactgtgtgtgtgtgtgtgtgtgtgtgtgtgtgtgtgattataggagtgacccactacgcccggctgtgtgtgtgtgtgtgtgtgtgtgtgtgtgtgtatgtgtgtgtgtgtgattataggagtgacccactacgcccggcctatgtgtatgtattttaaaggcttcaatgagaaaaaagttggttcttaaaaaggcaagcttcagattccagggaagattgcctctggagagctctgttttaatccatgggtttgccagattaatgaggatttactggcctcgtgccttcggccctccctaccctgcgcccattgtgcatgttttgaaaaagcagtgccaggaaggactctctctggaattactgcggagttacttgagttagcaaagaatccccttcctcccccaagagctgtaagccaagtctctgtagagctgactccatgcctgtttgtctgcctgtgtgtcttggcgcaggtggctggccgtgcggctggagtgtgtgggcaactgcatcgttctgtttgctgccctgtttgcggtgatctccaggcacagcctcagtgctggcttggtgggcctctcagtgtcttactcattgcaggtaagaggggatgctcttggctggattattaaagtctgttaatgggggagccagttgtccttggctttggattccagctccaacaggaatgggggagaggaacttgagaggtacggagtttgaggagcaggtacagtgccacagtgcctggtgaccaactagagcaggagacggatttgacatgtggccaggattttccccatcagtcacacagattccttagtggcccaagaggatacttccaggtacgaggggaatgcttttaaagctatgaatttccctctaagaactgctttagctgcatctcacaaatgatgatacattgtgttttcatattgtcacctggctaaaaatattttccagtttcttattatgtggcccatgagttattttggaaatgtgtgtgcttaggagatggcaatgtggcaggcctgggtgatggctatacctggggttgctaatttcggtacctttcttacctgaatgtttcataactcataaccttttatttttatttatttattttttttggagacggaatctcactctgtcacccaggctggaatgcagtggtgggatctcggctcactgcaacctctgcctcctgggttcaagtgattcttctgcctcagcctcccaaatagctgggtttacaggtgtgcgtcaccatgcctggctaatttttatatttttagtagtgactgatggggtttcgccacatcggccaggctggtctcaaacccctgacctcaggtgatctgaccgcctcagcctcccataattcatacttgttgaaaataatttgtttcctattatctcagtggaaaaaaagaaaaaggaaagtcaagtacgcccgcttactctagaaatgccacgtgactcttccactcacaggtcaccacgtacttgaactggctggttcggatgtcatctgaaatggaaaccaacatcgtggccgtggagaggctcaaggagtattcagagactgagaaggaggtaggcaagggcccctggctggacctcttggtctttggtgtagctttaccccaaggagatctctggaccctatcctgtgcacctctgcctctgagctggatacctcaccaggtagaagtgcatcttaacgcttgtccagtctttttgcagcacttatttagagcccggttttagggtgaaaatagtttaccggctttacccaagatctggggtatccatatacgagactgtgggatgctgtcagggcattcagaaggtattcacattgtgaagaagtttccccctctatttctctttcataacttctgatggtatcacagagaaagtcttagtctggggctagcaggtctttaacaccttagcaattgagatgatctcccttcaacagacagataaacagcagccctcacacttggagtcttcaacaggacggattctgtctatcagaaataaccttctgttatttgttatgaatttggtttttttgtgtgtgtgatggagtctcactgtcacccaggctggagtgcagtggcacaatctcggctcactgcaacctcctcctcccaggttcaagtaattctcctgcctcagcctcccaaatagttgggattacaggtgcctgtcatcatgcctggctaatttttgtatttttagtagagatgggggtttcactaagttggccagtctggtctcaaactcttgacctcaggtgatccgcctgcctcagcctcccaaagtgctgggattacaggcgtgagccactgcgcctggcctgttatgtatttgtataggggactcctgttacggaaaataatactacttttccttttgtgattgtaataaattttcctcttaagtaagttgagaaattaagtctaagtgacttgattaagcatattaaaacaacaagagaatgagtacatgcatactacacgaatgatgtagctgggaactgaccaaagtttgggaaaccctgccgttattgaaccccagtcccctttttatagatggagaaaaagggaacctggggagggacaacagctgatccaaggtcccacgtggcttggtagaacagctgggactaggacccgtgcctccagtctttgatgttgcgttgcccttaataactgccttcttaggccctgaacagcagcacaagtaggaacagcagtgataatagataatcacaataatgcctggcgacacccccaccctacattaatgataacagggacacacatagtgccttgtagaatgtcaggcccagacttaaacgtttaatatagagtaatgcactcagtctttaccccgctctatgactgatttttgagacacggtctcactcttgcccgggttggagtgtagtgcgatctcattcgctgcctcccaggctcaagtgattctcctacctctgcctcctgagtgtctgggaccacgggcatatgccatcacaccggactgatttttgtatttttagtagagacgggattttgcccagactcatcttgatctcctgagctctagtgatctgcctgccttggcctcccaaagtgctgggattacaagcgggagccaccatgcccagcccagccctataatttagatgctactattacccccattttacaggtgaggaaactgagacaaaaagctgaagttacttgcccaagatcacatggctggtaaatggcagacctaggcgttgagcctgtgcctcctcagagaccctatccagtgccatgggagtcatgctacccggcctcctgaggagagatgccccttgggagtgagaccaaggcctctgtaaggtctgtcctcctgaggaattcacagaggtgacctcggcccactcctttaacattctgactgggtgaaccaggtcccatgtcacgggtgagcattgtaagaatggcgtgagtgcccccgtgaggaaccaagggtgtattacaccggcggcttccaacttgacactgaatttaattcacttacaaggtatttcattaggttttttttttttttttttttagatggaatttggctttttttttgcccaggctggaatgcagtggcacgatctcagctcactgcaacctccacctcctgggttcaagtgattctcctgcctcagcctcccaattagctgggattacaagtacccaccaccccgcccagctaacttatttcattagtttttataatagcctcattgacatgtgaatttcacatgccatggaattcacccagttaaagcgttcagttagattgaattcagttttttttttgtttgtttgagacttaagtctcgctccagcctggagtgcagtggcatgatctcagctcactgcaacctccttctcctgggttcaagcgattcccagcctcctgagtagctgggattacaggcgatttttgtatttttagtagagaagggatttcaccatgttggcccggctggtctcgaactcctgacctcgtgatccacccgcctcagcctcccaaagtgctgggatcacaggtgtgagccaccacacccggcctgagttcagtttttaaaagcattttacttttgactgacttttatatttttagaaggatcgtgtttgacaaacccaagagaaagtaattgtcctcattagtcctaccactattctgtatttgcatgtatttttatatatagatagaaagttccacatacttctctccattccgctcactgtgttgttatagcatctccccttcaattatgtacataaattataaaatagagatacacttgttgttttaaaaaagaaaaaatcaatacagggctggacacagtggcccacgcctgcaatcccagcactttgagaggccaaggtgggtggatcacttgaagccaggagttcgagaccagcctggccaacggtgaatcccgtctctactaaaaatacaaaaattagttggcatggtggcaggtgcctataattccagctacttgggaggctgaggtgggaggatcgctggaacccgggaggtggaggttgcagtgagctgaagaaacatcactgcactccagcctgggtgacagagtgagactctgtctcgaaaaacaaaaaaacaaagaagtttatggtggagaaagacagtttgttcctgttcgccccgttcctctcctctccagagagaggccccattagcattcgggtgaatttcccccaaaactttcccgtgtggattcccacataccccaacacttttgtttgcttgtttctttttcttttaacgtaagtggaatctacctgttatcctgtgaaaccttttctttaaccatgaggcacctttgcatctgtgtatagtaacagtcactgcctctaagggctgctgtgaggctcagatgagatcatgggtctcaagtgctgagcagagcaacttgccttagttgcattgtaagcgctcaataataacatttattttttggccaggcgcggtggctcacgcctgtaatcccagcactttgggaggccaaggcagatggatcacttgagcccaggagtttgagacgatcctgggcaacatggtgagacatcgtctctacaaaataaaaaataatactttttgttgttggcggtggtggtggggtttttttttgtttttttttttttgagacagaggagtcttgctgtgtcacccagactggagtgtagtggttttatcttggctcactgcaacctctgcctcccagattctagtgatcgtcgtgtctcaacctcccaagtagctgagattacaggctcccaccatcaggcccagctaatttttgtatttttagtagagccagggtttcaccatgttggtcaggctggtctcaaactcctgacctcaagtgttctgcccacctcggcctccctaagtgctgggattacaggtgtgagccactgcgccggcaacgctgtgattttatagcacgtccacaaaagggctgcatgtcttgcctaaaagttgcccggcgttttcttgttatgtgccgtctgcagtgcccctgagcttggccatgtgctctgcagcctggttcagcacctgtgtgtgccctggacggggaggtgcattccccgaggctaaaaccagtgaacctggcccaggccatatccagctgtgggcctcaggaaatgctgaactgaactacttttcaaaaggagggttgtgtgtccctgggcaagttaccgcccctctctgtgtctcagtctccttgtgtgtaaactggggataatgaaaggaccctcccacatggggttgctgtgaggattggatgagacactgcgatacagatgctgcttttatccttgccttcctgccggggtgggcagccagggtaactcacttttattgtcgtgtctgtccagagaagaccactcatttcattgactccatttataaatatttatttaaatttttttttatcaaaaagtaagttttattggcatctaaaaacaaaattcacccaacactgaaacatacttcaatatttatgttattgttttcttgtttcttttttactcactgcagtgtgaggaacaaatcacatttactttggagaaacagagaccatagtgtagattttacaaaatcactttttaaactctctgtattgcgctcctcaaatacctagagccagtctgtgcataacatggcacactgttgtctaaaccgtaaaattttgcatcagcctaaagatatggataagatatacctccacttgctcttttgaaatacatctattaccttatccagcctaatgatagttacctaaaaaattctttgttccgtaggaagtctctgacaagctgttattcatttccttgacgttaaaagaatctgggggcaacatttatattttatcagaaaaactttttaaaagtttacctatcatgttcatattgagaacaatgtctgtggcgggcatggtggctcacgcctgtaatcccagcactttgggaggtagaggtgggtggatcatgaggtcaggagttagagaccagcctggccaacatggtgaaaccacatctctactaaaaatacaaaaattagctgggtgtggtggcgggtgtctgtaatcccagctactcaggaggctgaggcaggagagtcgcttgaacctgggaggcaggggttgcagtgagctgagatcatgccattgcactccagcctgggcgacagagtgagactccatctcaaaaaaaaaagaacaatgtctatacaaatcagttgtacaattattttaaaagaatggtgagcatgaacgtcacgttaattctggcagacaaaaatgaacaactatggtccattgagccattatctgttacacagagatgacagctttacagaaggtatctctgacctactgagggatgatcatgtcctctcagtttctgtgccttctaccactagttcactttctatatcagcagctgtgtcactcttcttgtttatgttcataaatgtgtgttgaacacctactatgtgctctgagccctgggatacagcagtgaacaattagagcctgtcctcattgagtggatggtgcagtgggtgtgggagacagaatacactcaagcatgcgagccccaagagggctggggacaggcagtgccctgaaggagaaggcagtgcgggaggggacagagggacacagggctgagagggtgctctgtatcgaccagagatccacaggatgcaagggggtcatttggggaataacattccaggaagggcaaccccccagtgctgaggcctgggaggccaccttgggcagcagagtgagtgagaggggaggtcaggggagtcacagctttaccagatggactggaaattccttactctctcccttcactgcgatcgaaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtgggtacacatcgccccattccctcacccattcccagtcgggcacagggtgccatcgggcaggtgaacctagctgcagcgtctccccagtcactcacggctccacacctttgcttgaatggctttttggggggctgggagtggactgtggcagtaaaagctgttcagagcgcatacagcttgcagaagtgaaggcttttaggtgaactgacagcctgaagaccaaatgagccccacagatttgttttggaagattttttgttgttgttgttgagagagggtcttgctctgttacccaggctagagtgcagtggtgtgatctcagcccactgcagcggcagcctcccaagtggggggactacacatggttgggagtgcaggtgtgtgccactgcacctggctaatttttgtattttttgtagagatgggggtcctactatgttgtccaggctgatctggaactcttgagctcaaccggtctgcccgcctcagcttcccaaagtgctgggattacaggaatcagccaccattcctggcccctggaagaagttctttttttgttttttggttggttgtttttttttttttttttttttttttttttgagatggagtcttactctgttgccaaggccagagtgcaggggcccgatctcagctcactgcaacttctgcctcctgggttcaagtgattctcctgccttagcctcccgagtagctgggactacaggcatgcgccaccatgcctagctaatttttgtgttattagtagagatggggttttgccatgttggccagggtggtcttgaactcctgacctcaactgatccacccgcctcagcctccccaagtgctgggattacaggtgtgagccactgcacctggcctggaagaaatttgaataagttgcaaatactgaaaaatctggaagacttaatataaaaatttattttctgctttttttggaagatcagaacatctggcaacatcaggtcaatcctcccccgcctggctctttctagtcaacctgtgagcctcctggttcaccccagtccctccctgtcccattcattgcctagttggcccctccaaaacattagaatttgtgatctctagaataaggtgtcaccatcccttctagggggatggctcaagggaagtgagaaattgtcagaattttggaaccttctcttggttccgagctgttcttggaagaggttccttgacctgagtgatacccttagactttcctctggaattggtctgacagtcttcctggccatttgctgggggacaaggctgctttcacctctgaacatatggacttattgaactgttcctacgtacctcccacaaagctcagaacattctgttcccagcagataatttctctctgagttacagagaagagcagagtgggtgatgttcttgctgtctttttttgtttttgtttttgtttttgtttttgttttgttttgttttgttttgagacagcctctcactctgtcacccaggctggagtccagtggtgctatttcggctcactgcaacctccgtcccctgggttcaagtgattctcctgcctccgtctcccgagtatctgggactacaggtgcatgccaccacgcccagctaatttttgtagttttagtagagatggggttttaccatgttggccaggctggtctcgaactcctgaccttctctgatccaccttcctcggcctcccaaagtgctgggactacaggcatgagccaccgtgccccagcccttgttgagtctttatggcttatctcacgtcatgagaatttttgcacgcatgctgctctgtgacacccctgtaggagggaagaaggagcccacttctcaagagccaggcaggaaggggagaactggaggtcaggaacatcatcctttggccattagctagagaacctagttccttcaagagaggatgcatggagaccaggtcatagcaaagggccggaagatctgcctgaatctttcagatatttcaacaactcatgatgggaaactcaccatcaaaggtgtgaaaaacagtggggaaatgaggaaatgcctgattattacttaatagtttcttgagtctaaacaaatagggctttgttggaaattccttctgcctcttctgtatctcttttgaggtctctagtaacttataaaaagccgagtcattccttttgggagcctggcaaagggaagagagtccttcttgaccttcggccgaaacacccttaaaggagtgtctctgggcagcgcgcaagggagagggctgtcgagttgggttgaccagatgactgatgcctgaggtggggccgagatgagggcactttggggcagggacaagtccggatgccagcattcccaccacacctgggcccttctgtcctgcaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggtggggtctgggtgtggcccagggggtgagccagagctggcaagccctatgattgcactgacagtggtgtatgtatatttttggggcaaacatacatttggccctacttcatcgttcttttttttttttttttttttttttttcctgaaacagggtctcgctctgttgcccagagtggagtgcgctggcgcaatctcagctcactgcaacctccgtctcccaggctcaagcgattctcccaccccagcctcctgagtagctgggactacaggcacatgccaccacacccagctaaatttgttttgtacttttttgtggagatggggttccactgtgttgcccaggctgcccttgaactcctgggctcaagcaatccacccaccttggcctccaaaagtgctgggattacaggcatgaggcaccgtggctggccttcattgtttttattgaagttaggctgtgctgctgcttccctgaatttcctcttagtatatgattaacaacgtgggaattaactgactatcagtcccgacttcctgtccccgggaggggtagtttcagagcatctagaaaaatccaaaaagacaccgtcttctctctctgctgccagagtcagactgagcatctctaacccttccaagagctagacaagaaataagactttttaattttcgattcacggggtgcacctgcaggcttgttacgtgggtatattgtgtgatgctgatgcttcggcttctatggatctcatcacccaactattgaacagagtacccgagagagagtagtttctcaaccattaccctcctccatctgtccccacttatggaggctccagtgtctatcatttccatctttacaaccatgagtacccagagtttagctccctcttacaagtgagaacacacagtatttggtgagaaataaggattttctttttctttctcttttcttttttttctttttttaactgagacggagtctcactctgtcacccagtgcagtggcacgatctcagcttactgcaacctgcacctcctgggttcaagcgattcttctgcctcagcttcccaagtagctgggattataggcacgcaccaccatgcgtggctagtttttgtatttttagtagaaacggggtttcaccatgttacccaggctggtctcaaactcctgacctcgagtgatctgcctgcctcggcctcccatagtgctgggattacaggggtgagccaacatgcttggctgaaataaggattttctagaccaatccccgcaggtggattccttaatatgttgccttttagtgtaatcttccctaaagtgtcttagaagattctcttctgtggttggatgacgggagaatccacgggactttactgttaggaatcacctgtgctgcgtctcatttctggaggttctcaacccacttgcatattgaaggctccaggaagttgtatggaaaggaaatctgttgtattctgccaaactcagactttccagacttttttttttttttccattattaaggcaattttttttttggagatagagtcttgctctggagtgcagtggcacaatcttggctcactgcaacttccgtctcccgggttcaagtgattctcctgcctcagtctcctgagtagctgggactacaggtatgcaccaccatgcccagctaatttttgtatttttactagagacagggtgttgccatgttggccaggctggtctcgaactcctgaccttaagtgatccactcgcctcggcctgccaaagtgctgggattacaggcgtgaaccaccgtacctggcctttttctccattattaacatctccagaaatagtgattccaaggagctctgataccccaccttcaacagtcctggccagaagtccttaggtcgcctccatccatgtcagcgtgacacaggtgtcacatgccgtccactctcttctctctgaacaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcaggtaggcgggggtgaacaaggagacaccgggtaaggtgtcctaggcgccatctcggtaggggtgtttgaagattctgtccagatctgtgtcacctggatttgagtcccagatgaccatttgtcccttcacctcttggagcctcagtttctgtatctgtaaaacgggtctcaatccaggctctttgtaccatgaggtagaataaccaggatgaccagtacatttccttttatacacaccagctccattcagttgatagtggctgtcagttgttaagctatggaaagtcttctgtaccagttggtcactagcactgctctgagcccccaggtccccatgcactaccccagctgtcttggtctctaccaggatcctggagctctgtccatgacccagcaactaaagcattaatgcctggcacaccagcggaacctctggggtcctgctttggtggtgtttgttagtgcctggttctggttctgttatccgtctccatgacaaccaaccataaagcctcaggcatgttcaaccataaagcaacgatcattgctgccatacgagggcagtcagccaggtggctctgctgatctcggctgggctcacatgcatgtctgggagtcagctggctgttggctgatctcggggtcagctggcttttggcctcaggtggggcaagaagggtatgttccgtgcatccctcattctccagcagaccagcttgggcatgttgtcatggcgatggcaggggcacaagagcgtgcaagcccctattgcatctaacagtattcttttggctgtccttacttttgctggtgtcccattggccaaagcaaggaacatgtctgattccagagccacctctcatggccccacagttggataagggatgcatgggtatgaggccttttttttttttttttttttttttttttgagacggagggtctcactctatcacccaggctggagtgcagtggcgcaatctcatctgcaacctccgcccccaggctcaagcaattgttctgcctctgcctcctaagtagctgggatgacaggtgcctgtcaccatgcccagttaaattttgcatttttagtagagatggggtatcaccacattgtccaggctagtctcaaactcctggcctcaagcgatccacccgccttagcctcacaaggtgctgggatactaggtgtgagccactgtgcccggctcttattttttttttattttattttttttaagagacagtgtctcactctgttgcctaggctggagtacagtggattgatctcggactctaactcctggactcaagcaatcctgcctcagcctcccagtaactgggactacaagagcatgccaccacacccagctaatttgtttatttttgtttttggagagatgggggtcttgcttttttgcccaggctggtctcaaattcctggcttcaagctatcctcccacctcagcctcccaaagtgctcagattgtaggtgtgagctgctgttttgagaatgattctgaacctgcatcttgctgaataggagatgtgctctgattgattagtgatgtctgctgcagacacagatgttgggagtggacatgctttcctggtcaagcaacatagagtgtctcctttcgcttctcccagcctgggcctaggttcagggtcaggggtggtttgacccaacactatctcctggtttttttcttccggtcaagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaaggtgatgccactggcacagtggcctctaggctttgggagtttgccttactcactggctcactcattaattcattaattcattcaacactgtccttatccctagtgacagccccagtgggtggatcctctcttcatcctggatggtaccagctatttctttttttttttttttttttgagacagagtctcgcttcatctctggagtgcagtggtgtgatctcggctcactgcaacctctgcctctggggttcaagcatttctcctgcctcagactcccgaatagctggaactacaggaatgtgccaccacgcccatctaacttttatatttttagtagtgacagggttttgccatgttggccaggctggtctcgaactcctgacctcaggcgatctgcccgcctccgcctcccaaattgctgggattacaggcatgaaccgctgtgcccagtggtaccaggtatttctaatatcatctagtcattcattcacgtcagcgcacctgcggtgttcccagacactggggactctgtaggctgctgtcagacaaagtccctgcctccaggaccaagtagcttattagatggaggagacaaaaaatatacagagcaataaaccaacaggattccagagggcagcaggtgctgggaaggacgcttgccaaggagacgggatagcgagtgctgggcagggccactgtttccattgaacactgcaggcccagtgcgtggggcccacaaaaaggttttattttttttaaaaaatcagaagcaggccaggtgcggtggctcacggctgtaatcccagcactttgggaggccgaggcaggcagatcacctgaggtcgatagtttgagaccagcttggccaacacggtgagaccctgtcaccattaaaaatacaaaaagtagccaagtgtggtggtgcgtgcccataatcccaggtacttgggaggctgaggaaggagaattgcttgaacctgggaggtggaggttgcagtgagctgagattgtgccactgcagtccagcctgggcaacagagtgagactccatctcaaaaaaaaaaaaaaaaaaaaaaagaatataatccaacctggattttatttatactaacacagtcataaaatagaatttctagcattttgtgtggagaaagccacctccgtaggcatcagtgccggggaccacaaaagtcagaatgctgccatagtgccagggtcctggggggttttgagttttgtgtgggtcatctctgaagaggtgacattttagctgagacctgaacaatgaaaaggagtcagccttgagaagatctgggacagcgatctgcaaccttgttcttaagggccggggtagtttcagctttgtgggccacatggcctctcagccacttgactccagtgttgccgtgtgaaagcagtcatagatagtgcacgaatgaatgagcatggctatgttccaataaaactttattcataaaaacaggcaaggggtcagatttggcctgcaggccacagtttgccaaccttggatctaaaggaagaacattctaggcagccggtacagccgaatgtaaaaatgaatgcgcttaatgaatttgaaggctagcatgaggaggccatgtacctagaggttggaattgagtggacaggggcaggagattaggccagaaaggtaggcaggggctggatcttagagcaccatgtaaccacggtgagaagcttggaacttactctaagagccctataaagccattggaaggttttaagcagggaagtgacatgagtttctattttattttatatatttttgagacagggtctcaccctgtcgcccaggctggagtgcagtggtgggatcacagctcactgcggcctcaagtgatcctcctgcctcagccttccaaagtgctgggattataggcgtgagtctctgcacccagctgacatgatgtttctagttcactgagtaccacctactaagtggcagatgctgagttggtgcttttgaaatataggacatagaaatgaggacagaagtgggcagtgtcaaatcttacaggacctaaaatattaggggtcagccaactatggcccacaggccacagatctggccccctgcgtgtttttatgaataaagttttattggcacgcagccacatctgttcattttcctgttgtctctggcagctttcacactataaatacagcagagatgcgtagttgtaacagaaagcatatggcctgcagagcctcaagtatttactatctggcctttttcagaaaaatgttgccaatcgttattgtagactgtggtaagatctttttattttactctgaatgtaatggaacagtgaatgtgaacagtcaacactgttaataccattcacaccatgattgatgtggggtagatattaaggagctggcctcatgggaatctgacattgactagaaatagggattgagggtgagcaaccagctggaaggtactgcaccagtcctagcaaaaagtgttaggggcctgacccgaagcagtgacttgcccaggtcagttgtcccaggggcacgaggtgctcacccctccccttcccctcatgtctgtatcccctctccctcagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaatggttccctttcctttggggcctcggcgagggttccagccatgtcctctgcagggtcaggatgtggcatcttcctgtttctgttctttccttttgacaacaagtcgcctctagtgggagctgttgccagaaagggcaagttgtagagatcactagtcagatggggtttagtgggaaggcgggacagccgcaaggtggacggagcccaggttttggggttggacagaccctggcttgagtcctgctcttgtcatttgctgttcttgtgaccctggggaagtcactcagcctctgtgcctcacttgctttgtctgtaaaatgaggctgatcgtacttaccctgtgagcagtgatgtgtgcggtactcgtagcctcggtcaggttctaagacacaggcgaggcagaaatcacatgtggccagaacgatccttgaaaatcctgccctccccctgcccttttttttttttttttttttgctagaggcacggtctcactctgttgcccaggctggtgtgcagtggcacgatcatagctcactgcagcctcaaactcctgggcttacgcaatcttcctgcctcagcctcctgggtagctgggactacaggcatgtgcccagctaatttttaaaaatttttatagagtcagggtcttgctatgttacccaggttgttcttaaactcctgggctctggggatcctcctgcctgagcctcccaaagtgctggggttcaggcacctggcctgaaaatccctttatgttagtccagagaggcgaggctgcgctgcagtaacaaattcgccgtaaaatcttcggaaatgatcacaaggctttatttcttgctcacgcagttcttggtgagggtcagctgcctctccagggtaggtgacttccctgtgacaagtgatccaggctgtcctggttttgtgacatggcctcccaagggttggcctccaggtccccacagtgggagaagggagagtggacgactctcacccactcttctgtgtctgaaaccggaactgacgcagttaatcccactcacagcccattggccaaaatgagtcacatggccccaacccaaccactgcgggagctgggaaatggagcggtgcctgtggaagagaaggatttctccctttcctaactgatgtggttctggagttttggatagcggagtagtcagactagtgtgttcggtttctaacttcgaactgggtgagtctgggcagtaaggaatgtctgtatttggggagcacaccatttctgccacacctaaaaccatgcaccaagtacatgtgcagatagaacgttctagcactgccattgttccctcaagctttcctgtcccctgattgaaattgttggcttgcactagggactgtggtgtacaaaggtgctcagggaagagccggcgaggtggtgaccattagaatgagtagtagtgtctgggtgcagtgactcatgccccattgaaactgttggcttgcattagggactgcagagtgtgaaggtgcctagtgaaaagccagtaaggtcataaccattagaataggtagtatcagccagccgggcatggtggctcatgcctgaatgatgtcattggcttgcattaggaaccacagagtatgaaggtgcccagtgaaaaactggtgacgttgtgactattagaattagcagtattggctagacgaggtggctcatgcctgtaatcccagcactttgagaggctgagacaggaggactgcttgagctgaagagttcaaaaccagcctaggcaacatagtggaactctttctatataaaaactttttttttgttaaattagaagtagttgaggctgggtgcagtggctgacgcctgtaatcccaggactttgggaggctgaggcgggtggattgcctgaggtcaggagttcaagaccagcctgatcaacatggtgaaaccccgtctctactaaaaacacaaaaattagttgggcatggtggcacatgcctgtagtcccagctactggggaggctgacaggagaattgcttgaatgtgggagataaaggttgcagtgggctgaaatcaagtcattgcactccagcctgggcaacagagcaagccgagactccatttcaaaagagtagtagttggatctaccagcgggaatcttaatagggatgtgagatgtgtttagatctcaaagcctgaccctgagtcttaaaatcccaggtcagatcctaagcagtcccagagagctccacctggtgtgcatctgtgccagtgtcttggggtggggcagctgcatgctcaggtggaatccggggctgagttcaagtttaatccactttatgaagaggaggcagagtgaggcataactcctcatccaggggagtggaagtactgtggaaggaagctctgttttgtacctactacgtgctggccctggcctcactgtgcagaactctccacattggaaaggatccccccagaccagagaggcgtaaggagggggctggtgctttccagtgttgaactgttcatctgtcctcacacccaccatcgggtcctacagcaaatttgtttgattttctgcaaaacacccagaatctatccactccccgtcctcccattgccaccacgctggtcccagccaccccactttctccctgcatccctacaacagctgccacagtggtctcgaggcttttgcccccagccccccacacacacatcagtgtcctcaacctggtggctgtagtgaccttatgaaaacacgcactggccgggcacggtggctcacgcctgtcatcccagcactttgggaggccgaggcaggcagatcacctgaggtcaggagttcgagaccagcctggccaacatggtgaaatcctgtctctactaaaaatacaaaaattagccaggtgtggtggcgagtgcctgtaattccagctacttgggagactgaggcataagaattgcttgaactgggaggtggaggttgcagtgagccaagatcacgccactgcactccagcctgggtgacagagtgagtgactgatggtgaggacacgggctctgaagccacactgcttgggcagagatgccactcattctgtttgttttctcatctgtcaaaagggcctgatggtagtaccttcctcatcaaaacgttccagtaaggggcccagtgaggtggcttcctcctctggtccactgaatgcgtgcgtggcgggcatttaaagcagtgtcaggtatacgtagttacgtgtttgcagtggcgaggtggactgttgagttttaaagagtctactgggcgcaggcactgaccagagaggaagtctgcagccttgatggatgaaattcgtgttccacccaccagccagaccctactggcagcagcccatggcgggggtattaatggcctgggcatcccctctggcgcgtctccagactgccgtggtgtgggcccaacagcagtctcgttagcaggctggcaggtgccggttcccacgtgctggccgcctgtggcccaccctctgctccctggcacacagcctaggaaagagagtctggtggccctgggtcatccccagctgagtttgccaaatgcccacatggcagcccctgcctagggtcactctgcaaggcaggtggctcagctccagccagagaagacaggctgcatctgccgcccttcctttctctaaaggacaaatgtgtcctgtgcaatgactttggtattacacccagaaacagatccccactctgtccttactgactgggtcaacttggcaagtcatgtcaaccccttgagcctcagtttcctcacctgtgaaatggagctaggaataggtagttgtgggtccacagctttgcaggcatgactaggggcaggtcaagaatgcggacttcctgccccactttgaaggtggtagaagctgcagttagaagtttactccaggccaaaaggggcatcacaaaacctgtgaggatgggccatcagaaagtcccatgacctgatgggcggagcaggccctgtgtccttaagaaaaggtggagttcttgccctgccacccctgacaccagcaaagccactgctcaagtatctgtggatgatggatggcagcggggcaggttagaccggggattctcaaccaagtgggtctttttgttttgtgttttttcagacagtcttgctctgtcacccagcctggagtgcagtggtgtgatcttggctcactgcaaccttctctgcctgggttcaggcgattctcctgcctcagccttcagagtagctgggattataggcacctgctaccacacccggctaatttttgtatgtctggtagagccaggggttcaccttgttgtccaggctggtctcgaactcctgacctcaagtgattcacctgcctccgcctcccaaagcactgggattacaggcatgagccactgcacccggcccaactaggtggctttgaccccctgggggattaatggcagtgtcacaagtctggtggcggtagaaggaggatgttattggcatctagtgaagaagaggccaggggcgctgctgaacgtcctacgatgtgcaggacatgtccccacagcacagaactatctggccccacgtgtcaataaggttcagaaagcctgggggattgccttctgtgcttccacgaacacatatccatgtattatgtcattcttgcggcaatgccacgaggtcagtgagactccctgactagcatacataatgttaggatctagggagttgtctaatgtctcacgctgcccttcccagcgatctatgtgtggccttaggcttggctactttagacttagtccctcttttccggtgcctgcagctggtttggtgagtccagtattaatatactgaccgctgtcagaaagaggagtgaggaggctgggcatgatggttcacgcctgtaatcccagcacttttggaggccgaggtgggcagatcacctgaggtcaggagttcaagaccaacctggccaacatggtgaaaccccgtctctagtaaaaatacaaaaataattagccaggtgtggtggtgggtgcctataatcccagctacccggcaggctgtagcaggagaatcgcttgaacctgggaggcagaggttgcagtgagccgagatcttgccactgcactttagcctaggtgacagagtaagactctgtctcaaaaaacaaaaaaagaaatgtgtgaggaatgcaacaagctgtgcattgaccacccttggttacagcaagttctccacgctcagccgggtccagcctttggctgtcagcagcatctggagcggaactgtgaacagaaacactccaggtgttccgacgggtgctggggcgcccccagggagctggaatttggtttttagcaaccacatataggaaatgaacccgccagccacagtatctcacgcctgtaatcccagcactttgggaagctaaggccagcggatcacctgaggtcaggagtttgagaccagcctggccaacatggtgaaaccccgtctctactaaaaatacaaaaatcagctgggcgtggtggtgggcgcctgtaatcccagctgctccagaggctgaggtgggagaatcgcttgagcccgggaggtggaggttgcagtgagtcaagattgcacccctgcactccggcttgggtgacagagtgagactttgtctcggacaaaaaaaaaaaaaaaaaaaaaaagaaccaagtcctcgggcaaattctcccattgagggctgtgaagtcttggctcctctgttgtttgttttggaaaccaaacttgcatatttgactttctcatgcgtggagaggacccatgcttggcatgggggggcacctggtttttgtgtccttggagctcatctctggtgggggaggaggagcagcaggagatgcgagggctgtagttctcagtcctggccgcacattggaatcctatgggggagctttaaaattatacaccaaactcggccaggtgcggtagctcacgcctgttatcccaacactttgggaggccgaggagggtggatcacatgaggccaggagttcaagaccagcctggccaatatgctgaaacctcgtatctaataaaaattacacaagttagccaggcatggtggcgcacgcctgtaatctcagctgcacgggaggctgaggcaggagaattgcttgaacccaggatgtggaggttgcagtgagctgagattgagccactgcactccagcctgagcaacagagtgagactctgtctcaaaaaaaaaaaaaaaaaaaatacacacacacacacacacacacacacacacaactggagaacagagcatggtcactgggggcaggagcgagagtgatgggtgtggtcggaaaatggtggtggctattccgtatcctcaccctggtgtggattcatgagcctacatgtgtgataaaactgcatgggacaaaataaacacacacacacacaggagtacaggtaaaacgggaaatcgagcaagattgttgtgtcaatgtcaacaccctggctgtgatgctttatcctagagttttgcaagatgttaccattgggtgaaatggggtaccaagtacacgaatctctctatattattgtttctttaactgcatgtgagtctgggattatcccaaaataaaagtgttaatttgtaaaaagtacacacagcatggcagttcccagcctcagagattctgatttaagggtctagccgggagcctgggcatgtgcttgaggcccccaggtgagtccagagtacagcggggctgagagtcgctgttgacattggctgcagggtggacagggcgagatgggccctgcccgggcagacctgtgtattgctaggtccttccggctctgatgctctgtgataattggccactttctctgccattttcctcccagagagcaaacacaggtctagactcaatatcgtgtggagctatcgatgaccacgggtcacttccatctccagcactgcaggctgtgcgggctggtccaactggggtacggttgagggtcctggctcagaccaggcctgactcctgggccagtctgtaaaacaggcccttctgggccagcagctgggccgggctgccgctctctgccacctgccccttgtccatgaccagaaccctgtgggggagagggagacagagaggctctttggacaccagcccaggctctcggcagctgtgagagcccagtgtgtctgcgctgaggttttctccatagaagtcctgctttccatgcggctccctggccctcacagctgggttggaagcgtgtgctgggcgcatgtccttgggcagctttcccacttggcatgtgttcccgggcattcctcccgctctggccccattcaggacccctccagctctaacccgaagcccagtggcccaggactgcctccgcctccttcccccaccactgcagggctgctgtgaggtcaggccggggcgggagccttaccgggcacagtccatcacggagcgcaggcggtgggcaatgagcagcacagtgcactgtgcaaaccagctcccgagcatggcctgcatctgcagctccgtgccagggtccacggcagcagtagcctcgtccaggatgaggatctgggtcttccggagaagggcacgtgccagacacaggagctgtttctggcccacgctgggaacgattgggacaattagctgggacgtgcgtttgtcggcacatggtgatgtgtgggtgtgcccagaaacaggtccctgaagcagtgcaggagtgaggtgcctgtgttcaggcatccccacacatggggtctggggtctgtggtctgcagaactgataggaagcctgttcctgccatctttgagcaggctgactgtaggcaggtcattcaaaccctttgtgcctcagtttccccacctgtgaaatggctattttcttttttctgtttatggctctttttttcttcttcgtttttctttttttttttgagacggagtcttgctctgccacccaggctggcgtgcaatggcacaatctcagctcgctgcaacttctgcctcccggttcaagcagttttcctgcctcagcctcccaagtagctggaattacagtcatgcgccaccatgcctggcttttgtatttttaaagtagagatggggtttcaccatgttggtccgacttgtttgaaactctcaggtgatccacctacctcagcctcccaaagtgctgggattacaggcgtgagccactgcgccccggtagttctatttctagtttgttttttgagaaatcatcatactattttccatagtgactgtactaatttatatttcccccaacagcgaaagcacagctttcacttcagtcatgccgttgcaaacaaacctacaatgactgactgctgcttcaagaatcaaatctacagtcttcctaagacattcaaggctggtgtcacgtgggccttaaatacagatgtgtacaacacctgggtgggattccaggcgtgatccaccgtgcctggcctgtttatggctatgtccagttctatttctagtttccaccttgtgccaaacacattctaagtgcttgtatatattcactcaatcctcataatgtccaccaaggtagatattattgttctcttcttttgagagaagaggacacagatacagagaagctcagtggcttgaccaaggtctcaaggctagtggtgggtccataatttgaacccaagtcctctgaccccagagtctgtgctcctaatggatccgtcctcgctgaatcgtgacgacatggcacataaaagtgtgtgggtggcggggcacggcggctcacacctgtaatcccagcactttgggaggctgaggtgggcggatcacgagatcaggagatcgagaccatcctggctaacacggtgaaaccctgtatgtactaaaaatacaaaaaattagccgggcgtggtggcgggcgcttgtagtcccaggtactcaggaggctgaggcagaagaatggtgtgaacccgggaggcagagcttgcaagtgagccaagatcgcgccactgcactccagcctgggcgacagagcaagactctgtctcaaaaaaaaaaaaaaaaaaaaaaagtgtgtaggcttgtcacagaataagcccttggcatggagtagcacccttcgtggagggtggaggagttgagattccaggttgtgagcccagtgagcccctgacccaggtgggaactgacccctggggccccagcatggctgtcttgcacagtaagcccttccatgaaacagcatccttttacatgatcagaacctactatggtcatgcaggcgttagagtgcctgggtcttgtcccaacctcactacttttaagctgtgtgacgtcaggcaagccccaggcctccaattccaactctgtgaaatgatgttatcaggagtgtgactcaggactaaaatgagtatttactctttgctctatgcctgccactgtttcaacaactttgtgcatataattcaatccttgcaaggtaggtaggtgctattattcccaccttacagatgaggaaactgaggcacacaagataagttgcctaagatcctacagctagtaagtggcagggcggggcgggggtgggggtgtggggtggggggcctggatttgagcccaggcagtctgtcacctgtgtatactcttacccaccaagcaacgctgcctctctagtgctggaaattattgcctaccacaagcccttcggacaccctcagggtcagaggggtttataaatccagaacaccttaggtttttttttgttttttttgagacggagtcttactctgtcacccaggctggagtgcagtggcacaatcttggctcactgaaacctctgcctcccgggttcaagcgattctcctgtctcagtgtcttagcctcccacgtaactgggattacaggcgcctgccgccacacccagctaatttttgtatttttagtagagacggggcttcaccatattggtcaggctggtcttgaactcctgacctcaggtgatccacccgcctcggcctcccatagtgctaggattacaggcatgagccaccgcgcccagccactttggtttttctaaaggcatatacctatacacctatgttcatagtggcattattcaaaacggccaagaggtggaaacagcctgggtatctactggcagataaacggataagcaaaatgtggtctatccatgtagtggaaaattattcggccttaaaaaggtagagaatctgacacatgctacgatgtggatgacccttgaagacatcatgctgtgtgaaataagccagtcacaaaaggacagatcctatgattctgcgtctatgcagtgtctagagtagtcacactcagagagacaggagaatgctggtggctgggcgctgggggaggggacaaggagagttagggtttcatgggtacagagttgtagttctgttgtgtaacagtgtgaatgtacctaacactacagaaactatacactgaaaaatgggtgagatgggcccggcgtggctgctcacacctgtaatcccagcactttgggaggcctacgcaagttcgactgtagcctgggcaacatggtgaaaccctgtctctacaaaaaataaaaagattacctggccctggtggctcacacctgtaaccccagctactcgggaggctgaggtgggaggaatgcttgagcctgggaggtggaggttgcagcgagccttgacctcaccactgcactctagcctgaatgacagagccagaccctgtctccaaagaaaaagaaaaaaaaaaaaaaaggttgagatagtaaattttatgtgtatctttccacacagctttttgttgttgagacgaagcccaggatggagtgcagtggtgcaatatcggctcactgcaaccttcgcctccctggctcaagcgttcttcccacctcagcctcccaagtaactaggactacaggtgcatgccaccatacctggctaatactgttgtccacagagatagggtcttgctatgttgcccagactagtctcgaactcctgggctcaagcaatcctcctctctcagcctcctgaagtgctgggattacaggcatgagccactgtgcccagtccacacttgacatttaccaaaaaaaaaaatcctatattatagtcccagtgagtggtgaggttaccacccgatatcaaacaatattttcatagcaaaataaatactgagcaagagcaataaaggctatcagtagccctgtgtcagttgaggttgggttttgccaccaagtaaatatagaagactaactgctaatttaggggggaaaaccttggtattcagagactgtgtcagagcttggaattgcagataagagacatgtggttattaatgtaacagagtgataatcctatcgggggaggcatttcctgaaggcccttggggagggcatggccatcccctcctctcccacctgcaggtcccagccatggtgggacgaccatacctcaggtcctcgcctcggtcagcacacttgtactgcagctggccgggcaggctggccaccaaggctttgagctgcaccgtctccagggctgcccagatagcctcgtccgagtgctcctgcagcaggtcgaggttcatccgcagagagccagggaacaggatggggtcctggcggggaggggcggtgggtcagagccgggtcccaccatgcctcccatctttgcccaccccctccaccagcctcacctgggggatgatgctgatcctggagcgcagtgtgtgcagccccacgtgggcaatggggaccccgtcgatccagatcccaccctcagctgcctcctggagccgcagcagcccactggccagggaggacttccctgccccggtcctgccaacgatgcccacctgcccggggttgggaggaaaggcctgctctgaccagagggtttgtgggcatttattggggagatctttctgctgtacccgagatctgtctatccatccctcattgtgtaaaggtctaccttccatctctctttccatctgtctacctttctatatatccacccatcaatccatccagtcttccatctgtgttcttctctatctttcccttatcctgatatctctctcccatctttctccccacccttcctttagttcctccatctttcctcatccttctatttacacctctccatcatctctcatccttttttctaccccatcccatccatctgtctgtccgtccatccatcccttatccttttttccaccccatcctgccatccatccatccatcatccatcctcaatcccatccctccatctctcttccaccccattccattcatccatccattcatctgtctatccgtctctcgtttcttcttccctattcatccatcaattcactaatcctttcattcatttattttctcccatccatccatccagtccatccttccctcatccatccttccattcatcctccatcttatccatgtgtccattctgttatccatctcccatgctgttatccaccctccatccttatctctcttgctactattgcatcctcagtgtctgacacatggtgtgggttcaacattatttgtttaattaatgatggaaacatgtgggtcaccccactgtatgccaagtacctgtttaggcaccggaagtatagaaattaaagagtccttgctccagtgtgcccatcatccggtctaggaaacagtgcaattgagtaaatgtaatacagtgtgatgaacaatgctttatttatttatttatttatttatttttgagataaagtcttgctctattgcccaggctggagtgcagtggtgcgatctcagctcactgcaacctccacctcccaggttcaagcaattctcctgcctcagcctccctagtagctgggactgcaggtgcctgtcaccatgctcggctaatttttgtatttttagtagacacgggatttcaccatgttggccaggctggtctcaaacttctggcctcaagtgatctgcccaccttggcctcctaaagtgctgggattacaggtataagccacagcacccagccaacaatgctgtttattatcaaggtctggacctctggcaattaagggaagcaaggcagtgctgctcatgctgcctgggatttgacagaggtaataagagaagacctcatggaggaagggatacttgcatggaagcttgaaggatcaataggagttcaaggaaggggaacactccaggtaaaccacaccaagtgggtttccaaaactagaagctcatggagctcacagcaccatgtgcccccctggccgagaggcagctgctccacaatgttggctaagccctggcagagcaatgaatgagagggggaggttggcagggcctgggttgggtagagccttgaatgccaagctcaggaattcacactttaccccaagggaagctggaactagtagaaggttttgagcaggggaatgacatgcagtgtcattcatgctgataaaggtcacaggatggctgggcatggtgggtcatgcctgtagtcccagcactttgggaggccgaggggggtgattgaggtcagaagtttcatagcagcctggccaacatggtgaaaccctgtctctactaaaaatacaaaaattagccgggtgtggtggcaggtgcctgtaatcccagctactcaggaggctgaggcaggagaatcacttgaatctgggaggcggaggttgcagtgatctaaggtcacaccactgcactccagcctgggcaacagagtgagactctgtctcaaaaaaaaaaaaaaaaaaaaatcacaggagagcagattggagctggtgagacaggatccactgctttttaggggacaaggagaggacagggaggaagcctctgtaggttcagagggagggaggaaagggattcagtgaaggggcctgatgaggcatctgtaaaatgggatagtactagcacctcacttaggggttgttgtgagagtgaaaacgcaaataataaaagcattagtaaacatttctggagcactttctatgagctaagcatgttctatgtattaactcaaacttcacaacaactcagagatcagtattaccagtcccaatttacagatgggaaaactgagactgagctatgaagtgcttttcccaatgtctcccagctgaaagcaaatatcccatttgtgcaaactggaaaatgtacctggagcatttaacacactgcccagcacatattaggtgctgggttaatgttaaaggaagaaggaagtcacggagttgcttcctcatctggggacaccaaggtggatgaggaagtcaccagatggaagcaggtttggggaaggtgaggagttcattttagggggtaatgggtctgaaagctaggggacctgaggtggggacactgtggaggtggctggtgcccagggtttagggccttgtccctggagtcctttggcctaaactccatgaagaagacattgtgagagaaccactcaccttctctcctgcgtggatcttgaaggacacgccctgcacagccagcgggagctcaggtcggtatcttagcccaaagtcccggaactcgatctgcccgccctgaggccaggggggctgagctgcacatgtgggcagcctccagggagcctggagcaggaggggaaactgagtcagaggagccttcctctaagacttcacacaagatggcccacctctatcagcttcagttttctcttccgcaaaatggacgtatttattgctgttttacagggttgttatgggaattcaacaagagagggcatggactatgtcaatgctaaaaacagatggtggtggctacttttagtctattttattgttattattagccactgtttattataaaataatctctttttctatagtgggagcagacatttctctttgtctttgtgaaaggacatgactgtgcagtgggaagaccaatactgcctttgctgttcccgtgaccttgaacagatcattctacccccttgagtcttggttttccaatctgggaaatagggctaataagagcagcagacatgtattgagtgtttgcaatggaccaggcactctattaaatcatttctttgcaggatctcatttgatcctcccagtaaactcaacgctgttatgttactgttacattagtgctatgctgctgttcttatcctttcttccacccaatcccatccatccattcatccatccatctcttatcctttatccaccccatcccacccatccatccatccatgcatccatccatccatctccaatcccatccctccatctctcattcttccatcccattccatccattcatctgtccatctctcaccatttcttctaccctattcatcaactaattaattcttccttgttctgttactgtaatgttactgttatattgctaacacattatatcatgttgctgttttgttaccgttgcgttgctatgttgctgttctgtccttataatgctactgttatgttgctggaattttgccatcatgttactataatgttgctgttttcttactgttacattgccatgttgctattccgttactataatttcagttattttgctggaatgttgccatcatgttactataatgttgctgttttgttactgttacattgttatgttgctactctgttactctgttacagtcgtgttgctgggatgttgctgtcatgttatgatgttgctgttgtgttactattgcattgctatgttgctgttttgtttctatcatgttactaaaatgttgctattacgttactattacattgctatgttgtggttgtattgctggaatgttgccatcatgttactataatgtctctattatgttactattacactgctatgttgctattctggtactgcaatattgtggttatgttgctgttacattactgttacattgctgttgcattactctcatgttctggaatattgccattgtgttgctgttgccattatgttactatcatgttgcagctatgttgctgttgcaatgctgttccttgtggttccctgcactcccatgggtgacctgctttcctcaagctcagaagcaaaggaaccaagatttggcctggctccaaaccttatgctcctaaccactgctgccaccctgtctgtgactctgacctatagtggtgggggttgagtgaggggagaagagggtataaactccaaagcctgtagcagatgtcaacagggacccattgcccccccccacaatatgtccttgctgggaccccctccccacctcccgcccatcacctccttgggcgtccaggcatagtcctgcatccgctccactgacacgatgctgttctctaggtctgtccagttgcgaacaacccactgcagtgtctgggtcacctggtgcaagaaagcctctctggctgggtttggcaaggccacttgagggcttgcaacagcccccctggtttcccaaccttttctgggaggccagacccaggggagtaaagaggggaggcaggaatgggacagtctgaggacctgggcccaggggattgggatttggatacaaccaacaggtccctctcttccttcagtagaaccagagcatgcagagcaaaaagaagccctcagacatcagcttgtacaaactggcttgatgcaggtgagtagacaggatcagagagggtgtgtggccctcccaaggacacacagcaggacccaggcccactgattccattctgacggctttctcgcagcgactgggtggccaccaatttcccatgacacttagaaccactccaagctcctccctatgagccattagcagctctagccctgccatcccatccccaaccttgtctcccagcacccctgccttcacccaccctctccagccacacccgtcttcttgctgttcctctaacacaccagggatgaaccttcaactcccaggccttttcttcctgctgttaacctcacttcctcctaagtcacctcctcagagaggcctttctggatgcagtaggaaagttccctcactgccacccaacatgctccagcctcttacttcatccttaagcttagcagccttgactgtaaaatgaggataataacagtgcttctctgatggggttgtgggcagtattaagtgagttaatatttataaaattcttgtgcacagtggctcatgcctataatcccagctttttggaagtctaagcaggaagattgtttgaacccaggaattgaaggctgcagtgagctgtgatcacaccactgcactccagtctgggcaaaagagtgagaccttgtctcaaaacaaaacagctgggcatggtggctcacacctataatctcagcattttgggaggctggggcaggcagaccacttgaacctagagtttgagaccaggttgggcaacatggtgaaactgtttctaccaaaaaaaaaaaaaaaaaaaaaaaaaaaattagccaggcatggtggtgcatgcttgtagtcccagctaattgggaaagtgaggtgggagaatcccttgagcctggagatggaggctgaagtgagccaagatcatgccactgcactcaagcctaggcaacaaaatgagatcctgtctcaaacagcaacaacaacaaaccaaaacgaacaaaaacatataaagctcttagaataatgcctcctccataacaaatgcttatgagtgtatatatatatttttttcatagatgtcatgaactgacattacatactgttaatagttaacaaaaattagccaggcatagtggctcacgcctgtaattccagcaacttgggaggctgaggcataagaatcgcttgaacccaggaggcagagttctcagtgagccgagattgcaccactgcactccagcctgagtaaaagagagagactctgtcttcaaaacaaaacaaaagttaacaatgcactagaaatgtcctccacaggatatgctttgtctcaactagtctttataacatcagaagtagtgggatttctggcctgtctttccaaggagcacactgacactccacaaggaaagactcttgcccaaggttgcaagttcaccttagctgagtctggctcttgtagagctgcgtgtccctccttggtggagggactccacacaccatgttggtttggacacagggtcttcaaaggtcccactagcaggggtccgacagtctctgcctctgtctgtccctcaagcccagtttggggatgtggggagtacctggagggcagcagagacagagaagcccacgaggccagcactgaggtgggctttgctcagcacagcacacgtggcagctgcaaacaccaggccattccccaggagctccacattggccgcaagccacctgcaaagggaagcgacagcagggtgagtggttactctcatctgcagggagatgcttctctgggcacaaggactggtcatcacaccagctttgtacacacaggggtcccagcaatggcctccacatgcaacccaggctcagggagtagaggaagatgacaccgtcctgtctcaactaagcccactttagggtctggggtacactcggtgttctgaagagcatccctgtgtggctgcttttctgtccctggaatttgccaagccatgtccacctgccattcccctggcctgaaccatggcctccatggtttggctctgtgtccccacccaaatctcatctcaaattgtaatccccacatgtggagggagggatctggtgggaggtgactggatcatgggggcagttttccccatattgttctcgagatagtgagttctcacaagatcatatggcgtaaaaggatgcggcagttcccacctcatgctctccctctcctgctgccatgtaagacgtgccttgcttccctttccaccatgattgtaagtttcctgaggcctccccagccacgtggaactgagtcaattaaaccttcctttctttataaattactcagtctcaggtagttctttttagcagtgtgaagatggactaatacacagccccagctggctggggacctgagatgaaaggaaaaaggacttcacatgtattgagcacctagtgtgtacttgaccctctccacactctggtaccagactgcttggattcaaatcctggctctgccagtattagctgtgagaccctggacaagtttccaaacctcactgtgcctaggatttatcatctatagaacagtttcttcctggtgaagctgttagcagaattaaataaattaatctacatagattgctcagaacagtgccaggcatgcagtaagcatgttacaggtcttacctatgagtgtctgtatttaatcctcatatccactccatgagcacgatcccagtttgacaaatgaggctcagagaggttatgtaacttgcctgaaatcaaccagctggtaagtggcagagctgggatttgaacctgtgtctatttgtgcttaaagcttgtgttcttgttcttgcttagtacctaaagatggctgaggatgcttatatggctgctttatcaccaaggcaaaagaggttgatccagttgcctggcaacagaagcttcttcctgtaccccccgcccacctgctgttgagaatctctcggtcatgttccatctgcccacggtgagaactgatagactgcctgtgggatctagcctcaactatgtccctgactctctgggtgacctctctaccatacaatatgacctcaggtctcaccctctaaggatatggatgaattgcaaggtcttctctgccctggctcttcctacctgtcagccaccagtcgcgggaaactgatcctctggctttcatctacgcgagcattgttctgagccacaaagggggcctgggttcggaatgcccggaccactgtgctgccctggaacgtctcagccatgtgggagcagacagacgagtagctggctgactccaagcgtctcagctggcatgagctaaccacatacaggctctgagaaggatggatgggagagggaagaggagaagccacagacatagagaggtagtttccagaagcacagagagccccaagtacaggattccagaccaggatctgttaacagcttactgtgtgaccttgggctagttgcttgccctctctgggttctcatttccttgcagaatcagagttctatggtttttttgaaaatcacctggggagcttcaaaaacctctaatgccccaccccagaatgactgaatcggaatctctggaaatgtcaccttgactttggtgctgtttaaatagccttccagatgattctaagggacagccagggttgagaaaccaccaatttagtttaagtgtctcacttcccagcactgaggccgactacttcatttacggctggtcagtgggagaacaaaactgtaaggggcaatgaaggcagttggccaagtcagtttcactcatgtaacccaagggttacatgccaggtgatgtgcagaaaatattcgttatttggtttgcagctgcaggttgggtgcagctggcagacaggcaggcagggaggaactgaatttgctgaacacccaactgtatgtgccaggcttttcacacagtgtctcattcattgcagagtgagcattcgcgtcattcatcagttagtggtgagaacatccaaggctcgggggattcagcagctgtcctgagtgccacagtaagtgatagagcctggatttaaacccatctttgcttgactctaaagcttgagacagaaacagcccatcctcggagtcaagtgaacttagagaagacctaggacaattgtcggggacagtggtagccatgggttttgttgtttgttttttgagatggagtctctctctgtcacccaggctggagtgcagtggtgcaatctcagctcgctgcaacctctgcctcccgggctcaagcaatcctcccgcctcatcctcccaagaagctgggattacaagcatgcgccaccacactggctaaatttttgtatttttagtagacggagtttcaccatgttgaccaggctggtctcgaactcctgacctcaagtgatctgcccacctcagcctcccaaagtgctgtgattagatgtgtgagccaccatgcctagccctagccatggtttttatctgactaccatgttttctacttctggtttcctgtgggaaagggctgggttggggtgctgtcaatcatgggacctgatcagagaggtggtcacatgatgcagcctagtgtatcagaatctactatccattcagttactgtgacgagttcagagatggacacatgatccacaaagggccaatcagaaccttccctgggattaatatatgactactgagctgaagaaacgttttttgcatgttgagttgctaaggtgagatgatatgatagctagtggccataagacctgccctggaaagagagcgtgtacaaaattagaccagaggtaagccagtggttcctaaacatttgtgtacatcagaattacttggagggttaattaaaacctagattcatgggccgacccacatagtatctgaggcagtagtcctgggctggggcctaagaatgtactttgctaactagtccccaggtgatactactgctggtcctggggtcacactttgagaagcactgagtgaagatatggagagagtcactgtgtcctgatgacaactgggcccatgcccccaaggaaatataagccattaaattctattcttttggttaagctaattttagttggttgctggtcccagcaattgaaagaatctagcttcatataatagcctttgagaccttgcaatgcctttttggcttccagataattggagaggaagaaattacggcaggataaaaacattacgcgtgaaaggctctggcccttaatatttaactgtgccgtggggcacaggggctcatgccctgtaatcccagaactttgggaggccaaggtgggaggatcacttggggccaggaattcgagaccagcctgggcaacacaggaagacacttgtcctacaaaaataaatttaaaaattagccagtcatggtggcacgtgcctgtagtcccagctacttgagaggctgaggtaggaggatcacctgaacccaggagttcaaggctgcagggagctatgatcacctattgcacttcagccttggcaggagagcaagattctgtctctctaaaaaaaagaactttgatgtgaacatttagagacagacactagtggagataccagaaagactgtagtgtccctgtccctgggaattctaggaacagcccctagatgtccagctgggtgaaacctcatatatggagtcttccccagagacaggggactggctgagttgacctcagccggtcccggaagcctccctgacctctccgtacctgaaacccagcgtagaggagaaacagtggcaggatggccacagtggccagtggggtagccactgccaccaccaggctgacctccaggagtccaaaggcgtacatcagcagggaccggagtttgtctggaatgtccacgtcaaccgtgtctgtctccttggagaagcggtttagcaggtgaccaatgggtgtccgctcaaagaagctgatgggagatcgcaccacatcccacaggagcctctggaagagcaacctggatgcccgggccccacctaggagcaccgcagccatggaggcaaacagcccaatggctggggagggagaggaggtaagagcatgagggctggagaccctcaggagcggcccacggggccctgcgcaggtctctcccgctaccccatggtggacatcttatggcttggccaccctgattattatatttttttgagacagggtctcactctgtcacccatgttgaagtgcagtagcatgatgatggctcagtgcagccttgacctcctgcactcaagcgatcctcccgcctcaccctccgagtagctgggaccacaggtgtacgccaccatgccggctaatttggggtatttttgtagagatgggatcttgctatgctgtccaggctggtctcgaactcctgggatcaagtgatctgcctgccttggcctcccaaagtgctgagatgacaggcatgagccactgcgcctgtaccctgcttgtttcttgatgtaatgggttgaagagtgtcccccaaaattcatttgggatgggtcctaaattcagtgactgccatttatataagaatactagaggatactcagagacacagcaggagatatgaagatggcgacacagatgggagggtgtatctacaagccaaggaatgccagcgactgccggcgaccaccagaaaccaggagagaagcctggggcgtattctccatcagaacctccacgaggggccgggcacagtggctcatgcctgtaatcacagcactttgggaggccaaggcgggtggatcacctgaggtcaggagttcgagaccagcctgagcaacacggtgaaaccctactaaaccctactctctactaaaaatacaaaaattagctgggcgtggtggcaggcacctgtagtcctagctactcaggaggctgagtcaggagaaacactggaacccaggaggcagaggttgcagtgagccataagccgagatcgtgctactgcactccagcctggttgacagagcaagactccgtctcagaaaaaacaaacaaacaaacaaaaaaaccaaaaaaacctccacaaagagttaacactgctgacaccttgattttagacttcaggcctcagaactgcgacagaacaaatttcaattgtgctgggctcccaagtttgtggcaacttgtttggcagtagccctgtgagagaaatgcacatccttcctcccagtgctaatctgtatgcctggggtggggctaacttctcctctggggtggggcaaatttcacccatggccaatccaaaccactgcagttggttcagggatgaacacataacccaagtcaggccaatgacagggagacctgggacttcactagaacttttggaaaagtggtacttggttgttggaggtagccaagctggagccgtggaatatcatcttactgccagggggagcagctaagctggacaggaagctgtcacagaggagggaaataaagcgatttcttgtttggacccctacatccagccatacctgaagccagaaatctagggatactggtcccaagagccaatcaattctcttgttgcttaaacactttgaattggagctgaatttgtttattttcagacggagtcctgctctgtcacccaggctggagtgcagtggtgcaatctctgctcactgcaaaccccacctcccaggttcaagcgattctccttcctcagcctcccaagtagctgggattacaaacactgacaccatgcctggctaatttttgtatttttagtagagacggggtttcaccatgttcgccaggctgatcttgaactcctgacctcaagtgatccacccgcctcggcctcccaaagtgctgggattacaggcatgagccaccgtatctggcctggagctgaattttttattctttgtattcgagagtcataaccaatttctctctctcagctcccatctctccatctttaggggagagtaagacttgcccttagctatcaaatgagggatggaagtggaaggattttgaaagggctatttgccacccaaatgaggatttgggttaattccagggctcggctgactctgagaatccctaatttcctcttggttaagtaaccattcgccttgagtattccactgtacatgcagttgtggtgagtaggtgtacaggttcttaggactagaagagtcctcaagttcaggcctggcgccccctattttacaggggaggtcacaggctcacagcattttggtgatgtggccaatgtcacccagtgaatgaggacgaatcaacatgaaaacgaggcaactgtcctttaaagatgaagccaggccgggcgtggtggctcatgcctgtgatcccaacactttgggaggttgaggcggaggattgcctgagcccaggagtttgagaccagcctgggcaacacggcgaaaccgtctctatcaaaaacaaaaattagccagcatggtggcatgtgcatgtagtcccagctactcgggaggctgaggtgggaggattgcttgagcccaggaggcagaggttgcagtgagccgagttcgtgccactgcattccagcctgggtgacaaagccagacccagtctatatatatgtgtgtgtgtgtataaataagaagccaaactcacatgtgcactcctgttactcccttcagccaggccacgtattaaaaggagaagaaccaggggttggggacagggtgggcgaggcaggagaagggtgggtgtggttgcaaaagggcaacacgagagcgcctcgtggtgagggggttgttcagtatctcaactgtcaaccatcgtgatggatgcgagagactgaacaggggatacgactgcacagaggcaaacatgcgcacacccacgtgcaagcaaaactggggaaatcacaatgagatccatagggccgggtgcgggggctcacacctgtaatcccaacactctgggaggccgaggcgggcagatcatttgaggtcaggagttcgagaccagcttggccaacatggtgaaaccccatctctactaaaaatacaaaaattaaccaggctgcacacttgtaatcccagcttccagctactcaggaagctgaggtaggagaactgcttgaacctcggagatgggggttgcagtgagccgagacggcagcactgccctccagcccgggcaacagagcaagactctgtctcaaaataaaataaacaaataaataaataaataaataattgagatccatggattgatgggtgtcaggatcctttgtgtgatactttactatcagtttgcaaaatatcaccaatgggagaaactgggcagactgttcaaggtagctggctgccttatttcctagaactgcatgtgaatctacaattatttcaagaagaagtctttccatttttgaggaggagaagaaggagtgatagcggtgatgcatttgttagggagggtctggctctgtctggaggtttgggggcaggcactgaaagccaccagcaggcaggccttgcagacgccttccgctagtggggagggactgggagaggttctgaagcttccagaaaaggagggatgtgccctgtccttcccgttccctccagcctcatcttaaggacgcagatctttgcctggaccccagacgttttgcacactgttccagggggacagggtgacccagggaggggtggggtaaaggagtcctgagcaccccttggtgcagctgggaggagagggatgaggagggcaggtgaggcgtaccttggagacagccgaggagcccgaagatcccgccacgcagggctgcctgcgtctgctgcccacctactgcagggtcgtccgcccacaggctcagccagtagccccggcagaaggaggccacttgctggcagaggaagaggaagagtgcgtagaggcagaggggggtgcccacggcacgcaggtaggccaggtgcactgtggccttcacctgtagcacacatgagggagagggaggcagagagagcccccagtgggaggggtgggttgaggcaaggccaggcgaggctcccagaaaacatgcccatggcagatgggaccaccacgcagacctcactggttctcccgctgtgcctcccaccagaagcaccatttccccgacaggccccagccagccttagaacccccatctcctatacaatccccagggagctagtattaatattttttcttttgttttttttttgaggacagggtcttgctttgtcgcccatgtcacccaggctggagtacactggcatgatcatggctcactgcagccttgaactcctaggctcaagtaatccccccgcctcagcctcccgagtagtcaggactataggtttgtaccaccatgttttgttaattttcatagttttaaagagatggaatctcgctgtgttgcccaggctagtctcagactcctggcctcaagtgatcctccctcctcggccttccaaagtgcttggattacaggtgtgagccaccacacccagctagaagggttttcttgaacacccaccataggtcaggcatgtgtctctccttataacaacctccatttcacagataaggaaactgaggcacagagaggttcagccactggcttaaggtcctgctcctacaaatctgaagttctctgcacagctgcagccagacgggactgttgaaaacattaatctaattatatcttgtcgttggcctgtccatggctatctcttgctcttagaagaaatcccagccaggaggggtggctcatacctgtaagcactttgggaggccaaggcgggtgtgtcacctgagctcaggagtttgagaccagcctggaccaacgtagtgaaaccccgtctctactaaaaatacaaaaattagccacgtgtggtggcaggcacctgtagtcccagctactcgagaggctaaggcaagagaatcgtttgaagccaggaggtggaggttgcagtgagctgagattgcaccattacactcttctctgggcgacaagagtgaaactctgtctcaaaaaaaaaaaaaaaaaaaaaagaaagaaagaaagaaagaaagaaagaaagaaattccaagcttcttatctcgcccccactcactgcctgccagcctcatgggacccctttctctggcaccctaagctacttcccacctcggagccattgcacctgctgctctctctgcctggagcgctctttctcctgccctttgtatgactggttccttcacacattctttggggaagctcaaatgtcacttctcagagcatcctgtccataccaaccatggtagggtttctcagtggtctctatttcatcattctttcttttaagaggcagggtctcactctgtcacccaggctggattgcagtgacatgatcatagctcactgcagcctcgaactcctggcctcaagcaatcctcctgcctcagcctctgaaagtgttgggattacaggcatgagccactgcgcctgatcattcttattttctttatagcacttattgttattggacatagcttacttattagcataattatttactctccgtctatcctcactagtgtctaatctctaccagacttagcctggcacatagtgggtattgtgtacatgtttgctggatggatgagagggtaggtgggtgaataaatgagcgggtgggtaggtaggtaggtgtgtgaatgagtggatgaatggatggaaagatcaatgaatggatgaacagctgaacagacagatgcataggtgagggaatggttggatgtattgttaggtgggatagatggatgggtaagcgaatgggatggataaatgagtaggtgggtgagtggatgggttggacagataaatgagtgggtgggatagatggataaatgagtggatgggatggacagataaatgagtgggtgggatggatggataaatgagtgggtgggatggataaatgagttggtgggagggatggataaatgagtaggtgggatggatggataaatgaatgggtgggtgggtgggtggataaatgggtgggtgggatggataaatgagtggttgggtgggtgggatggataaataagtggatgggatggataaatgggagggtgggatggataaatgagtaggtgggatgcataaatgagtgggatggataaatgagtgggtgggatggataaatgagtgggtgggatggctaaatgagtgggtgggatggataaatgaatggatgggatgcataaatgagtgagtgggatggataaatgggtgggtgggatggataaatgagtgggtgggatgcataaatgagtgagtgggatggataaatgggtgggtgggatggataaatgggtgggtgggatggataaatgagtgggtgggatgcataaatgagtgagtgggatggataaatgggtatgagtgggtgggatggctaaatgggtgggtgggatggctaaatgagtgggtgggatggctaaatgagtgggtgggatggctaaatgagtgggtgggatggctaaatgagtgggtgggatggataaatgagggggtgggatggatggataaatgagtgggtgggatggataaatgggtgggtgggatggataaatcagtgggtaggtgaatggatgggatggataaatgagtgggtgggatggataggtgggtgggtggatgagcatctaggtggatgatggaatgggtaagtaggtgggtggagatacatagcagtatagaagatgagaaacagtgtaagcttcagactcagattggcctagatttgagtcccaggttgtgtcccaggctagatatgaaaacacaaacaagtctcttaactgtttaagacttcagtttcttggctgggcacagtggctcacacctgtaaccccagcactttgggaggcagaggccagaggatcacttgagcccaggagttccagaccaacctgggcaacatggcaaaacccatctctactgaaaatacaaacattagctgggcatggtggcacacgcctgtagtcccagctacttgagagactgaggtaggaggattgctttagcccaggaggtcgaggctgcagtgagctatgattacatcactgcggtccagcctgggtgagtgagcgagccactttctcaaaatcaaaataaaataaattttaaaagaattcagtttctttatgtctgaaatagacctatcatatctattttttagggtggttgtgaggattaagaaaatgaacatctagaatgctactggcacatagtaggtgctcaagaaaggtgagtatcactgccaagtgctacatttggtgggaagacttgggcccctggaggtggcagcagtgggtggggaggggtgggtgaagctggtggttaccctgccgtattggatgctgtcctttcctgctggccatcctgccctgtcagggtcatccagaggaacctctgtctgggcttctgaagtggtacggtccttctcagggactgacttgatggacctgtcatttagaggaaatgaagacaaagtcagtatctctcccaatggtggggtgtatgtgcctaaccctcaggcccactgacagccactgagctctgggtacactctgtactctttcattcattcatttatctaacagaatactgaccagatatcacacttcccttcttcccatatggtacccagctaaatgccatctattaccccagggtcaagcaagcccattcttctgatgccaattcacaggatgaacttaacttgcccaccattggaactctgttctcagaattttcttttttttttttttttgagatggggtcttgctgcattgcccaggttggtctcaaactcctgagctcaagcaatccacctgcctcagcctcccaaagtgctgggattacaggcatgagccaccatgcccagcctgttctcagaatttttattttggcttaagctttcgtgcaattgttttgttcctactgtataccatcagatttgtcagtccaactggcagaatataaattatgcacaattcagatgctaaagactctttgaatgttttatctgtggatgagtgggctgacttaacctctgtgcctcagtttcctcagctgtaaaaataggaatattatctatctatccatccatccatttatccattcatctacatacctgtatatctacatatacatgtctacctaccttctattaaattgaggttagcccaaagctgcctccttacatattttaagtttggcctaaaggttttccccgtacatagtgaactgtaacctaattggactcaaacagactgcaacctactcctgtgtcaatcactgagtttcagccaatcaaaggcaaccaaccgttcaaaccatgttccaataaagcaaacgctgagctgtaaccaatccggctgtttctgtacctcacttctgttttctgtccttcaccttcctttttctgtctattaatctttgaccccgtggctgtaccagagcctctctggacgtattctggttcagggactgcccgatgtgcggatcattctttgcttagttaacctctgttagccaggtgcagtggctcacgcgtgtaatcccagcactttgggaggctgaggcaggtggaacacctgaagtcaggagtttgagaccatcctggacaacatggcaaaaccctgtctctactaaaaatacaaaaattagccgggcctggtcacatgtgcctgtagtcccagctactcaagagactgaggcatgagaatcgcttgaacctgggagacggggattgcagtgagccgagattgtgccattgcactccagcctgggcgacagagcaagattctgtctcaaaacccccccccgcaaaaaacaaaaaacctcagacacattaaatttgctagaggttaatttggcacaatctcggctcactgcaacctccgcctccgaggttcaagtgattctcgtgcctcagcctcccgagtagctgggactacaggcacatgccaccacgccggctttttttttttaatttacttattttttatttttagtagagacgggttcaccatgttggccaggctggtctcgaactcctgacctctagctagtgatccacccgcttcagtttcccaaagtgctgggattacaggtgtgagccaccatgcccagccttaatgtgtctactggttttcttttaacatgactacctatccatctgatcttacttcagattcttgtgcgctgtgaaggtggtgggatttctcagtgtgtgtgtgattgagaagtgccctcagggtggctagctgggatgggggtcagccccaatggtccctggggactgaggcccctcaagatcgctgccgcccaccacccctgtatagcaggcacttaagctcaggccatctggtatcagtggcctgttgttctgcttcccaagacccctctcattaagaggggagagtatcaggcagcaggtccttctgctgccgacagctccacagtgagcccagctgtgtcctggctggagggagctgagaaaagaggggaccggaggcctcctcctggccccttgcccacgtgttctggccagcgtcaagtgatgctgtgcatacagacccaagccctgtgcatagccagcctgtcaaagcataagtggccaggcctggcatggtggtttacagctatggggaggaaccagtcctgccctactgcagcattcagacaactccagcaagctggcctcggcccacttgaagacatccatcaattggaaggcatattgttcattccatgaactggccttataggggcctaatcatcttggctaactggaccaattttggtaaattatccctcagcagggcaccatgggggggacttcagcaggttctctatccataatggttttggttgcccgcctaactgcccgagatgcgggtggtcccttcagctacttcagcttcagcctgtgcccttctgagtgtggcaccatggtggactcacctctcgcgtctaagctcgggcctcctgcctgcagaggtgcctctggggtccttggtgctggtcccaggttctgtttctgcaaggtcaagagagtcctgtcacgcaacacggcccagatacccactttgacacccactgactatgtggccttaaccgctctgaccatccatttcccctgatctggctcctgccacgtctccagcaacctctctcaacaccccactctgagttcttccaggaacatccttcaggcattcactcactcattcatttcttcaatcagtgataactgagcacctactatgaacttgaggttggaaaaacagcatttaacactgtacaaagtcaagttacctctgtttcccccaacagccttgctcaagcagttccttgtgtctggaatgcttttttctggctaactctcacctaccctcaggtaccatctcccctaggaaggacacctccccaccactatcccccaggtgtggccagtaactgaaagcaaatctgtagtagtttaaccacagacctgtaagcaacaagtaactgctactgtaagctgctaggatttggggggctatttgttacacagcatcatcacagcaaaagctgaccaacacaaacaggcaagttctatcttcaagcttcaggactgtgacattgtgaatcaacacttaaggttttaaccaggttgggccagtgctaagcagatgttctcagaagaagcaaagcctgagattgagggagacctggatgtgaatccttgctttgtcatgaagggatagtgtagagggtagcaattaaaaaacacattctctggaatcaagttgcttgggttcaaatcccagtgctgccacttacaagccatgtaacctgggactagttccttaacttctgggcctcagtttcctcatctgtgaaatggaaatgattctagtaccagcctcacaggggcattatgttgattaaatgagctaacctctgtgatgtgctgttagttgctacttttcagtcattgtgagtgagcttggcttggcaactttacttccagaaccttgccatgtatccagcacactgtttttctggattattagaaaccctagctagcatggtgtagcttgctaggcatcaaagtccttcttgggctgtctccatagcaactgcaagcatagactctggagctggacatactcaagttctaatcttgtgaccttgggcaagtgatttaactctctttgcctcagtttgctcatctgtaaaatgacagcaataacttcacatgcctctggggcatgtgtgagaatcaaatgaaatagtgtattttttacagaagcacttagcacaacccctggctcatggatgatgttatcggctattcttggagaaaggtgacctattaagagagctgtctgcttccaggcctaggcctgcagacagggtgtggccagagcactccattcatgccagtaggacccttcgagccttttcccccaagggtggcaggagccaggcctggagaatcagcaaagcccacctagtacctccttctcctctatctcctggctgtctggcttgatccagaagacacatgagggcccccttcctctgcagaagctcctggtaggaacccatctctgcgatggccccatttgccagcactatgatccaatcagcctggggcaggatgtggagtgcgtgcgtcacgagaatccgtgtctgggcagggaaggggtagaagttacacacatgtggccgggtgcagtggctcatgcctgtaatcccaacactttgggaagccaaagcatgtggatcacttgaggccagaagttcgagaccagcctggctgacacggctaagccccatctctactaaaaatacaaaaattagctaggtgaggtggcgcacacctgtagtctcagctactttggaggctaaggcaagagaatcacttaaacctgggaggtggagcttgcagtgaggcgagattggaccacagcactccatcctgggtgacagagcaagactctgtcaagaaaggaaagaaagaaagagaagaaaagaaagaagaaaagaaaagaaacaaaggaaggaaggaaagagagagagagagaaagaaagaaaaaaaaaatgtacggccgagcgcagtggctcatgcctgtaatcccagcactttgggaggccgaggcagatggatcacctgaggtcaggagttcgagaccagcctggccaacatggtgaaaccctttctctactaaaaatacaaaaaattagctgggcgtggtggcgggcacctgtagtcccagctactcgggaggctgaggcaggagaatggcgtgaacccgggagccggagcttccagtgagcggagatcgcaccactgccctccagactgaaagacagagcgagactccatctcaaaaaaaaaagaaaaagaaaaaagttacacacatgtgcttggccagcctcctgagctgggggttggggtgggggtattgtccctggactcagagtggggacagctccccttcttgtgctcctgccgcctttcttgtaaacagcatatccaaatagagaaacagaggggactcccttagcctgtgtctcaaaacaagaagacaaggagtacatctgaccctggccaatcatccaaggcaaagctgtagtagttaaatcacagatccataaggaagaaacacctgctgttgtaagctgctgggatctgggggttgtttgttacatagcattgtcacagcaaaagctgaccaatacaaagaggaaattggactcaagtggaagggggaggtgagataaacttgggttaggactggatgctaagtgcttcctctgcctttgccctgtactgtctgacacatgttcccaaacttactgttccctggagtagtccaccaggcccaatgacctggttgaagacatgctggccaacgtgggcatccagggccgccagggggtcatccagcaggtacacagctgcctttctgtatacagcccgggccaggctcagccgctgcttctggcctccggagagattcatgccctgtggccacaaaaggaacagtggcctgagtcagcatctacagggtgaaactggggtgcccaggctgtggcaggtcagggcacacctgcccatcagggtgaggtacagctcaacatgcctattccctggggacaggcccagcttccaaggcactcgctctcaagccaacaatgcctccatccttacccgacctcacttctccacttcccaagcacgcttcctggaggagttacctacacttcccaatccactctgtctcctcctgctcactctctctatctctttgagtccaactcttgtttccctttctccactgagaccaccatccatttccctattccctcatccagtggcagcttttcagtcctacttttgtattttaaattttaattgttttcttttagttttcattgatatgtaatagttgtaactattcgaggggcacaagtggtatttggatacctgtagggcagtggtccccagcctttttggcaccagggaccagttttgtagaagacgatttttccatggacctgggggcagggggatggcccgggggatggtttcaggacgattcaagcacattacgttgattgtgcacttctattattattattactgctgttgtcgttgttattattgagatggagttttgctcttgtcacccaggctgggagtgcaatggcatgatcttgactcactgcaacctctgcctcctgggttcaagcaattctcctgcctcagcctcctgagtagctggaattacaggcacccactaccacgcctggctagtttctgtatttttagtagagatggggtttcaccatggtggccaggctggtctcgaactcctgccctcaggtgatccgcccaccttggcctcccaaagtgctgggattacaggcgtgagccactgcgcccggcctacttgtattattattgcattgtaatatataatgactcaccatcatgcagtatcagtgggagccctgagcttgttttcctgaaactagatagtcccttctggggatgatgggaggcagtgacagatcatcaggcattagattctcataagatccctcacatgtgcagtttacagtagggtttgtgctcctatgagaatctaatgctgccactgatctgacaggaggtggagctcaggcggtgatgggaacaataaggaatggctgtaaatacagatgaaacctcactcgcctgccctctgcccacctcctgctgtgctgcctgcccagttcctaacaggccacagactggtgctgatccatggcccgggggttggggacccctgctgtagacaatatgtaatgatcaaatcagggtaactgagatagtcatcacctcaaatatttatcttttgtattgcgaacacaaccatccttctcttctagctatcttgaaatatacaagtaaatgatcattaactataatttcccttgtgcactattgattactttaacttattccttctatctaggccttcttgtctttcattcattcttttaaaacttatttttatttatttttgagatggagttccactctgacacccaggctggagtgcaatggcttgatctcggctcactgcaacctctgcctactgggttcaagcgattctcctgcctcagcctcccaagtagctgggattacaggtacgccaccatgcctggctaatttttgtatttttagtagagatggggcttcaccatgttggccaggctggtctcaaactcctgacctcaagcaaccctcccgccttggcttcccaaagtgctgggattacaggcatgagccaccgtacccagccattcattcattcttacattcagtcattccactaataaccactgcctcgttatcataaaccaggcatggttctaggctctggagaaacagcaatgagcaaaacaaagttgctgctctcttaatggatccatcattctcatgaaggggacagagacaggcaatccataaacaagtaaggcagacagcacatcaggtggaaagtgctatgaagaataaatagtaaagcagggggagccaggttcaggggctcacgcctgtaatcccagcactttgggaggcggagctgggtggatcacttgaggtcagaagttcaagaccagcctggccaacatggtgaaaccccatctctactaaaagtacaaaaaaaaattagccagttgtggtggtacatggctgtaattctagctactcatgaggctgaggtgggaggattgcttgaactactcatgaggctgaggtgggaggaatgcttgaactcaggaggtggaggttacagtgagccaagattgtgccactgcactccagcctgggcaacagagcgagactccgtctcagaaaaaaaaaaaaaaaaaaaaaaaagagaaaaagcaggtgcaggtgtagggtgcactaacaatagtagggtggctgtggtggtagataaggtggtcaggaaaggcctctctgtgaaggtgatagaagtgagggatgagccctggggactcctggggagagctttccagcagagggaacagcagtgcaaaggccctggggccagagtgtgctgtgggggatcagggaatatcacagagactaaggtggctgcagtaaagctgagaggtgatgatgggagatggggctaatggataccagagccaggtcacagggaccttgccagggattgtcatgacttgggctttgtctctgaggtaaatggggagatcacctgaggtccggagtttgagaccagcctggccaacatggtgaaaccctgtctctactaaaaatataaaaattagccaggtatggtggcatgtgcctgtaattccagctactcaggaggctgaggtgtgagaattgcttgaacgtgggaggcggaggttgcagtgagccgagattgcatcactgcatgccagcctgtgcaacagagcaagactctgtctccaaaacaaaacaaaaaacaaaaccacaagtggtgggctggatttggcttggggtcacagtttgccaacccctgcccaatccatagctccagatgcatatatcctgtttcttggacatctctgtccagaccccttggtgaggcccagagaggggaagcaattacaccaacattactcagcaaggcagggcagagtaagacaggagtctaggtcttctcactctcagttgtcagagagctcctcactgccaatccctgccacaactccctgcctctctctttgtgtctatttctgcttatcaattagtgattacgtattgagcacctagcacgtgcttgacgctgagctgagccctttttctccgctacttccctaaccattcctctcatttctccatcatactgcccatgatgagtcggggacccaaatgactcccaactgcaatgtctccctgtcccaaaaagacccccaaactctcacctgctccccaattgaagtgtggattccctcagggaagctgtccacatctggctgcagggcacaggcttctagtactctctccagccagggtgggtccagctcctgcccgaagcacacattctctaccacagaggtgttctgcacccaggcctcctggggcacgtaggccacagcaccctaaaacacaacttactttggtcacaggaggatgatggggacagaggtgggataggttttgaggagcagtgggagctgggctctcagtggtgggtgagaggtggagagaatgagtgaaagtgaacttggctgggatggggagggtgggaaggcagcgaggaagtgggactttcaggatggggacatcctagcagacaggctgggggtggcctcacctcgatgctcacgaacccctccacctttgacagctccccaaggagggcggacagcagggaggacttccctgcccccactggaccgacaacagccagcagacagccctggggcaccgtgaggtttattctggacacgcaagaggggagacatgaccttggttagggttcagcccgcctctgtgaggaaggatgagccccagacggagctgagctttcctgctctgggagtctccaagaggacctgtggggctgttctttttcccagtccttgtctagctatttgaggaactatcctgtgcacatctgtgcatgtacacatgcacacaaagcgtgcacacatgcatgcacatttgcacactcatacaagcatgctagcatgcacagcaacacaatgtgggcacgcatccacacacacacaagtgcatgcacatacccaatcaatccatgctcacacgcatacatgtgtgcacacatgcacaccacgcacacacacacagggttgactatagcctgagggtttcaccagcctggcctcctgccttggctcttgcgataaataggctctttcctccctccctcccgctactcttggtcccgccccactcctgtccacgtcccacagcccatcctccacccagtgaccagagggatctgttaaaacccaagtcagatcgtgacacttcccagctaaacccgccagcactcccatttcactcagggtcaaagctaaagtcctgacgatcaggaatgacatctcccgcctccttccgctctgtgcctcagctgctcggccctggccttgctgacctccttgctgtttcttgaacacaaaaggccagtggttctcaccagggggtgactgcatcccccaggagtcatttggcaagatctagagatatttttggatgtcacaaccagtagggggtgctgctggcatctagtgggtagagactggggtcagctaaacatcccacaatgcacacgacagcccccaacaaaggagtttcagcccaaaatatcaaccgtgctgaggttgagaaacccaggtccaggcactctcctgccccaggacctttgctgatgccattcccaccgcctagaaggttcttctcccaggccgggcacggtggctcatgcctgtaatcctagtcctttgggaactgaggcaggtggatcacttgaggtcaggagttggagaccagcctgacgaacatggtaaaacccatctctactaaaaatacaaaaattagctgggtgtggtagcatgcgcctgtaatcccagctactcgggaggctgaggcaggagaattgcttgaatccggaaggtggaggttgcagtgagccgagatcatgccattgcactccagcccgcgtgatagagcaagactccgtttcaaaaaaaaaaaaaaaaaaaaaaaaaaaaagaacagctcttctcccagacactccttccttatgatctcggcttgaatgcaaagccttccctcgctagacatgccatcgtactctgttcccttgctctggttttctgtttgggcctcacctctatcagcatgtcaccccacgagagcagggcccttgtctgtttccttcgccctatccccaatacctagaacagagcgtggcccatacctagtgctctatcgatgaagtgagtgaatgacaaccaatacaaatactacctggggcatattccttctcttcttagggagtttcagggctgtctgagatttttggccacaaagaccaagcgatagagttggagactatagatgatcatgacctcggactgatacaggaggcacagaagtgagcacagctgatagggctgaaccttggggctcctctcagccagccctcccttggcatcgtcttggccagcctgggagcacaggggtgtctccccctaatgggggaggctcagatgccctggtccccgtctgcaggagatactggtctatgctgtgcaggtccccaccttcaggaggtagagatgtatcctgagaacctccccggcagagccccagcccagccaaacccaccctccagtcccaggctggaaacctacaccacctctcaggtgggaggcagcaggagccccatgcatcttctccctaaaaacatgaggctggttactacgggtgtcgttctgtacctgtggaggcagggagggctttcctgggaccaggcgaaggtggcactgtgtatggtgatgcaatccttcccggcagctgcagggcacaagaggccatttacaggagacccctgacctggccggcctctgcatcggagaggcccccaggcaccatcccccgccccccccaggggcagaggctgcaggaagaaatctctcccactgaacaaattgccctgctactcactggcttgtgggtgaccccgcagggttcttgttctgtccgtgtcccatggctacataatccagggggaggcaaactgtggcccagagaccaaatcctgcctgctgccttttcttataaataaagttttattggaacacggccacatccattcatttctctatttcatgctttgagcagttgtgacagagactgtgtggcccacaggcctaaaatatgcacaatctggtcatttatggaaaaagttagtgaatttctgaaataaattatcatcaaatcccagccttcccagagtgaagggggtgttattaatttcactgtggccggcacagtgtctcatgcctgtaatcccagcactttaggaagcagaggtggtaggatcacttgaggtcaggagtttgagaccagcctggccaacatggcaaaaccctgcctctaccaaaaaatacaaaaattagccaggcgtggtggtgggcgcctgtaatcacagctacttgagaggctaaggcaggagaattgcttgaacccaggaggcggaggttgcagtgaaccaagattgcaccactgcactccagcctggatgacggagtaagactgtgtctcaaaaatactactgctactactactaattattattattatttcactgtgataacaagtgtaattagattagtggttcttgatccttaagacgtagttagaattgcctgaaagattttctaaaaatcaaagctctcatggcttagcccagatcaattaaattcatcgtcacaattagctgctataacgattaacatgcccattttggagatgggaacacggaagctcagagagatgatctacttgtcaggatcacccagctagtcagtgctggggctgggatttggacctgggcagttgaatgccacaggctcggcttcttaccactatgtgggtgttttccaggtacacagtttgcccaggttcttcagtgcaacaagggggagggtgtcttggcccgtggcataaaagaaggatggggtggagggggaagcccaggtaacttgagcttggtaagtctcatcgtgcaatggtgcttgaaatgctgctattttccagcttgatcaaaatgctgtcatgcttattacctgggactttctgcatgaggacaaggacctggtctgttagagcaggagtcctcaacccccaggccacagactggtaccagtctgcagcctcttaggaactgggccatacagcaggaggtgagcgcagggcaggtgagcagagtgtcatctgtgtttatagccactccccatcactcccatcaccgcctgagctccacctcctgccaaatcagcagcagcaatagattctcaaaggagcacgaacacttgtgaactgtgcatgtgaggaatctgggttgcgtgttccttataagaatctaatgcctgatgatctctgtctcccatcacccgctttggggccatctagttgacggaaagcaagctcagggctcccactggttctacgttatggtgagttgtataattatttcattatatagtacaatgtaataataataaagggcacaataaatggaatgtgtttgaatcatcccaaaaccacgcgcctctccccggtccgtgggaaaactgtcttccacaaaaccagtccctggtgccaaaaagcttggggaccactgtgttagagtgttccctgttgtacacccaggatggtacaaagtgggcgctcagtgagtggtcgctgaatggctagcagaaagaagagcagcacggtgccagtttccaagtgacacgcagatggcgtgatctgcacgtgtcatccattgcccgcagcccccatctccccccagtactgatgctggcttgccattatgggctggggtggcccccacatcccccatccctcccacacccctcctgccagactcagcactcaccgcttccagaggaacttgagtctacgacaccagggtcaacttcttccaggcagaggaaggtgaccagacggtcaaaggacacccgggcctaggaaaaccgaagccgcaggtcacccagcaagaagagcaaagaactcaggttttgggtgtcggtgtctcaagatgtgtggcaacagcttcctgtctaccaagctctgtgcataggaggcgtgaggacaaagctttctagttcatgggaaacgatgcaacccgagtggtgaccttgatggtggtgatctcccacctctgcgatcctacaaatcagtgacaccgaagcaagccagctgccattctgcagacaagatctgggaagaggatggtggcttttccaataaggttatcaagccattgtgtggaacaatttcaaatgttgtccacctgggggcgctctctcccagtcacaaacccatctttggggaagaaagagaccagtcgttaaaatagagattaggccaggtgcagcggctcatgccggtaatcccagcactttgggaagccaagtgcaggaggatcacttgaggccaggagttggagacctggggaacatagcaagactctttgtttctacaaaaaattaaaaaaattagccggatgtggtggcccatgcctgtagtcccagctactcaggaggctgggaggtagaagcatcacttgagtccaggagtttgagcatgcagtgagctgagatcgtgccactgcactccagcctgggtgacagagtgagacactgtctcaataaataaattaaataaataaataaataaataaataaataaataaataaggcggccaggcgcggtggctcatgcctgtaatcctagcactttgggaggctgaggcgggcttattacatgaggtcgggggttcaagaccagcctggcctggccaacatggtgaaaccctgtctctactaaaaacacaataaataaataaataagactgggtgcagtggctcatgtctgtaatcagcactttgggaggccaaggtgggcagatcacctgaggtcagcggttcaagacctgcctggccaacatggtgaaatctcatctctactaaaaatacaaaaaaaaaaaaaaaaattagctgggcatggttgtgcatgcctgtggtcccagctacttggcaggctggggcaggagaatcacttgaatctgcgaggtagatcttgcagtgagccgagattgcaccactgcactccagcctgggtgacagagtgagactccatctcaaataaataaataaataaaaataaaaaataaaaaacatggagatggctcaggtatgccgccgtttcttgttttcaccatgctgaaaggactagagatagcaaaggaagagaaacaaaatcgctttgtataaaaaagggaactgacatgattgcttgtatgtggaattgctgggcagatggacaagtatgcatgttctgaggtgtgtgtggaaaggtctgcacattgccctccaaaggctgaccccttccagatgtatttgctgtactctctgcccgcctctgttcttgcccctacccgcctcttttccagctccacaccatccctctccctcccactctgtcttccctctcctctgcaaatggcaggggtagggaagctggagccaggtgtagcccacgcactctcccaggatggctccagcccttgcacccacctcacctggacgagggagtggatggagaagggcaggaaagcctgggccttgttgaggatgttgagaactgtgagagtcacaaaggctttctctgcattcatagcattctcggccaccagagtgtggacagcaaacaccaccagtgcgacctggggggtgggggggacacgtggggcaacagtgagacacgcaagcatggatagggcagcctgggcaagctgtggtgcctgcacggtccatgtggcccacccgccatgtccgcatgtgcttccctccgtagatcccactcccagtcctgctaacacatgtcctctccgcagtcataagctacataaggctctctctaaagacacagcgcattgctaatggtgatgagtgcgcagccccacggctctaggcatcactagaacctaggggagaacctaatgcctctaggttccaggcatcgggggacagcagagtttttgatcttggtagccctgttgttctagacgtggtggaacttgtgattctagagtcccttggaagatgactctaaagttgcaggcaggagcagcacttgagggctctaggtgttggtgccatttgtggtgcttttttttttttttttgagatgaagtcttgctctgtcgcccaggctggagtacagtggcatgatctcggctcactgcaacctctgcctcctgggttcaagtgattctcctgcctcagactcccaagtagctgggattacaggcgcccgccactgcaaccagctaatttttgtatttttagtagagacagggtttcgccatgttggccaggctggtcttgaactcctgacctcaggtgatccacccacctcggcctcccaaagtattgggacgacaggcatgagccaccacacccagcctacgtatcaaattttttaaaactgtggtttaggaaggttgttctgacagcaatatgaaataaattacagaatggcaggacaaggatcacgtccagtgacagggtggctatggacatctgctggccaggatcagggaagtcactctgacccaggattctacctctgccacccccctgcatctgtaccctcctccccacatcggtagaagcctggaactctctctgagagttcagcagactttatcagccactgccacctttgctagaataatatgattaattagttcttgtagaagacagcagggacccagagagaacaggatccagaatgagtgggttttgatggacggggtggtaggatctggggggctccacctacctcaccctgcccccacccccgcactccttccccagtgctgctcagcatagagactagagtgacgtcaccagaaatgtagacacttggaaggacaccagcgacacagagaagaggaggccggaggtccgcaaggcgcccagctcctggcctcggatgcccaggactctgtccagaaaggctccctcccagccatggaacttgatggtcttcgagttcctgaggatagagctggtgagccgtgcccgtgagtccttctgcctcatttgctcctcctgggatcggagggaaaaagagagatgaagacagggacagttgagaactcttccctgcaccctgacagccacccttcagcaaatcccattcatctcaccaaactgcgtcccaaacctgtctgcctctcagcacctctgaccctcactcctggtccaaccaccatcatcctgtacctggacttctgcaggagtgcccctgggataatgtgccccatggaggaagcctctgatgcccggagaacagaggcagcctgagcccacctgggtatgacaccatcaggaaggctacctggaggtggttgatgcctgagctacgtctttttttttttttaccttttacattttttgtggagttggggtctcactatgttgcccaggttggcctcgagctcctgggctcaagtgatcctctgccctcagcctcctaaaatgctgggattacagcctgagctaaatcttaaatgaccaggaagtgcgtgctgagcaggcagaggatggggggatggagctggagaagagggaggggaggggcttgagatgggggtggggggtgggggctggggggtaggggggtggcgggggcacctaaaacccaggcacagggaatagcatgactcagaggacactcagtgtgaccagaggagcgtgtgggcagggtcacttggcactttaaagtcaggcagaagaattcagggtctcctgtgcttcaccatggggcggggggcatcatcagaggggcagctgcctggagaaggttttactttttgagaccgagtcttcctctgtcgcccaggctggagtgcagtggtgtggtctcggctcactgtaacctccgcctcctgggttcaagcgattctcctgcctgagcttcccgagtagctgggattacaggcgcccgccaccacgcccggctaaattttgtattttttgtggaggcagggttatgccatgttggccaggctggttttgaactcctgacctcaggtgatctgcctgcctcggcctcccaaagtgctgggattacaggtgtggcctcccaaagtgctgggattacaggtgtcagccactgtgcccagcctagaatgttttagaggagtccacgcaggaggctgaagaaacagcccaggtgacagacggacactgggacagctgggccaagagaggaaataagttccttccctccatcccccatctctccctctctctttcccgccttttctttccttccttccctatctcctttcttcctctttcctttgctttcttccctctttccttttatttccttccctccctcccccctttcttccttctctccctcattccttctcttccgccctcaattctttccttccctccttccctctgtccttcctcccctttcctatctttccttccctccctccttttctctccttcccctccctccttcctctcctcctttccttcttccctccctcctttcttccatagttcacaaacacttactgagaaccttctgcctgccaagcactaactagatgccgagttggccacaatcagtggcctgtgctgttgcaaagcttccagttaaggaaaacaaggcaatcaaccctgccgggtgcttcctgtaggaccctgtaggttgtgggaagtgctgtggggggaaaaaagcaaaaacaatcccagggcaggcaaaggagaggctgctgctgggaggggagggatggacgtgccatttccttgctggagggtggtgagggaagccgccctgactgcagggaggtgacagaggatcttcgggagtgagggtgatccaggtggagggaacagctaaagcgaaggcctgcagggatgtgtgagatcgggcaggtttgaggatgggagatgtgtggggaaaggcagggaaggaggggagatgggtagaaggtgaggttggaagcaataaggccagctcagggcgggcctggtgggccactgtggggtctttggctcagtctgaggaaaatggggccgctgtgggtctgagtagaggaggggtacaacgtatttggtttgcataggtctcctctggctgggagtggagagaggctgagggcagaggcggggagtgagccaggggcttgctgctgtgacctgggttagagatcatggggttcggagagcctatgctgggaagtgtgacattttggatgcattttgaaggtgatgccaagcaaatctgctgacagatgggatgtgagagaaaaaggcattgaactgacccagggcctgtggcctgaacattggagggacggagccactgtccattgagaggatagggggagggggtgcaggtctgagtgatgggcagctcacagacgacaagaacaaagccagacccgtgggctcgcactcagctctcccctccgcatctcccacaccaggacctgtggcttcctccctacttcctgcctggtccgtccctttcccaaaagccaaacctgatggtggttccttttcttggagatgaagaaattcagagggaggaggctcaggaagacagcgatggcagtgagggcggagggccccaggagctggggatagaaggggcaggatgtcaggagatcccgaggagcccagctctcagaggcacgtgaaccagagcaactccatcttgaatagggactgggtaaaatgaggctgagacctactgggctgcattcccagacggttagggtattgtaagtcacaggatgagataggaggtcggcacaagatacaggtcacaaagaccttcctgataaaacaggttgcagtaaagaaggcggccaaatcccaccaaaaccaagatggctacgagagtgacctcccgtcatcctcactgctacactccaccagcgccatgacagtttacaaatgccatggcaacatcaggaagttaccctatatggtctaagaaggaaaggcatgaataatccaccccttgtttagcatatcatcaagaaataaccataaaaatgggcaaccagcagccctctgggttgctctctctatggagtagccattcttttagatctttactttactaaaaaacttgcttttggccgggcacggtggatcatgcctgtaataccagcactttgggaggccggaggcgggcagatcacctgaggtcaggagtttgagaccagcctggccaacatagtgaaacacagtctctactaaaaatataaaaactagccaggtgtggtggtgggcacctgtgatcccagctactcgagaggctgaggcaggagaatagcttgaacccaggaggcggagcttacagtgagccacgatcgcaccactgcactccagcctgggtggcagagtgagactccgtctcaaaaaacaaacaaacaaacacttgctttcactttatggactcgccctgaattctttcttgcacgagatccaagaaccctcttttgggatctggatcaggaccccttttctgtaacacagctgcagaccccgaaggtggtcagacttgggtcctaagatggggatgtcagggaatctgataagggcagccaccaggtcccagggatctgtgctcatggggtctgctgtgtcaggagatgcctgctgaaggtggggtccttcaatgtcagggagggaaacagccctcttacacgatagggagagagttatattcaagacagattgtgcacacacacgagtgggactggggggtgttcccagccacaacagtaaagttgagacctatggaatcaggggacctggttcaaatcctgaccctgagagttttgagtgtggccttggggcaagtcatctcccttaggtgcaattctcttgtctgcaaaatgggaatagagttgttctcatttggcattttctcttattgcgtttaattattttcctaatcttcatttcatccctcgcaagggttgtcagatttagtaaatcatcatacagaatgcccagttacatttgaagataaagagtgaataaggttttagtctaagtctcgtgaaatatttgggacatacactgagaaattcttccgtttgtctgaaactcacacttcactgaatgtcctgtgttttctctggcaaccctgctcccccaccaacgtggtgattttgggatggttatcttccccctctcggctttggtttctatatctggaaaatgtggaagtggggggtagaataaatgatttttaagttgctgtgactttctgagatttctgcacaggttatttggacccattctcttgacaagccccaccccaactccagtctgtgtgcctcagtttcccgtctcagtccttaggaacactatgtttatttatttatttatttgtttgtttattttgagatggattcttgttctgtgacccaggctggagtgcagtctcatgatcttggctcactgcaacctctgcttcccaagcgattctcctgtctcagcctcctgagtagctgggattacaggcatgtgtcactcggctaatttttgtatttttagtagagatggggtttcaccacgttgcccaggctggtctcgaactcctggcctcaagtgatccacccacctcagcctcccaaagtgctgatattacaggtttgagccaccccacctggcctgggaacactattttctaacattgggccagtttgtttcatttatgcggcaatggcgctacctagtggctcaatggagaagggcgcagagggtaaacaccagcccacagcagggcttggaaaaacactcaaggaatgtgagcagaagatgaacatctctgtctgggggaaaaatggtatcattaaactgtagcaacctcagtgtccactcctccttcaccaagacctcacggtgatgttaggaactgtctaccaagaggcaggaaaagtacacaagcaaagtaacatggtgcattatctatggatatcttgttggtctcatctaattttttttttttttttttttttttttttagaaggagtctcactctgtcgtccaggctgcagtgcagtgatgtgatctcagctcactgcaacctccacctcccgggttcaagtgattctcctgcctcagcctctctagtagctgggattacaggcacatgccaccatgcccggctaatttttatattttcagtagagacagggttttgccatgttggccaggctggtcttgaactcctgacctcaagtgttctgccggccttcacctcccaaagtgctgggattacaggcgtgagccaccgtgccccgcctggtctcatctgatttttagcaacggtggggtcaacctgatcaattgccctgaattttcccatgttcttcctctctccctctctttcttcctaatgatgacatttatgtactgcacatgaagccctgtctgagtgccttatgttgtaattgctaagcacctgcctattgtttgcaaggccctggaatacaaggtgaagacactggaaaaagtcctggcccctagccttagcaaaaacaatcatatgcatgagcattcgagttttttttggaatattcagcaattacaatcaaaatgccattaacagtttttacaaggccaggcacagtggctcatgcccgtaatcccagcactttgggaggctgaggtgggcagatcacctgaggtcaggagttcaggaccagcccagccaacatggtgaaacccagtttctactaaaaatacaaaaattagccagatgttgtggtgcacgcctgtaatcccagctactcaggaggctgaggctggataattgcttgaacctgggaggtggaggttgcagtgagccgaagttgtgccattgcaccaaagcctgggcaacacagtgagactctgtctcaaaaaaaaaaaaaaaatcaaaaggatactatttcacgacatatgaaaatgatatgcacttcaaatgtcagcatccataaatagagttttattggaggaataccatgcctgtttgcttagtatggtctacagccacttctgcactccaagggcagagatgaatatttgcaggagagatggtgtggcctccagtgtaaaaagcatctactgtcttatcctttatggaaaagtaactaatgataatattacaaatacctacagggtgcagttgtgtgcccggcacccttttaagtgctttctacatatgggctcgtttaatgcctcagcccctctggggcaggagtgctactgttaattatgatcctcacgttggagacaagaacaggaggcacagagagagtagggtccttgcacacagattcacaactgataagtggtcagaaggaggatttgagcctaggcagttcccgatacagagtctaattttatttttacttttatttatttgttggagacagagtctcactctgtcacccaggctggagtgcagtggcattatctcagctcactgcaacttccacctccaaggctcaagcgattctcctgcctcagcctcctgagtggatggggttataggcacccaccactatgcccggctaatttttgtatctttcagtagagacggggttggccaggctggtctggaactcctggcctcaagtgatccacctacctcaccccccaaattgctgagattataggcatgagccactgtgcctggcccagagtctgattttaatttaaaaaaagaaaatcctataccacaacgttaaaggaatgaagttggaaagtaaatgttttgtttgttttgtttggttgtttcctgatggctactttgtgttttttgaacactaagtagcaatttttccccctaaaatgttctcctcttgtgttttgtggacagtggctatggtggtgcctcagggttactggtaacttcaaaacatggttaacttgcctactgggtaccctaatagcacatggggaagtatcaacgtcatcatcatcatctttctacagaggaaactgaggcccagagagggtgaacttcctgcccaaggtcaagtgaaggtcatccttattgaggacttttcccatcgtatcagacaatagtaggcaaattgagacaggattggaggaggaggagaaggaggagatgggggtggaaggggaggagaaaaaggaggagaggaagaagaaagggaagagaaggagagggaagagcagagggaagagagggaggacggtagaggagaagaagggagaagggaagaagtgggagggaagatgacagggagcagaaaggaagaagaaggtggagcaggagagaggaagaggaggaggagggggaaggaggaaaaggaaggggtgcaggaagaggagggggtgcgtgggcagaaggtgggagagatgcaggaggagggagggtgcagggaggggtgcaagaggaggggggcaggaggaggaggctggggcagagggagaggggaggaagccttatgagcttctacaccaggaatggaatccagggtgatgaaggcagaacaagggtaaaacctttcatgtgcctctctgacaccaacctggttctcccacagcctcagacttgccctaaccctggggtcacagcggacctcttccagcctcttgaatgctaagtcaggaggaggaagggtgggagggggaaggaggagggggagaaggagggggtgggggactccgttcaaatcccgtcttcctcctctggcatacctgccagagatagacgaagcagaccacgatccagacgagaggcagccacagcccgttgaggtagaggacgctctcggtcagccgctgcacgtccacggacaccagattgaccacatcacccaccgcactggcctttctggagccgctggacagagccaggacctggcgggtgggcagaaggagagaagtaaagtggggaggccggggcagagggatgccccaggtggcttctccacccactgagccccacctcacacgtctgcgaggtgggtgagtaaagtctcttaggccaacctctcagggctctttgaggatccacagagatgacaaaaatgaaaatcctccaagatccctaaagcacgggaggcataataatgaataacatgcacgaaaacaccagattaacacagataacggtggtcatctgcccagtgctcaccatgtcgcaggcactgtgctaaatgaacagccttatcctttcccggggtgctcacagccatgaatggtaccaagcaggcactaccatattcattccctctaatgccaggccaggtgcagtggcctctgcctgtaatcccgccactctgggaggctgaggtgggaggattgcttgatcccaggagttcgaaaccagcccgcgcgacatagtaagacccaagctctacaaaatactttaaaaaattagccagggggccgggtgcggtgcctcacgtctataatcccagcactttgggaggccgaggtggacagatcacctgaggtcaggaggtggagaccagcctggccaacatggtgaaaccctgtctctaccaaaaatacaaaaattagctgggcatggtggcaggcacctgtaatcccagctacttgggaggctgaggcaagagaatcgcttaaacccaggaggcagaggttgcagtgagcccagatcaagccattgcattccagtctgggcaacaagagcaaaatccatttcgggggggaaaaaagaaaaaattagccaggcatggttgtggtgcgcctgtggtcctagctagctactggggaggctgaggtgggaggattaattgagtacaggaggttgaggctgcagtgagccatgttggtgccactgcactctagcctgggcaacagagcaagaccctgtctttaaaaaaaattctatggataaattgctctctattattctctcaccaaggaaaataccacttccagttaaattaagacatgtaagagacatctcgattttggaagtattagagtgaaaaaaaaatgtgagacgagaatcaatgaaatgaacatttactaaccccattctatggctaaagaaactgaggcagagagaagttgagcaacttgcccaaagtcacaggccttgtaagctcctacacaaggaatggaatccagggtgacgaaggcatgacaagggtgagacctttcatgtgcttctgtgacaccaacctggttctctggcagcctcacatctgccttaaccctggggtcacagtggacctcttccagcctgttgaatgctaaattccaaatgcagccctccctttgtgactgcgtgagggtgtgaagaagtgatccaggaatgactggacatagaaattctccacttagcaagtctttgaagagtgctcactgtgtgactcacactgagctgggaactgaaaatacagctgtgaacaacagagatgaggcttgctctcccgggcctggagtttgaggtggggaacaaggctctataataaagatttatataactggccgggcacagtggctcacacctgtaatcccagcactttgggaggctgaggcgggtggattgcttgaggccgggagttcgagatcagcctggccaatatggcaaaaccccatctctagtaaaaatacaaaaattaactgggcatgctggtgggcacctgtaatcccagctatttgggagggtgaggcaggacaattgcttgaacccaggaggcagaggttgcagtgagccaagattgcaccgctgcactacagcctgggtgacagagtgagactctgtctcaaaaaaataagacaaaacaaaaatatttctaaaactcatgctttaatggcagttatgatgagtaacataaaaaagtagcccaggctgagcgcgttggctcatgtctgtaatcccagcactttgggaggctgaggtgggtggatcacctgaggtcaggagttcgataccagcttggccaacatggtaaaaccctgtctactaaaaatacaaaattagccgggcatggtggcgcacacctgtaatcccagctactcaggaagctgagacaggagaatcacttgaacccagggggcggaggttgtagtgagccgggactgtgccactgcactccagcctgggcaacaagagcgaaactctgtcagaaaaaaaaaaaaaaaaaaaagcccagaggttagagaggagggatctgatctcatcaggagatcaaagaaggcctcctggcgtgtgggtggggaataggaagatcaatgcctgctcaccaggcggccttcctcttaggctcaaggaaatgtggactctcaagacaggatagggcacacctagctctggcatgctcaggggaacaggagcctgggatgcagcactctggcaggaaagcatcaagagctgccctctcggccacctaggagctgtcccctctgtcccctcctcccctaggtgacagctcaggtgtcagggaatgacacttacatgggacgggacctgccctggctcagatgctccataccccacaggagccaatagctcttggggcagcagtccagggacttagcttccagagtcccaggaacggacaagagccactgcacagagagaagtctaaagctatggcctccaaccaggtattcacagtcaatggacagaacttccagcccagatgcaatttgggtttttttgttttgttttttttttgttctgagacgaggtctcgctctcttacccaggctgcgctgtagtggcgtgatctcagttcactgcaacctccacctcccgggttcaagcgattctcctgtgtcagcttcccaagtagctggaattacaggcacatgccaccatgcctggctaatttttgtatttttagtagagatggggtttcgccatgttggccaggctggtcttgaactcctgacctcaagtgatccgcctgtctcagcctcccaaattgctggaattacaggcgtgcaccactgtgcccagcctaggggtcatttttaccccaagcagtattgtctgggaacacagctgacaggccaccttatcagaaggttaatcctttatcctcaagggggaatgagtggaagttaaaatcaggctcaaaaattaaaattagattgggggagtagaagtggtgcctagacagtgagaacagctgcaaaggccccagggtgggtgggggcctggagtgtttgaggaactgaaaggagacctgtgtggctggaggagagtgagcatgggaggaggtgacgggatgaggtcagagacaccctagggacagatcacacaagaccttacaggaataactaaggagctgagacagatcacttgaggctaggagttcgagaccagcctgaccaacatggcaaaaccttgtctctaccaaaaatataaaaattagctgggcgtggtgacacgtgtctatagtcccagttactcaggaggctgaggcaggagaatcacttgaacccgggaggcggaggttgcagtgagccgagattgcaccactgcactccagcctgggtgacagagcaagactccatctcaaaaaaataaatacatataatacagagaaataactaaggaagtgagaatgtatggtgagtgactctaataagcaaggactgaatgcgttctcagctgctgataacattactgcccgctcagtgatactgcttttcctggctgggaagacctgcccttgtcccccagggctcacctttctgtacaccaggccagtgatggccgaccgcaacctcatctgcagcaccttgagcctgtacatgttctgctgctcaaacagcgtttgcaggcaggctgagaggaacatcagcacggcgaggaggtagcccttccaggctggaggcttgggatcaccaataaactccaggaaaaggcttgcaggggaaggagggagaaggtacagctggtgagaggaggtgcctaagggtgttgcctttgcccaaaccagtccagatgtggaggatcagtcggcccaaactagtccaggtgtggaggatcagtcagtgtggttttttttgcaataatggtctccgttatttcccccactgtccatactccttttcaatctgactgcagctcctcaagatcaagaggtggagtttttgttcccacttgttataggctaaattgtgtcctcacaaagtttatatgttgaagccccgacccccagtacctctgaatgtgactgtatttggaaatagggcctttaaagaggcaatgaagttaaaaatgaggtcattaggctgggccctaatccaatctgatggggtccttttaagaagaggaaatgtagacacacaaggagacaccagggggcgcaaacagaggaaagaccatatggggacacagggaggaggtggccaactgcaagccaaggacagaggcctcagatggaaccaccttgcagatactaatctcgaacttccagctttgagaatcatgataaaatacatttctgttgttcaagccactcagtctcagtctgtgatgctttgttatgtcagctgagcagacaccacttgaatctgggctggctacaaaaccggctttggccaacagagtacagtggaggtaaagccatgctggctctgagcctaggcctcaagagaaaatgtggtttttggtctatttcttagaaccctcccaagcacccacatgaacaagtctgagctagccttttggaggatggggacccacatggagcagagacagccatcccagtctcagatacacaactgcaggcacatgagaaaacccagccaagaaaagaaccaccacccagctgagcccagcccacattactgacccacattaccatgaactaaataaaagaatgtttgtcattttaagccactcacttttggggcattttacagcaaaaactaattgatgcagtcaggtaagagcttgcttatttgcccttctgggggtcagtcactttctcattaatccatttcccttcctcagtgtccttctcacccaccatccagtgtcccgagcaccagacgtataggcagaggcaggagagctgaagccccctggccctggaaggatgccactaagagaccacccaccttagcagggcacttgaggtctgggactcacctgagcagcttggggacagtgaacctgaagacatcactgatgatgaggctgagggtccccaggaggaaggtagaatggaacacctgccagatggccttcagcagtgggcgccactggctcccttcttgccgtaggaagggctcggtctctggagccttcatgccactgccgcctttccttttaaatgctattgccttgttgtgcctgaggggaagggagagattagctctgggtcccattttatactctcagccgccagcggcagggccaggcattaaagggttgttttcccaacagtggagatgggtgggtgtggatctagcctggctccctcacctgttcctccttatcaccctgagtacccacttaagaggcaatcatgggagttggggggcagggcaggagggcactctgaggcctcttagatggccatgggaaagcacacctgttgagcacctactatgtgccaggcactccccagtcatcctaagaccccctgagaagccaggtgttgttcccatttcacagatgagaaaactggggctcagagaagcgaacttgcccaagggcacacagctgagaagtaaaagaactggaatttgattccagctctctgcctccagagcccatgcacttttcttttttcttttcctttttttttttttgagacgaagtcttgctctgtcgcccaggctggagtgcagtggtgtgatctcagctcacggcaacctccacttcccagttcaagtgattgtcccacctcagcctctcgagtagctgggattacaggcaagtgccaccatacccagctaatttttgtattttcagtagagaaggggttatgccatgttggccaggttggttttgaactcctgacctgaggtgatctgctcgccttggcctcccaaagtgctgggattacagatgtgagccaccacacctggcctctcatgtacttttcaacctatcgtgttgtcaacctggaggaagaacagcaccccgtccccaacacacacaatcagccagcccttaggtggttttgaactggtggagaatcacggctgatgggcatggggcctggtgctctagctctgggtgaaagtgcagacagaagctcaggctgcctcaaactaataagatccccagcctttggctataaccaggggccacagagaagagctaaggtgagggagggagaggaggagatgggggaggcccgagggcccctgtgaggcaggtcagaagccctgggccagaaaggagaggctggggcgatgcagctgctgacagtccggttgctgtgtggtcctgggcggggacactgctcctctctctgtgtgtgagaggatgggtgtggtcccctgctgagtcccctgtggctctgacaacctataaggttatcagtaatttctttttctttttcttttctttttttttttttttgagacagagtttcgctcttgtcgcccaggctggagtgcagtgtagcaatctcggctcaccgcaacctctgcctcctgggttcaagcaattctcctgcctcagcctcccaagtagctgggattacaggcacacaccaccatgcctggctaatttttgtatttttggtagagacagggtttcacaacgttagccaggctggtcttaaactcctgacctcaggtgatccacctgcctcggcctcccaaagtgctgggattacaggtgtgagccaccatgcccggccacttatcagtaatttcaatccccattacagatctgtgacccggggccacgtgctgggatcagctctttacacgaaggagctcactgactcccctggatccccttgccaggtgagcattattaggttttccattttacagaaggggaagctgaggctctgagagatggcgacagccgcccgaggtcacacagcaagggcagagcagggatttgagcctagatcttgatttatggtttgtaaagggtttcttgtgcactaaggacccccaacctcaccataataaaataataataaaaaaagaagcataagaaaaacctctggtgagctcaggtggccagacccttcaaggccaaggtctctgtcccacattattggtctgatctggtgtttggtttggcatctatggagggttgtggttcagctctgttactgagtgggtgtggcctgctgctcacaaatattttggcatttggatctcaaagccaagaagatgccccttccatacagagagcatccctgcccaccctttcctgtttgatcctgccatttaattcattgccttcacagccatgtccatggctccaaccctctctttgtctcgttagaaccccaggtgggtagactttgcctgtgttttccaccaagatgtccctagtatagagtccagctcctgcacacagtaggagctcaataaacacttgtcaaatgaatgggaaaaacagattgagtgatgtgtgcaaagggcctaataagagtgccccctgcacatactgttataaaaatttatagaaggaaggaaggagcttggctgggtggacagaacttggctttggagccaggagactgtggttccaatgcctgctctgtctcctctcctctgagccttagtgtttccatctgcaaaatggggtcggggaagagttcactggaaagttttctttctggctgaggttctgctcagttctatttgagctgtttaacccagagagtcagtgtgttcagcctgcaggctccatagcaagtgttttcctctcctgcaggtctcacctcccatcaaggaagatgtccagattgctgtctgacgtctggtctctggactgaaggccatttagtgcagatctcacaaatgatggtggggcaaggcagggggtatgcatgagtggcatgggcaaggtgtgagttgggggatacaaaagggagtggtggaggccgggcacggtggctcacacctgtaatcccagcactttgggaggccaatgcgggcgaatcacctgaggtcaggagttcagggccagtctgatagcctgagcaacatggagaaaccccgcctctaataaaaaatacaaaaattagtgaagccgactggaccagcaggtggctgttgtgtggcctctcaggaggacgccctctcccttcccccagtggttgcaaaatacttcagaaagaaaaccaaagttctctgtgggtgcagtcggttgtttcagaagctgacggagcctggtctttgtataaccccatctttcccctttctttctgtcaactgtttatgggaggattctcaaactgttctggagaatgtttctaccctttagttctagtgttgggtgacctgtaattttcatgttggctggggatgccaggagttggcagaggctccttccagagcccctgtggactggattctgccacttccgtaaaatcattcaaaagtagagggtgagtcaggtgcagtagctcacatctgtaatcccagcaccttgagaggccaaggcaggcagatcccctgaggtcaggagttcaagatcaccctggccaacatggtgagaccctgtctctactaaaaaaaatttaaaaatcagctagatgtggtggcacacgcctgtggtcccagctactcagaaggctgaggcaggagaattgcttgaacccaggaggtggaggttgcagtgagctgagatcataccacaacccagtgaagggggtccagcaagccatgcctggggtgagagagaactgatgttttggttctctcacactacttattctgtttggaaaaacacatgcccttcctttgtgggaacagcccctacccacttctgtggctctgaagggaccaccagtcatggcaccagccccctgggcatgggattggcccctgacaggcacatgacttgagccaggccaattagaggccttccttgggatttactatatggacgttaggagagagatgctctcttattctgctggagtttgctgaacttgcatgggaagggataggccttatggagagaccaacacatagataatagttgggatgggagatgaaaggagagaatcctgacatcatttgagtcccctgatccagcaacacctgaggctagatcctcttagctgtgtgagcctatagtatcagtctctgtctcctctgtctctcttaatgtgtgggattcagccatctgcaacaactaccacaaaatcccggagtatgcagggaacttcccacagagctaacttccttttttgttctgtctcctaaaacaccaagatccggtgaggttaagcaacgtgtccaaggtcatcactatttgaaggcagggcagcatttaacccaattttatctaatcctatgcaggctcatttatctagaccagagtttctcaaatgaggcatcccaggctctaagggctgcagagaagtttccagagatgccactgagggcaggagtggacagagtggataactccaaagatcttaacaccctctggatgactaacagtgcttgagcacttcccatttgcaagacatttgcaagttcttttccataaatcatccttttttttcatccccataagctatgagctggggctaatgacatccccactgaacagatgagaaaactgaggcccaggaaaggaattgctcaggttatatagtaagtgagcagctgcttgtgtgttgagtcacctcccaaccctccaccccggccttaaaatacctcttctgtttgctgcctgtcattctgccatttccccatttgtaggaacctgtttgttccccgtttgtaggaacctgtgatgcgttctgggaggaaccatatcttaagcctgatactacttagtgggatcagctggaaggcaaggtggggaggcggcagtgccgccagagtagcgttgggggctggactgggggtcaaatgatgaggtttttttgtttttgtttttgtttttgtcttgtttgtttgtttttttttttgatacggagtctggccctgtcactcaggctggagtgcaatggtgacatctccactcactgcaacctctgcctcctgggttcaaacgattctcctgcctcaagcctcctgagtagctgggattataggtgcctaccaccacgcccagctaatttttctatttttagcagagatggggtttcactatgttggccagattggtcttgaactcctgaccttgtgatccgcctgcctcggcctcccaaaatgccgggattacagtcgtgagccaccgcacccggccaatgatgagcttttctgaagtagcatcaggtgagttcttgacctccacccacttacctccgggctgcactgcggttcctcatccactccttttcaagccgggaaacaagttcttctgaggagttttctctcccaagcgaccagaggtcttttggtctcagtggcctcctgtatcccctccagaccaggctgcaaaagaggggcaccagggaaagcttttcctgccattcacccctgcaggatcctggccaggcgagtagctgtgtgaccctgggtaagtcactttacctctctgtacctctactggcccctgggtaaaaagaaagcaattcactaaccccacctaatgtctgcagggcatttctcgtttcacaaagattgtctcattaattcttacatgaacccataaggtaggttattattgtttgtttgagatggagtcttgttctgtctcccaggctggagtgcagtggtgcaatctcggctcactgcaacctccacctcccaggttcaagcgattctcccacctcagcctcctgagtagctgggattacaggcacccaccaccatacccggctaatttttgtattttttgtagagatggagtttcaccatgttggccagactggtctcgaactcctgacctcaggtgatccacctgcctcagcctcccaaagtgctgggattacaggcatgagccaccacacccagcctgtaaattgatagtttataattgtataaatgtatgagtatattattatagatctattttacagatggggaaggaaatagaagtgcagagagattcagtggctaaaccaagggatagcccttggcaagggaaacagacatttccctgggaatcagaagtccgttgaccaaaactatcattgtagaagaagcttgaactcctccctcagctttttttttttaattattattattttttttgagatggagtctcactctgttgcctaggctggagtgcactgatgtgatctgggctcactgcaacctccgcctccctggctcaagcgattctcacgcctcagccttctgagtagttgaaattacaagccaccatcacacctggctaatttttgtgtttttggatggtgtatcaccatgctggccaggctggtctcgacctactggcctcaagcaatcctcccacctcagcctcccaaagtgctaggactacaggcgtaagccaccacacctggctaatttttttgtttatagtagagatgggatttcgccatgttggccaggctggtctcgaactcccggcctcaagtgatctgtcagggttggccttccaaagtgttgggattatgggtgtgagccactgtgcctggcctcaggtctctttaatctttctgatgacaccagccagaaggtcttgcctggttctggtctctgactcttctctaagccttaccaagttcccttttcttttttatttttattctttttatttttttgagatggaatctcactctgttgctcaggctggagtgcactggtgtgatctcggctcaccgcaacctccacctcctgggttcaagtgattctcctgcctcagcctcctgagtgactgggattgcaggctcccaccaccacacctggctaatttttatatttttagtagagatggggtttcaccatgttggtcaggctggtctcgaaatcctgacctcaggtgatccacctgcctcagcctcccaaggtgttgggattataggcgtgagccactgcgccaggccaccaagttcccttttctaatgcagagccaacttggggaagcaaccgttctgacatagaaattattaacgtggcttgattttccctgaaattatttttggagttctcctatatggcaagtgatgctatagatttttcctattttagcagtgatagagagtttctttttaaaaacagtttattcgagtaaaaaaagtgactcaatttagtttttgccccagtaggacaaaaaagcatcaagagtggtccataaatgcttaagtttgggaagcaggggctggaccccccagtagagctgtttcgaaaacctctaagctctttctaccagttccacacattcaaagcctgatatttttcatttatttaatagccatttaggccgggtgcggtggcttatgcctgtaatcccagcactttgggaggtcgagtggggtagatcacttgaggtcaggagtttgagaccagcttggccaacgtggtgaaacccggtctctacaaaaaactacaaaaattagctgggcatgatggcaggcgcctgtaatcccagctgctcgggaggctgaggcaggagaattgcttgaacctgggaggtggaggttgcagtgagctgagattgtgccattgcactgcagcctgggcaacaagagtgaaactctgtctcaaaaaaaaaaagagaaaatgaatagcccaggcacagtgggtcacacctgtaatcccagcactttgggaagccgaggcgggcagatcacctgaggtcgggagtttcagatcagcctgaccaacatggagaaacactgtctctactaaaaatacaaaattagccgagcatagtggtgcatgcctgtaatctcagctactcgggaggctgaggcaggagaatcgcttgaacccaggaggcggaggttgcagtgagccaagatagtgccattgtactccagcctgggcaacaagaacggaactccatctcaaaagaaaaaaaaataattaccacttaaactcattatttgccaggccctgttctaagtgctttacagatctcatcttatttaagcttcacaaccctatgagctaagtgctactatcaatcccattttgaaggagtggagactgaggcacagagaggttaagtaactgtccaaagcaacacagctaggaagtggtagggccaggattcaaatccatatgtcaggtgctactgaggtctgaatgccgtgtggttaggagagagcacatcctcaagtgccttgtgagctggccctggagaagcagctgttttctcaatctgcctggaaccctctagaaagtagacacttgctcctttatctcctcacccctggggcttagcacatagtaggtgcctattaaatgttggtggaatgactgaaatcaagtattggagacaattctaattactattaagcacccgctgtgtgcaagcactaagcactttccgtctcatgcaggttgagtcatccccattttacagagggaaaactgagactccggaggtttgcgacatggcctgctaacaggcagagccgggattcaaatcaagatctcactccagtgagtgaatgggaacaggatgcagatggtagacactgaacacgaagaagaaagcactgaggctgggatgaagaaagacttgctggcctttgtaagcacaggggaagggccatggctgggaatcagagcagcaaatgcaggcgggtgaggcaccaccccaacccttccgtgcgactttacttacccagaaacccaccagaacgtggctttggaggggaaggctgccccagtctctggacaggggttctgcaacagacaaaaatggagaagggaagtatgtggcaagggtaggaagacaggacgaactgtgtatttttttttttttcgagacagggtttcgctctgttgcccaggccagagtacagcggtgtgatcttggctcactactacctctgcctcctgggttcaagcgattctcctgcctcagccttccaaagagctgggatgacaggtgtgcgccaccacacacagctaattttttgtgtttttagtagagacagggtttcaccatgttggccaggctggtctcaaactcctaacctcaagtgatctgcctatctcggcctcccaaagtgctgggattacaggcatgagccactacacccagccctgacggtgtatttagtactgaaagtaaacatcgaggtgccctgtctccttgccaggggtgtagaccagtgagcttggtgcttcccagcaggcagcgtaaaaagaggttgggccacaggcctgacaatgtccacaaggtaagaaataacagtggctcagaagaacaactatgattatactgaaaccaaaaccttgctttgcttctcaaaaggaaggacactgcataacgaagaaattagatccttgacaatatccctcggcaaatgttgtgaagacagacctgtcgtgcgatttttgtcaggtgctccaggaagattacaacagtctgtactctttaccaataaggcgtgaaggtgcccatttcaccacgtttttgccatcacagcttattaatttttaaattttgttgctactctggtaggtacaaaaaagattcctatgatagttttaactattctcaagccttcgagcaatttttttttttttttttttgaatacagggtctcgctctgtcacccaggctggagtgcaatggtgcaatcatagctcactgcagcctttatctcttggattcaagcaatcctcctgctttagtctccacagagctactctgtagtgggactacaggcatgcaccaccacactaggctatttttaaaaacctttttgtagagatggggtctcactacattgcctagtctgatctagaacacctgggcacaaacaatcctccttcctcggtctcccaaagtgttgagattacaggcatgatccactgcatctggccccatttgaacatctgtttatatgatgtcagatcagtctcttccacaaaagaattgtttcttgatttcacagactgcttcactgttacctattgtaaatctctcaatctctcatgagcttcttctatggagcacttaccccaagggtaattttctttttccttctttttttttttttttttttttggtggagttccgctcttgttgcccaggctggagtgcaaatgcacagtcttggctccctgcaacctccacatcccggattcaagcaattctcctgcctcagcctcccgagtagctgggattacaggcgtgcaccaccatgcctggctaatttttgtaattttagaagagatgaggctttaccatgttggccaggctggctttgaactctcgacctcaagtgatccacctgccttggcctcccaaagtgttgggattacaggcatgagccactgtgaccatccaattttcaacatatttgtttaattttgtgaccagtgtctggttcccctgcttgaccagtagctacgtgagaacagaaactctatctgcttgttcaccatagatccttatgcccttgctagggcatagcggggtttggcaaactatgaccaaatctggcccactgcctgtttctgcaaatagtgttattgcaacacagccatgcaatttgttgacatattctgcttttgcgttcaatggcagagttgagtaattgccactgagatcactgtatggctcacagagtccaaaatattttctcttggcccatatagaaaaagtctgccaactgtggcatcgagtagaaatgtggtacactttttgctgaatggctaaatgaataaaaaaattaaagacttttggtcacctgggggagactgagacctcaaagtggaacaggaatgaggttggaacttggtgacttacagactgctgggggtcttcagggaagaaggggggttgatccgccaggcaggacagcacaaactgtgccaccaccagagacaggcataggtaggtggacaggtggcggacagggtcgctctggaagccctgtgggagggaaagcagaagataaggaatggagacagaggagggtgctcagaggagagaaaaggtttctgatcttgggtcagtgcccactctggggaccagggcaagagtatttgaaagccagagccctggctttcctagtggttctaattttctttctttcttttttttttaagacaaagtctcacttggtcgcccaggctgaagtgcagtggcatgatctcggctccctgcaacctctgcctcctgggttcaagtgattctcctgcttctgcctccttagtagttgggattacaggtgcccaccaccatgcctggctaacttttttaaaatatttttagtagagatggggttttgccatgttggccaggctgacctcaaactgctgacctaaagtgatctgcctgccttggcctcccaaagtgttgggattacaggcatgagccaccatgcccagcaggtcctaattttcaaatacccaatttataatattctgtctatacaaatggtgggccagggctgcgtctgggttttgtccttagccacatgatgattggccacagctgctgggacaatgagatgaagaaacaatttaccttcttctttgtgccacaaaagaaatcctttctccgttccaccctctaccccaatcttcaaccctgctcccccttggccagggttctctgttttgcagagatgagagctggttttattgagcactgaccctgccctgagcacatgcggcattcttgccatacacagtctcatcagctggagtttacttgcttcctttgactcagggggaaaccaaggctcagagaagtgacagcaccttgttcaaggacacgcagatgatctggtccaaattgtgatgctcctgctgccacaccacaatgatttttgcatctgctgccctgtcatctggtcagaaacaccctaattttctttctttttttaatttaaagcattttttattttttaattttaggtgtgtgtgtgtgtgtgtgtgtgtgtgtgtgtgtgtatactttttttttttttgagacggagtcttgctttgtcacccaggctgatgtgcagtggcatgatcttggctcactgcaccctccgcctcctgggttcaagcgattctcctgccttagcctcctgagtagctgggattacaggcatgtgccacgacccctggctaatttttgtatttttagtagagatggagttttaccatgtaggccaggctggtcttgaactcctgacctcaggtgatccgcctgccttggcctcccaaagtgctgggattacaggcatgagccaccgcgcccggcctgatatatatatttctggatgacgtgagatattttgatacaggcatgcaatgcataataatcacatcaaggtaaatgaggtctccatccccgcaatcatttatcctttctgttacaaatgatccattctactcttgtagttattttattttttagtttattattgagttggagtctcactctgttgcccaggctggagtgcagtggcttgattttggctcactgcaacctccgtctcctggattcaagtgattctcctgccttagcctcctgagtatctgagattacagatgtgtgccagcacgcctggctactttttttgtatttttagtagagacagggtttcaccatgttgcccatgctggtcttgaactcctgacctcagatgatcctcctgccttggcctcccaaagtgctggaattacaggtgtgagccactgtgtccagcctcttttagttattttaaaatgtacaattaaattattattgactatagtcaccctgttgtgctatcaaatagatattattctttctgtttttttgtacccattaaccatccccatttcccccacccactgtccttcctagcctctagtaaccttccatctactctatatgttcatgagttacattgttttaatttttagctttcacaaataagtgagaatatgtaaagtttgtctttctgtgcctggcttatttcacttaacatccatgttgttgaaaatgacagtacctcattcttttttatggctgcatagtacttcattgtgtatatataccacattttctttatcagttcgtctgttgatggacacttaggttgcttccaaatcttgtttattgtgaacagtgctgtaataatcatgggagtgcagagatctcttccatgtactgattttctttcttcctaagttttttgcttgtgttcgggcgtgtgatttgtgcagaactgactctactccgaggctgggtgggtgaatgaggcctggccaacgaatacgttctggtcttttggctaccatggcagggttaggaatgcacatagcaccccatgctgggtacttgagagctggaaccatcgggagattctgctggctttgctacatgctagaatgtaagtgtgaaggtattggtggctcttcttgccactccattggagaatcaagctaacatggcagagccaagaggcagaagtggagatctggtgatggtacctggtcccaggcctggatcagtcatgcctgggagatcccatgggtatgagctaataaatgcatgagctaatgaacccccttgacttacccttttcattaagctagtgtgaactgaggttttatggctttaaaccagagccctagttttaaatcatgattcctctactggattttatactcttctagttttgggtttttgtttgtttgtttgttttttggcagatagcagacaattggatattccaatgacaatatggcccatcttccctaaactcccactgttttccccactgtttctctcagaaagtttgttctgaatttgcctgagatgaactcgggctctgcactcccaagctttgtggccctgaggccgtcattcccttctcctagccttagtctccctcatctttaaaatgggacggctagaattcatcattggctggggcacattggctcaagcctgtaatcccagcactttgggaggcttaggtggaaagatcgcttgagcccaggagtttgagaccagccttgggaacataatgagactttgtttctatttctatttaaaaaaataaagaacccatcactgtgaactcttgtgagaatccagtgaggagacgtgtgtaagtgcctgccacagtgcctggcacatggttggaaccccagaatgtatatggtcccagtattattgtttctatgctgtgtcccaaaaagctgacttatgtcaactgtgggagcccaccatttcagaaattactgaataacctgtggaatttccccttagttacaaaggttactcttttaaaaactctgtcctcggtcaggcgctgtggctcacgcctgtaatcccagcactttgggaggccgaggcgggtgagtcacttgaggtcaggcatttgagatgagcctggccaacatattgaaaccttgtctctactaaaaatacaaaaattagctgggcatggtggcacatgcctgtaatcccagctacttgggaggctgaggtatgggaatcgattgaacccggaggtggaggttgtagtgagccaagatcgtgccactgcactccagcctgggcaatagagcaagactctgtctcagaatgaacaaacaaaaaataaaaactctgtccttaaggacagggtgatgcttctctaccttctcctttaggggcaggatggagtaaccactggactgaagaaatgatctgtgagtccagacgtggtggctcatgcctctaatcccagcattttaggaggctgaggtcagagaattgctcgagccgaggagttcaagatcagcctgggcaacaaagcatgatgttgtctccacaaaaataaaataatgaagtaaaatatctgaaacctgctgcagcctgttcattggtgttaagataactccctctcccagaagccttggctaagcacactgtcgaggccagtgcttctcaataggtgggtgactttgtcctcctcacccccagggacacttggtaatatctggagacattttgggttactgcaattggatggtatgctactggcacctatgggcagaagccagggatgctgtttcacaccctgcagcaaacaagacagccctgtccacccaacaaagaattgtctggccacaacattactaaagctgaggctgagggaagttggtctaggctacatgtttttctctttacagagaaaatgacccatcatgtctcctaatagagaaacgctgcttccggccgaatgacaagagctcacgcctgtaatcccgacactttgggaggccaaggcaggtggatcacttgaggtcaggagctcgagaccagcctggccaacatggtgaaacctcgtctctactaaaaatacaaaaatttttagtagaaatttagtagaaatttttagtagaaatttagtagaaatttagaataagccaggtgtagtggcacacacctgtaatcccagctacacaggaagcagaggcaggagaagtgcttgaacccgagaggcagaaattgcagtgagctgagatcatgccacttcattccagtctgggcgacagagcaagcctctcaaaaaaaaaaaaaaaaaaaaaaaaaaaaaagctgcttcccagattgggcaacagaaatacgagtggtgtgcagaatgagtgtgtaaatataggtgcataggaacatggggagggtgaatccatgacatgaggggaggtgtgcacggaggggtatgtgtgcacacaggtgtgtctgtgcccaggttgtgtgtgtgtgcgtgcatgcatgtacttgtgcgatgtatgaatcagtgcctataagtgtgtgcatcgtgtgcaagtggcacgtgtgatgtgggcctgtaagacaggaaattgtgttgataagaaatgtatgggatgatgggtactgacaggtgcgggagtggattttgtgtctctagagtgtaagtgactggcttgtgtgtgtcactgtatagagaataagttgtatgtggaaacaggaggagaaaggaagggacccaaggcatgagccaccattttggtttcccagggtggcccacgccccgacttaccgctccggaggcctgctgggcagcgttggtagctggcaagacaaagcagagaagccagtaaccaaacagcactccagatgactggactccctttttcctctcggtgtgaatcaggaacactgcgaagctctggacgggaaagtcagggaggccccttaggggagggtgggaggctgaggggagcctcttctcttccccttgttctccactgtggcaggcaaagcagcagctgggaggaagccgggctccagactgaaggcatcattaccatcgtggtgagccacacagtaggatgaatgaggaattctggggcctcaggcgttccctgttggattttccaaagagcgacagccacgctggaggtacacaggactatgagggcgaatccaagcacctgaggatacaggcttagataagcttggggggcaataagagaggtcacagcaaactggtaggcggccccatgtccaactgggagctggttctgcaacatcctggctgatactgagtataccagggtcaccagctagcaacgtgccaatgtgaacaatgtgtaaagggcattgcagatcactcctgacctgtaactgtcatataaataatgcacaggaagggcttgagccaaccgagtgttttccaaaatgcaggaagtgctccaatcgtgcacatatgagatgactgtgggtatggagaaacagcaggaaatgaaatgtactcaccaggtaaaaaactatcctttctccaagtcatttttcaatccctgctatgaaatcaaggagcaactctctgttgggccagtaagtctctagggtctctctaatatattttggtttctctattgaataaaagaaaggaagaaaatgagagaacgtgggcacaccagagggaaggccagagctaggttacgttggaggaactgctcaaagaacctcagtttaaagcagaagttggcaaactatcaatcatcaaagaaaaacaaaaagcatatgtcatgacaggtgaaaattacatgaaatccaaatttcagtgactacaaataaagttttattgaaacgcagtcggccgggggtggtggcttacacctgtaatcccagcactttggcaggccaaggcaggcagatcacctgaggtcaggagttggagaccagcctggccaacatggcgaaaccctgtttctactaaaaatacaaaaaaatagcgaggtgtgggggtgggcacctgtaatcccagctactcgggaagctgaggcaggagaatcacttgaacccaggaggcggaggttgcagtgagccgagatcgcaccattgcactccagcctgggtaacaagagcaaaactgcatctcaaaaaaaaaaaacaaacaaaaaagtaacacagtcatgactattgtctatggttatgactattgcgttcattctggaatggcagagttcagtgttcggaaggaagattacctggctcacaaagtctcaaatactgtgtaccgcttggctctttaagtttgccaacccctgggttggtggcgggtgataatgtaaaaattaatacaatggcagaagaatgaatgaactctgaagaacattctttggaagcctacaagaatggagtagaagaggatggatgagcagaaaggctcacacttggaatgccagtgtttatttaacacactaaggtaaatacatatcacatataaaaattgtcctataatacagccagtgggggaacataaaaataaatgcataactttttaaaaggttcatcctaatgtggctctaaaattaccttgtgtatccaagagtctacatggtatgttttggaaaatgccaggttatggtagctataaactgtccaggaacatgggagtgtatgcgtatgtttgcgcatgcgtggattttcggaattacaaaatctgtttgggagaaccgtgttccactgagttgacctctgtagcctttctaatattgctctgtttgattaacagattcccttctacaccccgataggaggagtctactttaagacttcaccaggttccagcctgtcccctgcctcccccgaacattgcctggttccaggctcccagggatggcagctaccatcttggctttgaagagtggggacatccggaggtagccccggccatggtggtggatgaagaggaggtagatgggaccaaggacccagaggtacatggggggtacccagacccctgctgttctcaggaagcacaggctcagcaggctggtggcggcaggttcaggctctgtctggttccagacctgagggaacacaaagaggacccttaggatggtacaaggcaggggtccccagctcacctgcccagggggccaggcaactttttggatctttaacatttacacaaaaatgtaccaagtactctttggaatacctactaattctcaattcctttcatcctgacattaaccctaggtagttgcaattatattgatttgcagatgaagaagctgaggaccagagaggttgagtaactttgctgactttacccagctgaggagtggaagggctgggatttgaacccagggaactgggccatgtggtctaggagacctgggctccataatcattgctaggcatggactgtcagttaatccttataacaactccaggacgcagacagtactgtctccatttcagaaaccagcagactgaggcaccagtcggggaactgcctcccccagggacacacaaatgggaagtggcaaagctgactctgacccaggcttatctgaccccaaacctcgttcgactggtggtcttgatgtatgatttgtttttattttttattattaattaatttatgttttagagacagggtctcactctgttgcccaggctgaagtggcacaatcaaagctcaacaaagcttcgaatttcctgggctcaagcaatcctcccacctcggcctcccagagtgctgggattacaggcataagcagcctcaccaggcctggctaattttttttttttatgttttgtagagatgggggtctctctatgctggtctcgaactcctggtctcaagcaatcctcctgcctcagcctcctaggtactgggattacaggcaagagccaccggcccagcttgatctgttattttcatctcagcaggtctgctggtcctatctaaccctagaagaaatttgaagtttagtggacgtggcctcttcaattctctctccgctgtctttttactcctcctggtttcacaactcaccggctgtgcaaactttaacctctctgtatctcagtttccttccctgtaaaagggggaaaacgagactctacctctatgagttgtattaaatggattaatagcagcaaagttcatagcagcatggcacaaggttgggcacaaggctaggcacagagaaagccctcagttcattgccagtttattgcttcaactccctggccctcgaaatgctggcagtttgcaacccccacccccactccatgaactccactccctggagtcctttgctaagagcaatggaaaaagaaaccagagaggtaagggctctccgggggtaggagggcttgggggacccactagctttatgcaaagaagagtcaaagcccctagtagctgggaggtctggtggccccttaaatagagctgggctctcggctgctggcttggtgaaagaaatccaacccgctgcagtgagggggccggagtaagtctcctcgcttcccgggtccaggaatttgggggtctctcctctccccagtatcgcagcccgagagatctgcagccaaaccaagcctggaaaaggagagtggggcgcgatggggggcactcaccccctgccccgcgcagggctcagcaggcgcggccatcggcgccttctgtcgtcgtgggtcccagcgtctgtctgtcgctaagtctctgggcagactgctcggccgcgatcctgccggagaagaggcggggctgggctggtcgggctgggctggtccggctgggattcgagctccgggatcgggaggccccgggcaaggtccagctgcgcggcgggagtgaggccacgggaggtgaaaacaggcgaggtgggggatgggggaagagaggcgctcggggagctgggacgggcaccgggttggggggtcccggaacccctgaaagttcagtgacacctccatagttccctcttccccctgcaacaagaatcactccagacttcctaaacactttggacccagcaatttccaggagttcatcctgatgagagaactgaaaggtgtgcacacgttagtaacaaggaggcctggtgaccgcctaagcgtccaatcgcggggaccaccgggtcgaggccgagaggatggagaccgcgtcacaggcacctcgctgctggaatggagggtggtggggagaacttagaagattatgcaatgggctggcagggctatacccagccgccctggtaagcagaaactcaagaaacctctagggtcctgttttctggtcgtatgatcccaggagtgcacatgggcccctcgggtgtctgaacagaagggcataggagggagggccgcagccctgcagtcttactctgctggtgtagcggtcacctgccaactcccaccccaccctgcaccgcgggctcctgagtcggcagattaagcattttataaattctattttaaatacgtgttttaaacttgtcagatatttgtcttcatttcagtccctgcgcctctacctcttgctgtggtcgcttatttaacactggggggctacgttctgctaagtcccagggagagactgttcctaatatccgagggagatattattcctaatatcacgctgggtgaacaccacgtgtgtacagcctctgatacgattggtaatatccaagggagatattatcctaacatcccagtgggtgaacaccatgtgtgtaaacgctgtggtattattagaaatatccaagggagatattactcctaatatcacagtgggtgtacatcctgtgatattattcgtaatatctgaaggagattttactcctaatatcacagtgggagtacacactgtgatattatttgtaatatccgagggagattttactcctaatatcacagtaggtgtacaacctgtgatattattcataatatgctagagatatattactccaaatctcatggtgggtgtacactctgtcatagaattcgtgatatcctagggagttattaccgctaatatcacagtgagagtacaccctgtgatattattcatactatcctagaaagatattacttttaatatcacagagggtgtacaccctgtgatattattcataatattctatgaagatataactcctgatataaccgtaggtgtataccctgtgatattatttgttatatcctagggagatactacacctaataccacagtgggtgtacaccctgtgatatgatttgtaatatcctagggagatataactcctaatatcacagagggagtacaccctgtaatattattcataatatcctagaaagataatactttcaatatcacagtgggtgtacactctgtgataatattcgtaatttcctagggagatactactcctaatatcaccttgagtgtacactgcgtgatattattcgtaatatcgtagggagctattgcttttaatttcacagtgggtgtataccctatgatattattcataatatcttaagaaggtagtactcctaaaatcacagtgcctgtacacactgtgatattattcataatattctagggagatgttactcctaatctcatagtgggtgtacaccttgtgatactatttgtaatgttctagaaagatattccttttaatatcacagtgggtgtacaccctgtgatatgattcgaaatattctagggcgatattactcctaatatcccagtgaatttacaccatgcgtgtacacgctgtgacctcccagaaagatatgactcctaatatcacagtgggggtacaccctgtgctattatttgtaataccctatggatatcataatatcacaatgaacgtacaccattgtgtacatgctgtgatattatttgtaatatttttgggtgatattacccctaatgtcacagtgcgtgtacatcttttgatattatttgtaatattctgtggagatattgcccctaatatcacagtgggtgtatactctttgatactattcgtaacatcctggaagatattatccatattgtcacggtgggtgtacaccctgtgatattattcgttatattctggggatatactattacccctaatatactgtgggtgtaccccctgtgatattattcactatatcttggagatataatattacccctaatatcacagtgggtgtatactttgtgatattattcattatatcctgaagagatattatttcctttaatatcacagtgcatgtacaccttgtgatattatttgttatatcctggggagatactactatattactcctagtatcacagtggctgtacgccttgtgatactattcattatatcctggggagatattattactcctaatatcacagtaagtgtataccctgtgatattattcataatatcctgggagatattacccatattgtcacagtgggtgtacatcctgtaatattatttgtaatatcctggggagatattattactcctaatagcacagtgggtgtacaccctgtgatattattggttatatcctggggaggtattattattcctaatatcacagtgggtgaacattctgtaatattattcattatattttggggagatattaattcctctaatatcacagtgggtgtacaccctgtgatattattcattatatcctgggaagatattaatccctctaatatcacagtgggtgtacaccctgtaatattattcattatatcctgggaagatattatttcctctaatatcacagtgggtgtacaccctgtgatattatttgttgtatcctggggagatattattatgtctcatatcacaatgggtgaacaccctgtgatagtattcgttatatttggggaagatgttattacccctaatatcacagtggtgtacactctgtgatattattcattatgtagtggggagatagtattacccataatatcacagtggatgtacaccctgtcatattatttgttatatccttgagaaatattattattcctcttatcacagtgggtgtacaccctgtgatattattcgttacatcctagggagatattgttacccataatatcacagtggatgtacaccctgtcatattattcgttatatccttgagagatgttactacccctaatatcacagtgggtgtataccctgtgatattattcatcaaattttctggagatattattacccataatatcacagtgtgtgtacccactgtgacagtattgattatatcttggggcgatattactcttaatttcacagtggctgtatccctgtgtttacaccctgtgatgttattcataatattttagggagatattactcctaatatcacagtcagtgtataccatgtttgtacaccctatgatattatttgtaatattttagggagatattactcctaatatcgttgtgggtgtacagcatgtttgtaaacactgtgatattattcataatatctgagagagatattactgccaatatcacagtgggtgtacaccctgtacaccgtgtgatacgattcataatatccgagggagatattactcccagtatcacagtgggttaacaccctgtggtattattcataatattcgagggagatattactctcaatatcacagtggatgtacaccctgtgatattatttgcaatatccgagggaaacattactgctaatatcacagtgggagtacaccctgtgatattatttgttttatcctggagacatattattcctattatcacagtggttgtacaccctgtgatattcttcgctatattcatggaagatgttattacccctaatatcacagttggtgtacaccctgtgatattattcgttatatcctggggagatattgttacccctagtatcacagtgggtgtacgccctgtcatattatccattacatcatgggaagatattattacatctaatatcactgtgggtgtacaccctgtgatattatttattatatcctggtgagatgttattactgctaatatcacagggtgtgtcaaattttctggagatattattacccttaatatcacagtgggtgtgcaccctgtgtgtacactctgtaatattattcgtaatattttagggagatattactactaatatcacagtgggtgtacaccctgaggagatattacttcctctgatatcacagtgggtgtacaccctctcatattattcgttatgtgctaagtagatattattacccctaatatcacagtgggtgtacaccctgtgatgttattccttatatcccaagaagatattattataactaatatcacagtgggtgtacaccctatgatattatctgttatatactggggggatattatttgtaatattttagggagatactactcctaatatcatagtgggtgtactcatattttacagatatattacttttaatatcacagtgggtgtacaccctgtgtgtacaccctgtaatattattagtaatattttagggagatattactcctaatatcatagtgggtgtacaccatgtttgtaaaccctaggatattattcataatatccgagggagatattactcccaatatcacggtgggtttacaccctatgatattatttgtaatatctgaggcaggtattactctccatatcacagtgagtgtacaccctcctatattattcataacatccgagggagatattacttccaatatcaaagtgggtgtgataatatctgagggagatattattcctaatatccgtgggagatattattcctaatatctcagtggttgtaccgcgtcacagtgggtgtgcactgtgtgatattattcatagtatccaagggagattttactcctgatatcacagtgagtgtacaccctgtgatattattctaatacccaagggagagctttctcctaatatcacagtgggtgtacactctgtgatatttttcataatatccgagggagataggatggagaccacgtcacagtcccctcactgctggaatggacactgtctacccgtggagtggtggggagaacttagtgagattatgcaagcgtttagcacactgccagatatacattaaatgctcagaagacttagcttttattattactgtcataattgaggccatgggttactaaccagtggtttaaaatgccattgcagctgggcacggtggctcatgcctgtaatcccagcactttgggaggctgatgagggcggatcacttgaggtcaggagtttgtgaccagcctggcaaacatagtgaaaccccgtttctactaaaaatacaaaaattagctgggtgttttggtgcgtgcctgtagtttcagcttctcaggaggttgaggcaggagaatcgcttgaacctgggaggcgaaggttgcggtgagccaagattgtgccactgcactccagcctgggtgacagagcgagactctgtctcagaacaagcaaacaaaatgccattgaagacatatatgaatatgaaaaggtgcttgctaaatgatgattgaataaaagagattataatataaaataggctttggtttttttaaagcaaaaaagaaaaggatatgcctaaattagggaacatggagaagaaggccaaggcatttaccttcctctcttgagtctttttctctctccgtctctgttttttttttttttttttttgagtcagggtcttgctctgtcacccaggctggagtgcagtagtgccatcatggctcactgcagccttgacctcctgagctcaagcaaccttccacctcagcctctccggagtatctgggactacaggcacacaccaccaagcctggctaatttttaaatttttttgtggagacttgtctcactttgttgcccaagctgctttggaactcctggcctcaagccatcctcttgcctaggcctcccaaagtgctgcgattacaggcgtgagccaccatgcccagctctctcttgggtcttaaagcaaagtgtcaaagacccagccaccacttcttagaaatgactcgatgtcatactagcataaatgcatcgataaaaagatggaaatgtggtaacacagtgatcttggggaatcctagttttcttttccaatttctttgttgttgcagtgagcaagtacttgtttcaagataggaatgaaatattcggctcttttagacagacaagcacaggtgctcagtttgggagaagaattaaaatcctctgcactctccatgctgccttgctaattcttggggtcctgtcctcatcttctactcttgccttctgcagggaccccacagtgtgttttccccgatctttttgtatcactctaaatccagtattgggcccagggagcaccccctcccctgcccccttcagctgtcctcctgcctgagtcttctggaagcttcgggacagaaagaacccaaggatttgtcatgaagctcagtgtggcaggtctactgtttccatgtaaatcatgtctgcttatctgagctggttttggtggaaactgatggaaattatggggaagctaaatccctgtctctctgcaagccactccccaatcccacccccatgaattggcattgtcacagtcctggtgcttcatttctttctatatttgaagatgaatttgagggaaatagtcagaaagtcaagaagaacacagcagaaatcaattggggtgagtccagaacaaaacttggggatcccacttcctgctttttttttttttttgagatggagtctcactctgtcgcccaggctggagtgcagcggcaagacctcagctcactgcaacctgtggctccctggttcaagtgattctcctgcctcagcctcctgagtagctgggattagaggcatgcgccaccacacctagctaatttttgtatttttagtagagacagggttttgccatgttggccaatttggtctcgaactcctgacctcaaatgatctgcccacctcggactcccaacatgttcatattacagtagtaagccacggcttctggccccaattcctgctctctagctccgggaaaacctgtggctgcatgcagagtcttagacaacttccttttcctctctgggcctcagtttcccattctgtaagatgagaggtttccataggcctacactttctaattggtggctttcaatcctctggtgatttgcataaaaggcatctatttcaattgtggttataaataacaaaccccaataaatagacgaattatttaaatggtttctcattatcactgaatagttgagagtctactgtatttgagtgaaaatgcagcacgagaaactgaaatcagatgcgctcatgattatgaccctgaggtcaatgtgtcattcccttcattccctccttgcccccatgaaggtttgactactgtatggtttgaacctgtgcttcttagttgtttattgcttaagttttagccacaacggcaaattgcagcgggaaattcagtcttactttgtcatttggaaacaaaatacaaaacctatcaaaataaagcactagcttttttttttttgagacaaaatggaagaaatcctaatattaggttagaaaagcaattttttggtgtttttaaaattttatttatttatttttttgagacagagtcttgctctgtcgcccaggctggagtgcagtggtgcgatctcggctaaccgcaagctccgcctcccaggttcacgccattctcctgcctcagcctcccgagtagctggtactacaggcgcccgccaccacgcccggctaagtgtttatatttttagtagagacggggtttcactgtgttagccaggatggtctcgatctcgtggcctcatgatctgccagccttggcctcccaaagtgctgggattacaggcgtgagccactgtgcccggcctctttggtgtgtattttgatgtggtgactggtagttaaattcagtgtacatatgaattcactcttgggacaaaatatgctggatttgagcttgttttcaggcaaatcatgtttcatcttgcagagctaattcaaagtatactgactgcatgcacttcttgcttaggggaagaaaactcatcaaaatttgtttctaggcatatgttattagagctaggattaaaataaatcttacatactttctttaatatgctaacattaacacgtttcgcttaaaaaagtatcgatcatttatcatggaaaaatacaccagcttacacaaattcctaaagcgtttttcgtgtgtgtgtgtgtgtgtgtgtgtgcgtgtgtgtgtgtagagatggggtttcgccatattgcccaggctggtctcgaactcctgggttcaagcgatccacccacctcagcctcccaaagtgctgggattacaggcgtgagccacacacccggccctaaagctttttgtgagattatatattttacctgcgaaatatatgggtcagaaagatttgagaaagttgttagataattccaccaacgaaatctcccgtcctttccagctgtgatggtgaattctaaagtagaattcatctttggagcttctccctgtaggcatgcaccttgcgttgcacctgccagatgtcgcgcggagtcctccaggcctctagaaggcagagatggtctcgtttccttgccgagcatgcgccttagttctctcttctggggctgtgaccgtggggtcgaagcgcgcgtgcgcggcggcggctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgaggtgagcgcccgccccgccgcccggcgccgagtcgccgggccggtggttcagcctctctgggccgcgctggcctcgtctctgacaccgggcggtgtggagtccttggagcccttacctcttccgaggctatgctgtccgcgggctccctgcagcccctccccagtcgcgctggaggggaggttcttatcatggggtcgtctaaggactgaggggtgccagacctcaggttcttcaaaaccccgactccagatccccggaacacagaccccagatcctcaaaacccagaccctaaattccctggagcccagactccatttctttaaaacttagacctgagatctcctcgaatcagaccccctgaaactcagatttccccaaacccacattccagaacctagagaccacatgtcttatcccccaaactccacagcccagaaccccccgaagttctaatccactgctcctccaaaccccgcggcatgattttaaagagcatcaattcccatcccatagatactgacctagtagatcagtattggcaaccctggggccggaaagctattttttatttctccggctcccctccacttctgaaaatggagagttgccagctgccctgattgccttaatgagtagttaatggaattaccctagagatttgtgctgaaggttttttttttttttttttttaattaagttgtaaagtcctgttaaatgtttatcagcccggtgggattatgacccagaaaggttcccgtaaagaggaaagggatggatggaggtaggggcagaatgtcatttgtcccggtagatgggaggggaccagagcaaggcctgggcctcatttttgggaggggatttatggtggggtaggacaaggaagaggaaaagagcgggtgcctcggaggtaatttaggagaaaacgaaggaagaggctgggaaatgccaaagagagggattggggaataagaccccaaagatcgtctgaaagcacctttgagctgttccagggctggcagtgaagggtgaagctctgtgttctgcaaagcgggctgctgaggattgggggaggggtagggagtcagttccacaccccaccagctctgcgacctgcccttgctctaggtttcagtttttgtacctataggatggtgttgggagagaaacagtggaacccagcagatacatttctttaacaagcggatccgtgatcttcttcaaggcccccttgtttgctgctttttcagactgaagaggtcagaggtcaggcattgaatgaatctacccactggcagcggcagggctcctaggatttcctgggtacatgtttctgggtgcccatgccacctcctaggtctgcactggggacaggacacgttcagggtggtatggctgtagacggcacagggcatttcagaagctgaaatgcaagaggccgctaaggcctcttgcaacttgtagtttccaggggttctggaaggaaggaaaagacaggcacccccctccaccctcaccctcatactaatagtgaccttgagagcagagaacaggttttgtgacccatttcaaagtgtgttccttaagcccaagggctgcctgtccagatggtgtgggacactcattctttcataagtaattcagattctgaaatcagacatttcatactggccatcttgatgtagattacattgccatcctgtgtcctgattgtactttatgaaagatgtagaaacaatcatgatatttcacggttatttcttgattgtgttttttgtgttcctatgcaactgccgccattcttctctagctttctcccatcctgagtgtttttacatcgtgttcattgagtcaacaactatttactgagccccggcacatactgaagccttgtccccagtgtggatatagcagtacagtgaacagaacagacaaaactccatactctcatgagactgacattttgttctctaacagggaccttactgttaaaaaaaaaaaaaattatactggttgctaatactttaacaatcagcaggtttcacattaaaaactgggtgctttatttctctggaaagccagccgatctttaggctgccacacttggcttgggttttgtagtgatctgaatccttttggatgaatgtcccttgatgttgcctccctaaccggtctagtctggtgaatttccagtccctgccttaaatgcatgcatctgaatctctttgtcacctgtagcaaattcactgagtacctagagtaagctagacactgtctcaggcactggggaatgaagttgtcactgacctcagagaactttacatacaggcttaaccttatttcacacgagtcctttcccaaatgttcaaatgttcgttttatgagttagtcactttgtacatcatcttagctggtgagattcgactgtttcatagcggctcgtgtcatggtttgtttcatggtcatagagcattaacattttggaggtgaggcttttaggtgcatcagacccaactgcttccttttacagacatggaaactgagcctcagagtggttgagctgtgcaggtacatttaggaaattttccttgagcccagtatgttccctacgtattacactgtgttgcctttttcttcagagagagatattaaatagtgatacaaactgctttttccattttacttattttattttgttttattttgaggcagggtctcacactgttgctcaggctggagtatagtggcaccatcatagctcaccaaagcctctgactcctggcctcaagcagtcctcctgcctcggcctcctgagtagctgaggctacaggcacgtgccatcatgcctagctaattttttttctagtagggatgaggtgtggctgtgttgtccaggctggtctcctgggctcaagtgatcctccttctttggcctcccaaagtgctgggattacaggcatgagccaccatgcctggccgcaaactgatttttctttgaatccatattctgtagcaggtgcttaatatgcattgatgtgaatctgtacaaccacatgaaaaggagtggctctatgtctgcacctgaagaaaccgaacacgagcttgcccaaggccacgcaacacgtggaagactcagatggcatttgggcatcttactgggttaacacttcgtgtctggtaatgctcagaatgtaagagttttagagagtccttgaagagaggacagatattaaatgtctttttagtctctttttcttcggagaatgaaagtaatgagaaaattaagtttctagatgaatgttgctccaagtatttgaaattattcagagttagtaaggaagatttctggccctcattgcagacctttagttgagaaatagaggtgggccccaggaatttgcaatttattttactttattttattattatttttgagacggagtcttgctctgtctcccaggctggagtgctgtggcatgatcttggctcactgcaacctccgcctcctgagttcaaacaattttcctgcctcagcctcccaagtacctgggactaccggtgcctgccaccatgcctgggtaactttttttgtatttttagtagggacagggtttcaccttgttggccaggctggtctcaaattcctgaccttaagtgatctgcccacctcaccctcctgaagtgctgggagtactggcatgagccaccgtgcccagccaggaatttgcatgttaataagcaccttactaatggcaaagtttgcaaatttgttttagacccggaaacttacacgagcaacctagaggcagccactaaaataaacagaaaagcattgaaaaataaggcattgtaataggctgtaggtggtttctaatctgaaaaacattgagtcacatgatttgggagagagtttgttgatttccctctgtccccagtaatgccccgtgttaaaagctggcatataataggtcctcagtgaatgtatactgactgagtgcattcaggtgtaacatgtgtagttaattcccaaaggcaatgttatgatttctgttttccttccttcctttccagataaagctgtacaccaagcatgggactttgaaataccagacagactgtgcccctaataatggttactttatgatccctttgtatgataaggtaagaggggactgcttgtcacttatgatgggaagtcactagtgtgcctcaccaggctgcattaaccatgtcctttcctacactagcaaatgctcatctgttttgtaaattattagtggaatatgataatcctagccacatttggagggagacaacttacaaactgccttgacgaatacagtggctctctctgtgtttaggaccatttggcaatgtctagagacgtttttgttgtgacatctgtggctgtgcgctacagtcacccagtgagtagtggccaggcgtggagctaaatgtgctacagtgctgcctacgacagcccagatgtcagtagtgccagggctgagaaactctgatttcatggaacccgttacttgcaagcagcttaaagtattgttaaaaaaattgtacaagtaatacatgaattcatgaactttgtgaaaaagaaagtcaaggtctttagaagtatgtgaaataaatttgtacccttttcgctccaattttacctccctctgtagtgataacctctgataatctgataaaggttttttttgttgtttttttttttcttcttttgagttggagtctcgctctgtcgcccaggctggagtgcagtggtgtgatcttgcctcactccaacctccaccccccaggttcaagccattttccttcctcagcctcctgaatagctgggattacaggcatctgccactacacccagctaatgttttgtatttttaatagtgatggggttttgccatgttggctaggctggtctcgaactcctgacctcaagtgaaccacctgcctcagcctcccaaagtgctgggattacaggtgtgagccgatgtttccggccctcttataaaattttgatgtgcatcctaacagattgctttctatttatagttattcagatatccacgggtacacatgcatatgtatatatggaaatacacacaagcacacatgcacatcgatatgtatccacaaacacctctatacaatcccatcctcccacatataaaccttttatttggaaatacagattcataggaagttgcaaaaatagtcaatacacatagttttgattttgatatattttttaatacaaatgaaatcaaacaataggatttattctgcagtttcattttttcccctgtgttaatgctttcaataccagagggacatttggttttttcctcttgcatgctttcaacattagcatagatagatctactgacttttttttttttttttgagacagagtctcactctgtcagccaggctggagtgcagtggcgcgatctcggctcactgcaacctctgcctcctgggttccagtgattcttctgcctcagcctcccaagtagctgggattacaggcacccaccaccatgcccagctaattttttttgtatttttagtagagatggtgtttcaccatgttggccaggctggttttgaactcctgacctcaggtgatccgcccacctcagcctcccagagtgctgggattacaggcatgagccaccatgctcagcctactgacttctttttaatggctgcatagtgtgtcagagtcaaacccaaactgtaatttatttaactacttggacatatagactttccccaattttaaaataatagtaattttaacataacacaccaggaaatattcttgaacttaactcttcatccagaatgcataggattgatttctagagatggactagctgggtctgtcctgaaatctatttaattaatttttaaatagtatcagtatcagtctcaagaaaccaggaggctggacgtggtagctcatgcctgtaatcctagcactttgggaggttgaggtaggtggatcgcctgagctcaggagtgtgagaccagcctgggcaacatggtgcaaccccgtctctactaaaatacaaaaaaattagccgggtgtcacgtggatgcctgtagtcccagctacttgggaggctgaggcaggagaatcgcttgaacccaggagacggaggttgcagtgagccaagatcgcaccacttcactccagcctgggcaacagagcgaggctccatctcaaaaaaaaaaaactaaaacaaaaacagaaaccagggttgataagtaaaatctagttttatttattgaattaatgagttaacgtattgtttagagacaggatccccttccgctgcccatgctggagtgcaggggcacaattatggttcactgcagcactgacctcctgggctcaagtgatctttctgcctcttcctcctaagtagctaagactgtaggcgcctgccaccacacccagctaattttttaagaacattttttgtacagatggggtcttgctatgttgcttaggctggtcttgaactcctggcctcaagtgaccctcctgccttggcctcccacagtgttgggattataggtgtgaggtactgtgcctggccaaatctagttttagggggtgcctttagttcctgaagatacatgctaacttgtgcaactgtaggcatgtgagggcttaatgggagactcaattaatagaattatagtatgtttagtattaaaagacagtgagtggctgaacctagtgtctttagaactcatgaatgggcttcagcactgtcttctgattgtttagatgaaaacttctggtgttcagcttcagcttgtagcttctgaagagaatcagtgctcagtaccatgtagaagaacaaggcttactcttagaatttcatttccggtgtaaaaaaattttagattaaatgataacactaaactaaatttagccagagtcacaattctcatttcttgaaattacattttctttttttccttttagggggatttcattctgaagattgagcctcccctagggtggagttttggtaagttaactgaatcactagacattctttgtaaaagattagatgatatgccgaatattaatttaggctagcagagtgcataaactattaaaatattaaggatcatttccagtatggaagagggtttgtattcctcccctccttgcccccatcactctggtttagttcggatttaccttaatctacctcaagactttctgtcacctttgaaaaatagacatcttttcttctacctttctggaaactcttcccttgcagtttcactcattacgtggccgtggaacagtatagaaatcaagagtggggacttggttcccatcccaggatggcttcttttttagccccctcagttttttaagtttttatggaattaattgaaacatttaaagattgtgagatttgtcataaaaatccagatttatgtcccatgagatgagaagactgtcagccttataccttaccagttaaataactttgggcaagttacttcccccgtgtcagcctggctcctcactgtcgagcaagggtagttatagtccctgccccactgggtacttggaggattaataaaccaatactgagtgttcagaggggctggcacgtaattagcaagtactcagtattcagaaacagcccttctgcacacatcccaacaaaagctccaaactttcctcatataactgccttcaagcatagctggggagttggggatggggttgagatcagaagagagggtctgttttgatgtagtttacatttttgaagaggagagactcttgatgtttcagtagagcaggtgtgggtgaccccagtccatggcttggggagaggagtagggatcaccgttgttgatatcaggcttgctcgtgcattagacaaggaagaatttagcacctgccatcaccaaggctaaaatgaggctcaggcagctgacagctaatttggctctgtgagagcagctcttttatcagtttatagtcaggggtagggtcgggggtgcctggctggtacgttccagaaagctggagaggaatgcagccctgctcatggccaaagcagaagtccagattggtggcctggaggagtgttgtgtttgccaccccccaccctacccccaactggtgctgttgataagctttttaattgaattatactttcagaaaagtgccttggatgaattttcactaagtgaacacacccatgtatccaccatccagataataagatagcacttcaccagcaccccagaagtccccatcctgggtgctcattagccatcccgccccaccctccaggtgaccaccaccctgaccttctacaaattagagatccatttggtctgttttgaactttatacaaatgctatcatgcagggaactttttaatatccggtttctttcactcaacattatgaactttatctgtatcatttgtagctttagttcattctctttgctgttgagaattctgatgcataaatataaaattatttatattttataaaatacttatattttattttatttttttcttttttttgagactgagtctcgctctgttgcccaggctggagtgtgatctcagttcactgcaacttctgcccgggttcaagcaattcttgtgcctcagcctcctcagtagatgagattacaggtgtgcaccaccacacccagctaatttttgtatttttagtagagatggggtttcatcatgttgacccaggctggtctcgaactcctgacctcaagtgatctgcccgctttggcctcccaaagtgttgggattataggcaagagccaccacgcctggcctatatttatattttatattcatattttgtatcagtgatctcttctactgttgatggccatttgagttgcttaccgattttggccactaagagcagtgctcctgtgaacattcttgtatgtatattttgatacatgtgtctgcatttttgctgagtatatcacaggagtaaagtcgctgagccatagagctgatacatgctcagctttaggtgtttgcaaacatccaaagtggatgcaccagtttgtgttctcccagcagtgtacaagggtttccattgctccacatcctaacctacacttgatatcgtcagttttttttaattttagcccttctggtgggggtgtggtattatctcactgtggccttgatttacattccactgatggccaatgaggttgcacactttttcgtatgtttatgtttgtttgccatgggctagctatttttgtaagattcctgttcaagtcttttgcccattttttattggagtctttgtgtgtgtgtgtgtgtgtgtgtgtgtgcatgtacgcgtgcaagcacgtgtgtaattcatcttaactgaaaatctcatctcatggttttccatttttttctctactcattactccatattcttcctaacctttcaaaaactcaaccttaacccctattatgatgaactcttcagttaaaaaatggagttaattgctgatattgaaaaatcaagagatggtatataaaatccagatttccagtttttcggagaagttggaagctctggcaaagcatggtagtggttggcagacttgagtggcagttgtctcctttcaatttgccacagtccccctgaggatgctccgctcacttcgaacccatgaggcccctgtggccctggagtttgtgttcctggtttaacatggctgagctcatgtccttggtcagagaacagatccagagccagacttttagggttgaattggggctctgttactcagaagctctgtgatcttgggagctcctttaacctttctgtgccttaatttacccctcagtaaattgcagctattactgcctgtctcttaagataattgtgaggattaaaggcactcagctcagtgcctggtcggtgatgagcattcaggaaataaaattatttggtgctcactgaattttcactggaactctgagatataacttagctgaaaggcgttgtaaaattattttatactctaaacacgaattccctctggggcaggaaaccaggaggctagggggataggggtgagagggagacttttcccagaatactttttcgtacctttggatttggaaacacaacgagtgtattaagtgttcaaaagtaaaatgaaacctgaataataaaaatacgttctacttaggttcactgtaccccaaaactaagcttgcctttgtgtcttgtgccccggtttcctcccctgcttcgttcctcagagccgacgaccgtggagctccatgtggatggagtcagtgacatctgcacaaagggtggggacatcaactttgtcttcactgggttctctgtgaatggcaaggtttgtctttggaacttgattatttttcctgttcactctataatgtatactaaatccttttttaaaaaaatgcaggatattttaacctggggactttgatcccacaagggacccatggataagtggcaagtgagcctgtgaactctgtacttcatccgtgtagaacacagcaggtgtatttaggaatgagattgaggttgctggtcatcccctctgctcccagagcataggctgttggtgtttttatttttttattttttattttgagacagggtcttcctctattgcccaggctggagtgcagtggtgcaatcttgactcactgcagcctccacctcccaggttcaagtgattctcctgcctcaccctcccgctccttcaccctcccgagtagctaggattacaagtgtgtgccaccatgcctggctaatttttgtattttcagtagagatgggcttttgctgtgttggccaggctggtctcaaactcctgacctcaggtgatccgcctgcctccacctcccatagtgctgggattacaggtgtacgctgtgcacccagccgctgttagcgtttatgtcagggatggccttttacagggatgccgaattggaaggacacactctctaagccttgtggcatcttgctgtccctgtgggtgaattgaagtcagcttctcccagagagagcgtgcatctgcttctgacacttacgtaggaggattcctattatttaagttctgagatttttttggaccgccacggtggtgtgaatttagagtcctaacgggtgtgtgcccagctcccgtgattcagattctcaggggagagtcatttctcctccacccgccctgtgcctgcggttgagatgtgcttccttccttcctgtccttctcttcatgatggacttctttctcctctacctttgcggtgacggggaggcccttccatcccagctgtatgtgtgggcttcttgttagagatggggatcttgggtagttttttctttatcgatggtttgcaaaataatggtgaacctttttttatttttatttttatttatttatttttttgagacagagtctcgctctgtggcctaagctggagtgcagtagcgcagtctctctcaccacaacctccacctcctgggttcgagcaattctcctgcctcagcctccccagtagctgggattacaggcgtgtgccacctgacccagctaatttttatatttttatttttatgtacatttacttttttttttttttttttttttttaagatggagtctccctctgtcgcccaggctggagtgcagtggcgcgattgcagcttactgcaacctccgcctcctgggttcaagtgattctcctgcctcagcctcaggagtagctgggattacaagcatgtgccatgacgcccagctaatttttgtatttttagtagagacagggtttcaccatgttggccaggctggtctcaaactcctgacctcaagtggtctgcctgcctcagcctcccaaagtgctgggattacaggcgtgaaccaccacacccacccagaccaataatggtgaatctataactgatgatgtcttagattcattgaaatagagtcttattttactgttactgttccctctcctacctcatccccaggaaacatatccatgatttatagcatcttttcaatgggattcttgacccaaagagggttcctgggctccacctgggagttgtaagcaggactgccagtgctttgagaggagggtgctttgctgggtgggccctaactttcttctccatggcaggtcctcagcaaagggcagcccctgggtcctgcgggagttcaggtgtctctgagaaacactgggaccgaagcaaagatccagtccacagttacacagcctggcggaaagtgagtagcgtcctgtctcttagtgttgccttagagccgggctctgacaggggtcatggagctgggtttgggagtttggattcagggagttctgggttcagatcctgattcagcctcttaagtttgggtgagttcatgcccgtcagagtgctgagttccccacatgtgaaatggaatccatttgacccatcttgcctagcattgatgagatgattaaatatgagttcatactggccaggcatgttggcttgcgcctataatgccagcactttgggaggccagtatgggaggatcacttgagttcaggagttcgagaccagcctggacaacatagggagactcagtctccacaaataatttaaaaaattatatcaagtagagtcccatgggggaagaaaattagctgggtgtggtggcatgcttctgtggttgcagctactcgggaggctgaggcgggaggattgcttgagcctggaaggttgaggctgcggtgagccgtgatcatgtgccactgtgctccagcctcggcagcagagcaagaccctgtctgaaacaaacaaaaaaagagttaatacccataaagcacctgcttcaaggcctggggcttagtgggtcttcatttagcagctcagcctggctctggagcctgccagcccgggcttgaatcccagctcccccatttgctggctggttgacctagggcaagttccttaacccctctgtgcctcagtttcctcttttgtaaatgaagataattgtggaacctatctcctaaggtactggaaagatgaaattaatattattacttcaagctgcctggcatattagctcaaataggttagctcagttatgattagaaaaaatcattatcattattatatcaaaactgctttgtagttggaacagatgcctagctgaccttgctgagtcagatttaaagcatttatttaatggatgtatatagttgagttgtaaatgttaacagatatgccaagattaataccagaatagttcaaactgataattccgaaagcgttcaaatcattactaactccgttaatatacaaactgagtaaattgcaaaatagaagtttataatgagtctgtcagtaagttattcaattttaaagttattattgttgaaactagttttcatttttgaaataacatttacttctgcttgactggtgcctctccaggcctggtgtgtagcaggaatatggagctgtaattttttttctgggctagtaatttggtgttgaccttactagaaaaaaatagtgtcttgagccttctgaatacctttcatctgcactaactgaaacaatgaaacatgtagcactgggctattatgaaaatgaaatagaacctcaatcttaccaatacttgtagtaatgtgatttccaagacctatccagttattgcaggcaagatttgacacaataaaataccacagaagaagaaatcaaatgcgttttctagttcatttcaccggacttagccttctcatttgtcagttgccttacaaatttgaagggataaacatgttagtatactggcagcagcatttccagctttagctcggctcactctggtgttagtctgtctatggctagtagagtaattttcatcagctgctggtttcttatctcagttgctttgtgcaaaaacccagaatgacttatctgtgtttctctaaagccttttttctgggattcaaagcttatcatagtttaccctgccctgtgtcatttgcatcatcttgggtcagcgtccccctcagcctgtgcatctgttctgttctttttcaccccacttctcccttcccatgtgtttccttggacacttctgtccccttctccttgtcagttcatgcctgtcacctctgtcaaacccagtcgaatgttctgtgactggtccctgctgtgctacaaggattggttttatgccagaaatccttgagattaagggagacgtaagcactcctctttccgatcagcacatggagcacccctcttggcacacagtaagtgctcaataagcgctcttttatgcagatttgtacagtgaaggattgaatttcattcatgctcatttaacaagctaatggaagtttgcgataattccaacattgttttcttgtgctgccaacattagtcatagaattagaaatacttgggttgtttggagaaagttaaatggttattttttatgtcttaggtttgcattttttaaagttctgcctggagattatgaaatcctcgcaactcatccaacctgggcgttgaaagaggtgagtgacagctacgtctatagccatgccaataatatgctggtcttgggacaaatgtagggcttttcaatttaggatatgaaaagaatttatggttcctccaggactagatgaagaaccaatggtgctgttgtttagtttggtagttatttataaggtgtaactcctcactgtagcagatgttgcttgtgttagtttcagttttaggtgacagtgttgtcttcctgctgtgaaatagatctgttttattaactatagctattttaaactaaatcaacaacagaaggccctgacgagatttatttgttgttcttttttcagcctgaaacagaaatctgtaaatatactaaacattctagaaactgtggtacgcgtgaccaaggagaatgtatgagaatgtttattgcagctttgtttgtaatagcaaaatattgtaaacaacctaaatgccttttaagagaagaatggattggggttccatcatacaataggctgctgtatgtcagcagtaatgaatgaaccagagctacatatatcaatgtaactacatttaaaaacagagttgaaggaaatatgattttaaatacttgtgataatcatttatggatacagtcttttttttttttttttttttttaaagacggagtctcgctctgttgccaagactggagtgcagtggcatgattttggcttattgcaacctcggccttctgtgtccaagcgagtctccggcttcagtctcctgagcagctgaattacagggatgtgccaccacgcccagctaatttttgtatttttagtatatatgggattttgccatgttggccaggctggtctcgaactcctagcctcaaatgatccaccagcctcgggctctcaaagtggtgggattacaggtataaaccagtgcactcggccagatacagtctttttttttttttttttttttgcaacagggtcttgctctgttgcccaggctagagtacagtgacatattcatggctcattgcagcctctggttcctggccttaagcgatccttcaccttggcctcccaaggatctggaactgcaggcatgtgccactgcccctagctaaggatacagtcttttttttttgagatgaagtcttgctcttgttgcccaggctggagtgcaatggggcgatctcggctcattgcaacctccgcctcttgggttcaagcgattctcctgcctcagcctcctgagtagctggggttacaggtgcctgccaccatgcccagttaatttttgtatttttagtagggacagggaggatacagtcttatgtagaaaaattataaagacatgtatgggaatagcagacgctgttcaaaatgatactgacttctagagaaagagggaggagggggacttcggggtacgccagcatcttgaattgtatttttttaaatttctttagctggttagaaggtatgtaagtgttctttagcatatctttttttgtttgactgaaatagtttatagtcaaagatcaaaaaaggaactccacctagtaggtgaggttctgtaatagccgtgaaagaccaaattgaaataagacttaagggacatcttgacatgttagcttctgtgttagtattgaagctgtatctcatttttgctaaagaagcattggaatcagtatttcagcttctactctatctgttttattattatttttactctgtaggttttacgcacttataattgatgatagtttcacacctagatgtctcttcttactgtttgtgacttttggttttgggggtttttctcttctgcagcaacatttaaaaatattttattcgaggctgggcgcagttgctcatgctgtaattccagcattttgggaggctgaggtgggtggatcacttgaggtcaggagttcgagaccaacctggccaacatggtgaaaccgcatctctactaaaaatagaaaaaaattagccaggaatggtggcatacacctgtaatcccagctactcgggaggctgaggcaggagaatcgcttgaacctgggaggtggaggtagcagtgagccaagattgcaccactgcacttcagcttgggtgacagagtgagactccatctcaaaaaaaaaaaaaaaaaaatttattcgaaatgaaagagcttacacatttataaatagaagagattttaaggtttacattgtatgttaattgtctgcatagaagaatctgagtttattaatatgagattgggattttcaagtaaagcatgttgttagaagtcaggataatgtttatcttcctggggtgttagtgaccggaagcaagtgtgagggcacttctggcttgctggtgctattctgttgggtaatcagtgcccaatttgtgacaagccctgtgctgcgtgcttagaatctgtacacttttctctgtgtttattgtaccttaacaaaaatgtttaaaaatatacacatattgtgaaaagaacaacttaaggcaaattaaacagagtttaattgagcatagaacaatttgtcaattgggcagctccctgagccagaataggtttacagcgactgtggcactgttgcgtgattggaaagggtttatggacagaaaaagaaagtgacggacagaaagtggaagtgaggtacagaaacagttggattggttacagctggacgtttgtcttatttgcacatggtttgaacagttggctgcctgtgagtagttgaagggtggctgcttgaattgggtgagacttggcaacacgtaagagaaacctttaggccaaacttaaaatatgtaaggaggcagctttaggctaatcttcagttaacactatatatcattaaaaatagaaaaaaaggcaaaatatgctcattaaaaaaattggaacatatagaggaatataaagcagtggaaacaaattttggaagctggaaaagtatacaagtaaaatagcaccatatagacaaaatcattattgtttacattttgccacatttcctttcacttcattttgggcattaaaaaataatgataagccaggcacggtggctcacacctgtaatcccagcactttgggaggctgaggcgggcggatcacctgaggtcaggagttcgagaccagcctggccaacacggtgaaaccctgtctctactaaaaatacaaaaattagccgggcgtggtggcgagcgcttgtaatccccgctacttgggaggctgaggcaggagaatctcttgaacccaggaggcagaggttgcagtgagccgaggttgcaccattgcactcaagcctgtgtgacatactgagactccgtctcaagaaaagaagtgatcatactgaataagcaattttatagattacgtttcccagttaatattttagcttcagcgtgtcctcatgttgttaggcactttgcaagtgtttatttttttacaggttaaaatctttttctgttacaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggtaagcaaagaaaagaacaaaagagatggtgtgaagggtaggagggtgggggattatagaccagaacgtactgttttaaaaaatgcaggtctgagttgatttatcattttaacacttaagaatatcgtctgtctcaggccgggtgtggtagctcatgcctgtaatcccagcactttgggaggccaaggtgggtggatcacttgaggtcaggagttttagaccagcctggccaacattatgaaaccccatctctactaaaaatacaaaaacattagccgggcatgttggcacgtgcctgtagtcccagctgcgtgggaggctgaggcagtagaatcgcttgaacccaggaggtggaggttgcagtgagccaagatcacgccactgcactccagcctgggtgacagagtgagactctcaaaaaaaaaaaaaaaattcaagaatatcatgtgtctctgttgactcacaagacattgcacatctacactgggaggcagtggtatgtgatggaaagtacacaggctttgaaatcagacctgggtttaaacaaatctcagatttaaacaaattcctcttcctagctatgcgaccctgggccggtcacattaccttcctgagcttccgtttccttatttggagaatggtgacccatgataaggaaggacagtcatgtcatctttcccgggaagactgtgccagtttttaactttgcaacttgaatgtcaagatttttgttccttttatctgtattaatgtttcttagatttcagaaatacatatattgacatgaaacttaaaaaaattttcctataatgtggctaattgatggtattcagaacatgtaaatggaaaaggaagtcttgtcttttttaccccctggcataggatgtcctgggctgcaatgtctcaccagtgcctgggttccagccccaagacgagagtctggtgtatttgtgctacacggtctccagagaagatggctcgttctctttctattccttgccaagtgggggctacactgtggtgagtgaagcagatttccgttctgtttatgtctgggactctcatgacacagtaaaagccaatgctgtttgggtgttaaaggaaaagatggttggcctgcagttctctgaacatgctgttaagcagtaacttacttaagatgagacactcaccccttcgtaatagctacaaaaagggcaaggcttcctcttttcaaatctgcaacagttatgatgaatgtttctcttggtctgtctgaaccccttgtcatttgtgggctgctagatcgattattaatattgctgattgatcatgttagtggttcttagtgattaagagactcttccttccagattccgttctatcgaggggagaggattacctttgatgtggcgccttccagacttgacttcacagtggagcatgacagcttgaaaatcgaggtaaggcttttctgtcttctggagggacaggtgtttgagttcccatccctaggcacaggtattgcaaacatgttttaaaaaaaaatcaattattttatctggaagggctgttggaaaaaatgccatctggtattatattcttacccatgatgtccttatcgtagagagctggattcctagttaaatctactcattcaatgaaatatatttattgattgccagtgacatgcatttcaggcaccattccaggactggggatatagcagtgaccaaaagaggcaaaaattcttgtccctgtggacctcatttttttttttttttttttttttaagacagggtctcactgtgtggctcaagctggagtgcagtggtacgatctcatctcactgcagccattgcctccagggttcaagtgatcctcccacctcagcctgttgagtagctgggaccacaggcacgtgccaccatgcccagctaatttttgtatttttgttagagatggggtttcaccatgttgcccaggctgttctctaactcctgggttcaagtgatctgcctgcctcggcttcccaaagtgttgggattacaggtgtgagccatcgcacctggctagacctcatgttctaatgacaggaagggtcaatacatgtatagatgtataagttagaaagtacagtagaaggtgataagtgttctctagaaaaataaaggaagaaaggaggtagtacagtatcagggtggagacaggggttgcagttgtacatagggtgtttttgggaagtcctccctgtgaaggtgacatttgagcaacaacctgaagggaaagaacaagagaaccatacttcactcctgcaggaagagtgtgtaagactgagggaacggcacgtgcaaaggtcctgaggcaggagtgtgctgaagggtttggggcatcccaaggaggccagggtggctggagtggagggaatgagcaaggaaggaggaggcggaaagagggtcagggaggtgacagggcagattgtgcagggcttggtgggctactttgcctataactctgggtgagaattggtgccactggaaggttcctagcagaggagtggcgtgatccttctggcagctgcattgaggagagtttgcagggtgtcagggtggaagtgggagaccagttgggatgccatggccgtaaaccaggtgagaactggcagagcttggaccgtgatggtaggaatgggcagtgtgatacatggcttgataaactgcctagaccctcacataaatggtaaatgtatttttcatctcacttacgtctcctttaattacagaagtagaaaatggttactgtagaaaattggctagctagaacaaatcccaaaagaaaataacagcctctcctaagtggaccacccaatgttagagttatcgaagcaattatattttaatcattttcttttaataattacatttgaaagtactgtgttaaaatcgcttaaactggcagaagcggacttttaggtcatatgcacagtggggtgcagactctgcattttaagattcagtggagtgtttgaccgttctgctgtacactggaggggaaagagaagggtaagaagatgaagcctttactttgcttctcgtagcttgcagagaaggatgggggcaggtgagcagagacagctattcccagattacagccaaatacatattttgaaaatgatgaatggaatttcagggaatggggccctgtaagttccctgaggtcaggtactgtgtcttattctttactgttttcctaacatgtgatttagtgcctggcacatagtaggtgcccagcaaaaatatttgttgcgtacatatgtgaattaataagtaggtaatgcatggaatgaaacatgtctttttggaaagatcaataaggactacctgtcatgtgagaccatcactaagaaaccatttgctgaaaaaaaaaataaaaaaataaaaaagaagggctccctgcataaaaaggaagtcatttaattatttaaagcttcatctcaaatgctgttgcacacgtgcgtgcacacattcattcattcaggagtcagttattgagtgcctgctgtgtaccaggtgactaagacagaaaaagtccctgtctccatgaggtaacatgctagtgggagggagacaactaagaaatcgaacgaggacatttcagatactggtaagtttgatgaagatattaaaataggttagcagtggtgaccttggggatacacagatcagggctggaactcagtaactgcagagaaagcacagctgtgctgctcacaggcgagtggggcacagacacagacacagacacatggagcacgggaccacgtgtgagccagtgatggtggtggaggagggtggtctaggtggatttctttttttttctttgagacagagtcttgctgcttcacacaggctggcactatcttggctcactgcaacctctgcatcccgagttgaagtgattctcctgcctcagcctcccgagtagctgggattacaggcgcccgccaccacacctggctaatttttgtatttttagtggagacagggcttcaccatgttggccaggctggtcttggactgctgacctcaagtgatctgcctgcctcggcctcccaaagtgctgggattacaggcgtgaaccactgcgcctggcctaggtggatttcataaggacctgtgttcaggtcgtggtggaaagacaggaggggacacgtgagaccttgcagaggtggaatccacaggactgatcgatgctggaggagcggggcgggtcatccaaagtgatgccggggtgtgcatgggagactggaggaagacgtggttcaccaaaatgggggcatctggaggggaggagatggcacaggggtaagggtggggggcttctagaagcttgagtcagtgaccttttaacgagggaagtaagtctctagacttttcttttctgttgtttgacactcagcagtgtgttgggaacacaacagagaagacagatgtgggtaaagtgagagggagcccggctggcacacaggaccggggcactgagtgttgggaggtgggcggcaggagcagacatggtaggtggtggccggcgcagcagaaggaggctttgtggctctggcacaggagcaccttcgagcaccttcttgttctttgttttctagcccgtgttccacgtcatgggattctccgtcaccgggagggtcttgaacggacccgaaggagatggtgttccagaagcagtagtcaccctgaataaccaaatcaaaggtgggctgacacagcagccccaggctgatggccagcgctctttttggatcacagagagaaatggagaggaactgatgactatatgagaacatggcagcttttggtccaagtattctggtgtacatgtaaggatacactgttgtttttggcttatcttctgtttgtgtgtttttgttttacagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggtaagcttatcgtgtggatttggaagcaccagtaaatatgctggcagccagtgtagaaccaaatgacctgtgatctgtgtgtctttgccgagcttaagaacttaagaaagattagtactttttttttttttttgagagacagagtcttgccctgttgcccaggctgtagtgcagtggtgccatctcgactcactgcaacctctgcctcccaggttcaagtgattctcctgcctcagcttcccaagtagctgggactacaggcgtgccccaccacacccagctaatttttgtattttttagtagagacagggtttcactatatgttgtccaggctagtctcaaaactcctaacctcaggctgtctgcctgctttggcctcccaaagtgctgggattataggtgtgagacactgcacccggccaagaaagattagttctaaatcttacaaactgaaggtactgacatgtcggatgcttaatgaaaagtcccttgcttcaaattaaaatgggcttgtgaaattaaaaaatctttcatgtctgactttcacgatctttcacaggacccctctttgcttaatctttgaggatttttggaagatggtattgttggttgagaaagcttattggaagatgcttcaggtcattggtgtagttcttcctgcttgtagttactcattatactataagtacaggcagggacatcttgtggttgaattcatgtggttttaccatcatctgaagcaagattgtgtagtgccaagaacttgggctttggagtcagatcccagatccacctgtatgtaacctgcagaacagctttagacataacaggtgctcacaaaacagtagcttagaaggagactgcagggtctgcttgggagaagcgcggcatgagcaaagtcaggcagtctcacagcagcatgaggtggctgcgggtgtaaagctgggtgctactggagcagaatatactggcaggtgaaggtgatgatgaggccaaccccatagcacctcctcacaccccaccagggcgtaggggctttctcccactggggccaacgggccatgagtggttttgagcattaatataacaagctttgatcattgttttcaatagggcattctgaaaacaatggcatggagtagagtggctttgaaggggacaggacttgggcacaggaggtctgaaagcagagacgacaagggcttgccttgtagggaagtcagggacagactggtgagatatttagggtgcccagcttgagaggtgtgatggctggggacagaaagagaagccagttaggtgatgaggtttcagatttggccacattggtctgtaggaccactaggtggagctcttcaataggtacttggatggatggtaaatcctgaagatttggccgcaggtggcagccaggacctcaaatatgtatgtgcaagtagaattagaagaacagtaggccaaaaacagagtgccaggtggcccagggggggacctagggagcctgaggtcataggagctaagaaagtaagtttggggtaggaggtagggcccaacagggaggtgcagggagctgggccctggtgaacacagtcccctggcttgatcactgaggaggccacagtgactcttttctgtagacagatggaggtcaaggtcaaggagtccagtggtgaatggaagacagggaagcaaattaccctcagaaagtaattcttggatttaagtctttcccaccttccataaacactttgtgcaattactctagatgaggcactgaaaaatgcttcatacctaataattaatcaaactagtgttccagagatggggctttcaccctaccagggagacagactgaagacaaatacatctgtggccaggcttaatgcctcacacctgtaatccatcccagcactttgggaggcagaggtgggcggatcgcttgagcccaggagtttgagaccagcctgggcaacttggcaaaacaccatctctaccaaaaatgcaaaaattagctagtttcataacctggtctaaaaataaataaagagataaaaattaaaaaataacaagatttttaaaaaagacaaaaaagacaaatacatttatgctgctaaattatggcaaatgttgtgcagggaagagatcagggtgctgcaagaagagctaatttagagtgggagctctgcaaggctctctgggttgcagagaccttagtaaagactaaaagttagctaaagaaagatcttccctagtagagaagcagcatgctcagaggcctgcataggataggaaggacctgaaaggcagtctgcgcagctggaggaggtgggtgaggtcagggagctctggggccttgtagccttgctttgggattgggctttgctccctaatgcagtggaaacccgttaggagttgtctgttggttggccgggcacggtggctcacgcctatgatctcagcactttgggaggctgaggtgggcggatcatgaggtcaggagttcaagcgcagcctggccagcatggtgaaacccggtctgtactaaagatacaaaaggttggcggggcatggtgatgcgcgcctataatcccagcaactcaggaggctgaggcaggagaatcgcttgaacccgagaggcaggggttgcagtgagctgagattgcaccattgcactccagcctgggcgacagggtgagattccgtctcaaaaaaaaaaaaaagagttatcagttggcaagggagtgatagggatcatggtactttaaaaagtttgtttttcttcctggctgctgtgtggagaatggattggaggaaagccatggtgtgaatggaggggccagatatgaggcagtcatggttgtctggaggagatatggtagtggctgggcccaggcggctggcaggcgagggagcgaggagtagatggatttggtaggtcacatggagaacacacccacaggcctgtgctgttgaggttacaggtttcttatttgagccactgggtagatggaggcggtgctgttcacggagatggaggaaatatatttattttctcctttaaagtagagtatttgggtcaaagaaagaaaaatagcatttgttgaacatttttggaaaaatctcttttttttaattggccgatgtagtacatttgcctttttagcacactgatacttcttactatttcttttcctttttattttttgttgagccagggtcttactccgttgcccaggctggagtacggtggcgccatctcggctcactgcagcctccgcctctcgggttcaagtgattctcctgccccagcctcctgagtagctgggattacaggctaatttttatattttttagtagagatgtggttttgccgtgttggctaggctggtctcgaactcctgacctcaagtgacccacccgcctcggcttcccaaagtgctgggattacaggctgagccatggtgcctagtcttcctttaaagtaaaataaaaaaattactcaatttattgtaaaaacaaactctttggcttctgtccaaatgactgtgaaaatagatttctctcaatatccaccaatattacctgtttctgtccatatatgtatttaaaccctgttgaaagaatttattgatacaaatcaatttttaagggcttcagtataacggaacctttttctaccacccttttggtttatttttccaaactaagccagtatagatttgaggtttagggaaaataggcacttctttttaataagaatgtgggctaaaacagatcttatggttcaaatatttacaacttaaggaggcaaagagatttgataggaaatagacaaggtgatgtgtcctctgacaggtacacaaatcaagagaatatgacaggtccttgggaatgattgtgtcagtgttcgcttcccatccttttattctgaaagttcacagtaggggaatgtgagaaccaaaatgcatatgctaggtcagggactgggacactttctctgtggagagccagagaataactattttaggctgcgtgagccatacggtctctaggacaacagctgagatagacatttgtaaatgaatgggcagagcgcaacacaactacatttttggacaccacagtttgcatttcatgtaatttttacatgtgaaatattatctttcttttgatttttttttttaactttaaccacttaagagtgtaaaattctttttctcggcttgcagttcatacacaaacgggaggggggtccttgggtggtagtttgctgacccatgctggagatagtgagctcatatggctgggcagtcccttcactctgaagaaatggctgtgtttttcataattcctagatttcacatacacaatcttccaccatttccttgtgttttccactgtttttttatttgaggcggagtggtggttccaacatttaatgtacccctaattgtcagaatccaacattcttgattatctttatgtcagaagtaactaatttttatctaaaatgattcttgaagattctttaaaatgaacagttgaaaagacaactgtgacccccagctaggatgtactattacactttaatacaccagctgcttcagaaatgaagaccagcactccaaggatgatggtcgttgtaggggggcctctcgtgtgttattcgagggatgccttgcaacaccttactccttatttagaatctcaaatctgaatcattaccttaatagggcttttcagttataagttacattgtggctcctacctcccaaggagttcaattttagctttgcattttttaacttaattaccttttctgttccaatctcccagtttgctttcatccatgtattatatataatcacaagcaaggaagacgtctttgataatcctgacttatttgatggcctggtaatgccacagtttcttaggcagcttagagctcttgcttttaagggctagcccacattctcagtccaaggccgctctgctgtcaacgatccaattacctgaaacgtttttattatctgcagattttcttaaaattgcctctgcagtgggggattgccagatgtcacccggaacacacaaacagccccactacgggcccctgttctgtagaaagatgcccagtcttgcttctgaaggttgctttttaaaaccagaatgaaggttgctttttaaaaccagaatcatctggattgcattctgtctcttcattaagattagactattctcaggaacaagggctgggagagggctgcatcttttttggtcgataagagcctttcctgttataattgagtcctcgtgctggaatgaatggtcttctctttgcaggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgcgatgcattgttttaaatttaaaatgttttgagaaaaagcagtgatttttagaagggttattaggtcgaatggggttagagaaggagcattccagtttccaacttcttgtttttaagtctttacaatcctgcaccagtagaggagagtcagataggcatccagctaaaaaataatgccatctgcctctcttttttccagtcttgatgtttattagtatcaggctgccagtcactcctctaccttcaggcttctggctgctgtagaatgtcgatgagtccaagaggacaccaaaaatgaactctactaatggccgctcaaaaatggccatagtgcgtggcttctgggaccccaggccaaaatggagcttcccatttcctgctttgccttgacttcaagatggctaggcagggaccacgcgacttatccattcaagcaggccgagaacggggagacggtctggcctgtggtctcatcaccatggtgaaggcccaagccacagctggcccaagcaagcaagagacaggacagagcagaggtcagcccaccatgcctttcagtgcagtggccctgcccttggggagagactgtttccgtgggctgtcacccatcaaatcagcagctgcccttcctccctgtggaagagcaaataacacaaagggagagggccgagaaggttccctgttagactctgctgtcctctagggcaaagtggggtccctccctctgtgggaaacagggtaggagattgcgttctccctgcttccacagaacagcgtggtgtgtgggttgacagctgactttattagatggtagctggcttcttgcgaagatgtccacattgacaagtctttggaagccctttcggaagcatgatggacttctccaaggaagggcagtgtcgtctttactagggatgaaagagttgaccgctgctaccttcacctgttcctcttcttagcccatgaaaggcacgcacaacaataggaggaagaaaatgacttaattccaccaaagtgtcatccacatagtgttgacaggttcagagcttatgctacaagtgatccgaagccgggaaaagtgactgggatgtagtatggtttctagtatgtaagtgaggcgtgtccgcgttgcgggcctgtggggaattaggccagatagacttttgttcatacacatcggtctgttgaggctaatttttcatctgggtagaaccgtgcttacttcacacaagttattcgtggatttgttgtgattgtaaaatcagcctggaaacgaacctttggccttcaaaatctctttagccttggtcccagatgaatgttctagcgccctgtaggtcagggggaagatctccccgaatgcagcctctaacgttccatccacgtttccgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttgggtaagatatcactggaaagtaagaacacatagtttcaaagaagtcagccggtaggagtgggatttgggaaactttttgttttgcctttgttgtttgctactgatcacctgcgtgcgagggaggcttcttggagtcaggtgggtacatgttaacttgaaagaagcgctccgtctgcctccggccactgcctcttaggagctcagcagtagcaagaagctattacatagggttaggattcgaacctgtgctgaagccttataaggggtcacatggagccctcccttcttttccctgcagacacctgtggtgacttgctggtgactctacagtccctgagccgccagggtgagaagcggagcctccagctctccggcaaggtcaacgccatgactttcacctttgacaacgtgctccctggaaaatacaaaagtaagaattggaatgcaacatcctgtggccctcacacacttcttgtctttgtaaactttctaaaactcaggtctcaaattgtatcacgaccatgtacctttccttgttttaagtcgtctttgcctcgtgaccttgactgcattatttagcgttggacaagcatggaggagtccaggccctgagctgaccgccaccttgtctgcacagcccactggcggcttctgttaagggagggtgccccgacgtatggcattttatttctaaagcccagagaaaggagtgtgaaatagttccactgatgtgttctactaacttagcagtactggtgctgagtactggccatggcaaggtacttgacctccctgaaactcagttttcccatctgtaaaatagacataatagaacctttctgcagaatataagactaaaagaagtaaagtttataaagcccgttgtgcagagagccagctaagtagctggtgcccacaaatgttacttcccttttccttgcccttcttaagaagccacttcttgcctgtatttctgctttttcagaaatcagcttggggctgctggcagtggatagctcataaaacagactgctttttctggaattatattaatattttctgttatggcagggcttggcagactacaaaaactgccttttataagcgtagtttccttagaatacagccttgcccatttgtttatggattctctatggctgctcgtgtgtaacagtggccaagtcgagtggttgaggctgacaaagcatgtggcctgcaaaactgaaaagagttacagaaaaagtttgtggatccctgaataccttacttgcagcctgatcttacaggccccattagatttctttcttgatgtaatggaaattggttccagtttttctttctttttttttgaaatttagcctcgctctgtcacccaggccggagtgtggtggcgcgaccttggctcactgcaacctctccgccttctgggtgcaggagattctcttgcctcagcttcccgagtagctgggattacaggcatgcaccaccatgcctggataacttttgtatttttagtagagatggggttttgctatgttggtcagactggtcttgaactcctggcttcaagccatccactgccgtcggcctcccagagtgctgggattataggcatgagccaccacgctcgactccaggttttctttagcagtaatttattccaaatactgctagttataaatatatgtatgtgtatatttctatctttatgtctacatacacacctgctttttaaaattagttaattcatgatcattgtttctggtggcgtgcagggaggtggtgtgctccacgcccatgtatccgtttttggtgtttgcttttgcagtaagcatcatgcatgaggattggtgctggaagaacaagagcctggaggtggaagtgctggaggatgacgtgtctgcagttgagttcaggcagacgggctacatgctgagatgttccctgtctcacgccatcactctggtatgtacggcttatggagtctcttatttggaaaagcgcttgccttgtggatgtcaagaaagactaacatcccaggaatattgtaaacgtaggcaagtcagatttccttttctgcctctgcactcacccacctgttacgcaacgcataatcaggaagcatttatactctctcagtggaaggacccctgtatttaggaggtttccttgtcctggccctacactaaatctgactggtgattcggggtgacctttggtacagtgtagagcacactggctttatattattagtaataatagctttgggtaaattcatttactgcttctcagcctcagttttcaccgaaaattgagatcttaatacctacttctcagggttatggcagggcttaagtgaaccctcttaggtatcaaagtgtccttggtgtacaccgctctgtactgccaagtgagtttctctgatatatatatatatatatatatatatatatatattttttttttttttttttttttttttttgagatggagtcttgctctgttgcccaggctggagtgcagtggtgcaatctcggctcactgaaacctccgcctcccgagttcaagcgattctcctgcttcagccccccgagtagctgggactagaggtgcgtgccgccatgcccagctaatttttttcttttttttttgtatttttgttagagacagagttccaccatgttggccagactggtcttaaaactcctgacctcaggggatccacccgcgttggcctcgcagagtgctaggattacaggcgtgagccattgtgccccaccttctctggtgtatttgttccagtgcaggggaagaagctgtaaacaggatcttagcttcttgttgactgtggtctctgtggcctgaaaggcagtgtgaaatgggtttcaggagcacctctgtagatcccttcgtgaattttctataatgttttgatgtcgagcggcggcagatgtcatcgtcaggtcttagtttctctgtagagaaactagaagaattggaactggtgtttcatgtgccaacttactcccctaactgcttaattacaaaaactccacaggtcgatttgttataggagatcgattaatatccggttcataataagtgatagatatttaggaaacctttcccttccagcagtggagtggatttccagctctcttgtaataagatccttttttttttttttttttgacacttccttaaccccttctttatctcctcccactgtcccctcactcgccgggccccagccacagtggtcctctgcagtcccacaccaagctcactccctcctcggggcctttgcacatactctcccctctgcctggagtgctgtgacttctccagaaacacgtgttgttggtttttcctcctcattcaggtgcagccctattgttcaggagagatgtgccctgggaccagcgagctaaagacccctcggtggggattgttcttctcttgctttcctgtttattttcacagcttcgttactgaccagttgagatcactaatttatttgttgttgcgttgattttgtcttcctgtattagaacataagccctgtgagagcaggagccatggtcatgactcccaaggcccagccttgtgtctgtcacatagcaggtgctcaataaatattagttgattgaatgaaaaatagcacacttttgttggaagttttgggaggtttttaattttcctgtggcacccaactgctccaatgattaatgggcaaaacagatgactggtttggaaagagaaatattattaatcatcttggtgtctccatctctcttagtaagtcattgtattggctttgctcccttaggaattttatcaggatggaaatgggcgtgagaatgtggggatttataacctctccaaaggagtcaaccgattctgcctgtccaagcctggtaagtttggaaggattgatgtgccatgaattagaaaaatggaaaggcaccagaggatggttttgaaggcatttttttctaccttggttctgtttgcatcaagctttcaatttctgtgtgttcaacctgctcttgtttttctgtctgtcttgggtttgagttgggtagacaccactgggccctttcacctccaaaaatataccattggccaatggcctctctttatagagctgttttaaaatttgaatcatttcccactttgcttaaaatctttcagtggcttctcgctctttctcattttttttttctctttctttttttgagatggagtcttgctctgtcacccaggctggagtgtagtggctcgatcttggctcactgcagcctccgcctcctgggttcaggcgattcccctgcctcagcctctcgagtagctgggattacaggtgcccaccaccacatccggctaatttttgtatttttagtagggatgggtttcaccacattgtccaggctggtctcaaactcctgacctaaagtgatccgcccgcctcagcctcccaaagtgctgggattacaggtgtgagctgctgcacccaaccctctctctcttttataatggctttttttggaggcagaatttgcatatcataaaactcacctatttaagatgtacaataaaatgatttgtagtaaatttatcaagttgcacaaccatggccagaatccagttttagatttgttcatcacccacaatgtaagatcctctgtgcccgttgacagttaatccctgtttctagccatggccagccactgatctattttctgtccccatggattggctttttttggacgtttatcatacgatgctggtattttgtttggcttcttttatttaacatgtttttgaagtttatctgtgtcatggcacatatcagtagtttgttctgttacattgctgtgtagtattctggtgtgtggttatatcatattttgtgtatccatttatcagttggtggatatttgagtggtttccagtttgacgctgttatgactaatgttacggacattcttatacaagtctttgtgtccgtatgttttcgtttttcttgtttcgatacctaggaatggaattgctgcattgtgtgataagtttatgtttaaccttttaagaaactgtcaaattgttttccacagaggctgtgtcatttgatattcccaccagcaatgcacgagggttccggtttcttcacctccttcgccaacatttgttattgtctgttttattatagtcatcttggtagatgtgaagtcgtgtctcattgtggttttgttttgcattttcctaatgaataattcagtggctcctccgtttggttcccaagataaaatacaaactccttaacctgatcttagctcctgtgtaacccagccctgtctgccactgtctctactccagccactctgtccttctgggtgtcagttcagctgcctttggctacatgtaacaaaatccatacagcagtgccattggcaagtggtagtttatttggctcaataaagaagtgtggcagtgcgtggctgccagcatgggttcagcagctggtagatgttaggggtggtgtctttgtgattctttaggcctttcccttctattttttgccttgtattttcaagatggctgtggttagaaaacttatgtttaaaggaggaagtcaaggagagggcaggcaaacatttccttgcgccccctcctccagtaagctacttgtctgtattattggccagaaccgtgccacatggttacttctagctgcaagggaggctgggacagttggatgtgctacccgaggctgagcacgttgccaccctcaacataaccagggtttgttctcaaggcaggaaggatgcctgttgaggaaacaatgagccagcctgtgaggcagatgctgttctctgtggacatctcctcctgcccctcctagctggggccttcttacccatcagttcagtattgcttcctggggaaggatggcctccagggccacttaggcctgcctcctacactcttgctctcagcactcacttctatccccttcttgcatgtgccacaattgatatgtttgtggctgtcaaatgctccccctctctgtggatggtaaactccatgaagacagggaccactgctctgtcattccccactgtgtaccagtacctagcataatacctggccaggaagagatgctctgtcgatatttgttgaatgaaagaccaaacaaaacaaacagagaaacctgatttttttttttttttttttttgatggtaactactctggggcttgttgagtgcaatgaaaacagcagggtggttttagctaatttcaggtttttgtaggaagtgtggccaaaatactggttaatgatgatttgggggaaatacattgttattccttgtatcttcctgaaattgactgtgttcctctggcaagtgatgaaatgtacccctactcggagtgtcctcccacacagactcacacttttctggggcttcccttactccttacctcctttttaggaatatttataggaagaaattgaggctgtggttatctcttggatccttaatagaatcttttaagtaggaaattatcctcagtccaatttgcagtagaaacgtactttctgttccttctcgtgcatgggtccgttcacctggtctgtgcagatttaactactgtgagttgttaccttatggaaaatgaaaatcatgcgcctgtgatcgggccattgcatggatcgggtcattggtaagacgccttcataggcagtgaaaacgatgcctgcccagtatttctgatcccattattgcagatctgcgatacatttgagttttcacatgcaaagagctgccactcgatttcagatgtcggaattgctcagtgtaatagatgccattctctgaaaattacttttgatttcctgtctgtaggtgtgtacaaagtgacccctcgctcctgccaccggtttgagcaagcgttctacacctatgacacgtaagcctgggaattgaatgctttgtggtgtttgtatacattccgtggaggattcttcatttacttcagagaacaaaaggagtttttctgttttttttctgaaagaggcaaggttaggccttcaacagcatttctagataaggattttaagacacttggattagttactgaggaaccggagacaggatccctttcccaagaattctgtaaccccaggatagagggctgtgtttttgaagtgccttaaatagaagctttgtcaaatctcccagccctcaccgatgggcatctgtcaagttcaagtctgccatttttgtatttttacagacgtgtgtgggtttcactgggaattggaagcataaagttgtggagtggagaattagtttactctttaaaatacttctctggatctccagagttattttaccccagactaaaagcaattttctgtagtatatttagggtgaagaaggatgcccaaaaagggtattgctgatgatcttctgagaatgagtaggttctagcgtttcctctgctttgatttgtaggtcttcacctagtatcttgacattgacagccattcgccaccatgtccttggaactatcaccaccgacaaaatgatggatgtcactgtgactatcaagtaagatgagcgttctgcagtgggccgagagtggcgggagagggtgtggatgaggcctggggagtctctaataggctctctggaaattagttttgatttcttatctctagatgtatatacaaatggccttccctctcttataggacattgccgtcaattcccagcagccttgatcctttccatttctgattcagaaattacctgtgggtgaggaagagcgttgcgacagcttgtttcagtgtcttcaatttctgtttgaactctttgtacttctcatctttgctaaggaaaaaaaaaatctctggggtttgtgcattgtatttcaagtgttttagcaaattcaaattgcctatttttctttagacttttgcttgaaggcttgggaaatagagatggcacctggtataagagaagggtcgtgagagaggaagtatttgaaaggcaagtccctcaccgaaggtcacgttcatgtgaatgtcacctttcagggaatttttgcagtgtggtgaggtacctgtgacgccccaattttcttgagaaatgaaagagttttggcaacatgaccgtctctgtcaagtagaatgggcattgcagtccctgtctccctcctgcccctggttgaagtcacctttccagctatgtttccatctttctgtccaccatctgtttatccatccgtcatccctgcagagtacatgatgactgaaaaactgagagtcttcagtgtttaggcactgggcttatgaggccacagcccctacacttatgggattgacagtctcatggggggaacagtggtcagatactcacatgcagaaccgtaaaatgacaactgttctgagtgctttgagcttgaccttgggggcatgcaggacaggtaggctgcggggggccaggccatgttaaggtccatagtctttgtcccatgatgcaattgacatgttttacatagaggaatgacatttttcttcctgaaggtccccctattggccgagtggagaacagacagaagaggcctgagagtgggaggtggtggaggcagggggaggcaatgggggccccagactagtggctgcggagatggagagcgacggactggtcggagagtcgttgagggactgagttgatgagacatggcactaaagtgaccactgggttagggcgggagaaatgtcagggctggccctggtttctggtgatggggagccaggtttttagctgggggtggatttgccgaaggtctgttgctgtcttttactatcatttactgtctccctgcttggaaagtatgaattactgataggactagcaatctaccttcttaccagtagtaactgcatgttacctcctttcagcttgattacattcatttttgtaacttcacaagggtgtttgtgttgcttgcttgtgccggaggttgtatggaatgcatcttccagctagacagagccactcggattcccctgggaatcgtgtactcagcagacccaaaacccgactgctgacagttgccctccatgagcccctctgtggtcttttctgattcagatatggcagctcccgctttctccttgtttcttgattcttatttcccttgaaccctaggcccagccaattccccaacaaagccttggctttacaatcaaaatacacccatcatctagtccctttttaccacttggccctcagccttggtctgacccccctctggggtcactgtagcagcttcccagctggccttcccttcttaccacgtggccctcagccctggtctgaccccctccgggatcactgcagcagcttcccagctgggctttgcttcttaccacgtggccctcagccctagtctgaccccctctgggatcattgcagcagcttcccagctggccttcccttctcaccacgtggccctcagccctggtctgacccccctctgggatcactgcagcagcttctcagctggccttcctgtttccgccattgctttgtgtattttccatgaaggagcaaacgatttcttttatcataccattcctcgactgaaaactccagtggctccaggtcggcaccaagcctgtgaagcctcagtctgacatctgctgccccttggacctctctgttggatatgactcttccgtgggcccctgtgccccaggctggactggtgttgccattgcttgaacatctgagtgagctttctctccaaggactttgcacttggcatcgctttgcccaagctactgtttacccagagagctgcgtggcgcattctctcccttccttcagacctttgctcaatgtcaccttatcagaaaggccttgactgtccctttaatgtaaaacagtgctccgggctctccgtcttcccacactgctttatttttctttattgcacttttcctctggtattatttttctctttattttcagccccttcccactgaaacgtggattccacaggggtaggaagtgtggtctgttttgttgatgctgtatccttggtgcctagttctctatcagagcagttctcagcgaaggtagaatggagaacagaggatggtggtgtggagaaaactccgtgtcctacatggaagctacaagcttatatccagtcgccataaaatcaaccgtatttcattccagcccagatctaccagatactgccaccatcactgcgaagctcagttgttattttttgtgaaactactagtttatttaaaacagaagactccgccactgtggtgtcatgataagatgtccagtttgtaactcgcaagtccatactcgtagaaaggtcaaattcccactgaccacaaggatacgcaaccacgtcctaggggccgccatttctttcttctaggtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtaagctctcttgtgcgtttccctacagtgtcctctgttttgtggggataggacccgccaaactgaagtatattaattattttaggtctggagagaaaatcactgttacaccgtcatctaaagagctgctcttttatcccccttcaatggaagccgttgtcagtggaggtaaatgtcaactcagcgagcgaatgtcacacacacctttgcagttgttcccttgcctgcatttacaagtagatttgtgatgttatagtgaagccatctttgtaagccaccttacatcctctctggcacacagatgttactgttggttggatggatggatggatggatggatggatggttgggttggatggatggatggatggatggatggatggatggatggatgaatgaatgatttagataaataaaagtaacttttgctgttagaattgagttgatctttttggaaaaggacttggttttctttgacattatcaggtcgacaccagaaggtagatgaagcacaaagctgccagtgatgatctttaatgatctttctgttgtttggcagagcatgatgggagggtctttttttggggaatggatgactgaagtgatcacttgtggagtatttgtcttttgccacttattatttttttcccagcactctggcttcgttaagttgtgggtgttatgtggttcgcgtttggaagcagagggtgttgaagagcgtgacttctagcaggcaggctgtttggggcggtctttctcagtgggtcctccagaggctgagcagcacggcctcctgtctgctgtaaagtgttccctcctgatctgtggcctcctgagaacctaggaagagtagtagtaaaaacccagccttcagcgttttttgattctcttgctaaagtccttcacactgagaaaggcctttcagggatggaaagaggcttgggctgtatccgattattgagctccccggggtgttaaataaccgcatttggaactagcttctaagatctgttttagccacttttgtcatgggaaacccccaaccaagaagctcctgtctctgctaccaagccccatccttgtgtttatttcttcccctcttagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacaggtgagcccgggatagagacacatttgcctgggatcagcgtgggagtcctctgaagaaactggggcccacatttccttgggcttggtaaggcttcctgcagggtgtgaacaaagccgttgctagcattctgctctctcctcttcagtgttggccccctgcacagtgacctggagtacacggtgacctcacagaaggagggctatgttctgactgcagtggaaggaaccatcggagacttcaaggcctatgccctggcaggcgtaagctttgaggtaactaacactgtattttcaaaaggcagttatactgaggtataattaacatataataaactgcacaaaaagggtacagtgtggtagtcttgacctaggaatacacccatgaaaacacctccacaattaaaatagcacatctgtggccctcaaggtttcctcctgccccttggtaatccctccctgccacccttccgctgagctgatgatctgcttttcatcaccattggttagtttgcattttcgagtttttataggttggtgcaaaagtgattgtggtttttgccattgagaataatggcagaaaccgcaatcacttttgcaccaacctgtatataaatggaatcaaacaggatatactgttgttttttttttttttttggtctgacttctttcacgtagcataatttggagagctgttgactttagcatgtttgtgtaccttctgggaagtagttaaagctgtcatccataactgttccattttgaaggacacagaatgttcttactgaggcgtttgctgcctagctcccttccaccggtcctttctgggaagaagcgtgctgcgattgtacagagtgggtctggagatcgttgagaatgaatatttataaactataggccaaaggaaaagagtgacagattacatcgcataaaaatttaaaattctatattgctgaatacatttggaaccaaactgaaagatattcaaactcggaagaaatgtttgtatcataaataatatccccattttacaaggagctcctaaaattggtaagaaaaagacaacccactagaaaaaaaatgaacaaagattatgaaaaggaaattcatggaagtaacgcaggtgactaataaacacagaaacacaaagcctctgtagttactgaggaaatgtgctaaggaagttacagtcgaaacactgttttgcagggattagatttgctgtaattaagacaatctctattttttggtaagtgtgggttttcccaagcataaataatttatgggactgtaagtggttacagccactttggaatgcaattagatagtatctttctgaatttaaagtgcatgtatccaacaattctacttctaggaatggattgttcaggaaataaaactaagtgcctagagatacatatttggggatattccaattgtctcttgtgtaccacaagagtaggtgctgtggtttgtcaaaccctgccttagaatgctatgcagtagttaagaaacaggcagatttctattggctggcagaagagaaccaggataaattgttgaggaagagagcaagttgcagaactgtacatataacatgccatttttatttcacctcctccacccactcaatgaacttgccagtctgtgaacaataatatgtaatgtttataaaatttgtgtgggcatagaaagagttctgggcggggcacggtggctcatgcctctaatcccagcactttgggaggcccaggcatgtggattgcttgagcccagtagtttgagatcagcctgggcaacgtggcaagacccgtctctataaaaaatacagaaatgtagttgggcatggtggtgtgcgcctatagtcccatctcctcaggaggttaaagctgaaggattgcttgagcttgggaggcgaaggttgtagtgagcccaggttgtgccactgcactccagcctgggtgacagagcaagaccctgtctcaaaaaaaaaaaaaaaaaaagttctagaaggctacacaccaaacttacaaaacttacaacagtagttacctgtggggaggaagattaggtcccctgtcctcctttgagtaacaataaaagaaaaaaaccttgaaaaaatgacctcttgacttgtggaactgttattttcatagttagtaggagtttaaccttgctctggtctcaccttctcatccccagataaaagctgaggatgaccagcccctcccgggagtcctcttatccctgagtggtggcctgtttcgttccaacctcttgacccaggacaacggcattctgacattctcaaacctggtaacgtgttctgcaatttaccacctgcctgtcttccctgagagagagccaggatgcagcatgcgagacttatgtgttgcttgacaacgtgagaagagaaggccaatgtggagtggtttcagtttcttgggggcccacggtcattagagtattgctcttactcgaacttaatgctgctgattcatgttcccttccacacgcgcttcttgttttctgatcacccgcttgtcactaagacagtgtaattaatttccctggccacaacggctgctctcttaggcgtcttctcgttttgccacagaatcatgtttatgatgctgagtcttgtttggtggttagcttgcgtttcttctgaaaagacattccacttggtgggaagagagcagcagtttttctttcaagatgcagtcggaggccctgactggtggggattcaggaagtgtgtgttagttggtcatcttgtcagtcatggtgacaaagtggctgtggtggggctactggagaccgggcagtgggggcatctgaagacaccactttgcagtgatgcagactgctccttacttgctgtgtcctatcaggcaagttactttgcctctctgagcctcagtttctttattcattaaattcaaatatgagccaggtatggtggcccacgcctgtaatcccaccgctttgggagggtgaggcagtaggatcgcttgagcttgggagtttgagaccagcaacataggaagaccccatctctacaaaaaataaaaaaattagctgggcatggtggtgcatgcctgtggtcccaggtactcaggaggccgaggtgggagatttgcttgagcccagaaggttgagactacggtgtgctgtgatcgtgcactccatcctgggggacagagtcaggccctgtctcagaaaaaaaaaaaaaaaagaaaagaaaaattaaatatgacttctacctctctgagtcattgcaggcaggtgataccatcagctgccgttgttagagttgtgattgccactacctgactgtgagtggtgattatagagagagggttactatttttggctgccagggaagccatggcgctcccctggtgtaattctggtccatcgtgacattcgcccctcacttttaagccatgcctagatgtggctgctgaggctcagtgtgattatcttggcagagccctggccagtattacttcaaacccatgatgaaggagttccggtttgagccatcctcacagatgatcgaggtgcaggaaggccagaacctgaagatcaccatcacggggtaccgaaccgcttacaggtaagtgccctggccaccccactctcttccagggctgggctggtgaatcacattcaggcctctgttgcctggaaacgcatcccaggcttcacactgattttacttgggagggaagggagatgagatatgagggcaaaggagttttgactgctgcccttctctcctaggagctcaacctggtggttcagtctcaaatttcctattttggaattggcttgagagagcctattgagttgctaaaagcttttatttattttttattttttgagacggagtttcattcttcttgcccaggctggagtacaatggcgcagccttggctcactgcaacctctgcctcccgggttccagcaattctcttgtcctggcctcccaagtagctgggactgccaccatgcatggctaatttttctatttttagtagagacaagatttcactttgttggccaggttggtctcggactcctgatctcagatgatctgcctgcctcggtctcccaaagtgttgggattacaggcgtgagccactgcgcctggccacttttattttttaaaagagtttcaaacctgaattacatcattaaaaggagaaaatgtgctcagttgaataaaacttcaaaatgctgaaaagagtatagtgtaaaatttcccctctgtctcgtctcctagccacccaagttcctcttctgggagacaaccagtacttccagtttttctgaatgctcccagctgtagatagatagatacacatgagtgtctggcaaggcacagtggctcacacctataatcccagcacttttggaggctgaagtgggaagttctcttgagtctggaagttcaagaccagcctaggcaacatagcaagaccccgtctctacaaaaaaataaaaatacaaaataaaaaagatacacatctatagatagagagatgcatacatatatacatgtatacacacagatacacacatatgtgtattttttgtagacttatacagaatcactttagaggaagagtaattggaaagattgggtttagaaaaatggaccattttctactgaatatatggaatgaaagaggaagtgagttatttccatgttattgaaagctccattatttcaaataaagcctagaaagaataaaataaagctttagccttcttaaattacaattttccagagcatccctcaaaatgtatgagaaaagaaattgatggcagcttatccctccggcaggaaggtgtggtttgaaagtgggccggccacaccgagttgcctgggtcattgaggcacagttctcccctgaactattttgccccataattgttggtaaacgggaaacacttgggtccttcagataaccatgagaatatctcattcgtgcctgttcttgccatactagttgctatggcacagtgtcttccttaaacggagagcccgaacaaggggttgccatggaagcggtgggccagaacgactgcagcatttacggagaagacaccgtgacagacgaagagggcaagttcagattacgtggattgctggtgagacttggaatgtgttttctttggggacttttttttcatcctgtgtccagaagtatcttgtggtggccccaagactgctaggagtgggttgggcgagagggctgggggtggggctctggagccctcccagttcttacctttaattggtagagtttgccttttttctagccaacaggtcagatcaaggatctgtggcacaatggagttggaaaaccatgggtttggtagggcttttccctagcagtatgtggccatggcttacgccagggctcaagccaaacgcctatggagccagaagagcagtatgaacgggggagaggaggctgtgcgaaatgatagggagtggtgagggctgtggagtgggcacggcctgtggaaagggacagcctgtcacttggttccagcttattgtagccatgggggaagacagagtcagggttgccagatccttgaaattttaaaaagagaagtcagaaattcccacttcccagaaataatacccaacacaagcatttgggaatgcttatggtggacattccagatatccatcaatgtgtatatacgggtagaggggaggggtggatggagaggaaaaacatcttagaagagtaagagcacatagtatgcttggaattttgaaataagaaaccaaatttgatttattttggggtaggagaaaatgaaactgagttgggatggaaggagtcgcaaaatttcagatgtttcaacactaggggtgttcttaaaggaactctggactcttaaggttaacaggccacagattaggaaatgaggggagagaaatgctcctgtcttaatgatctcgtgcagccaaaccaggcttggaccaggcacgatacgacaagccccctttctagagaactgactcctgagtttttttgcagccgggatgtgtgtaccacgttcagctcaaggcagaaggcaacgaccacattgagcgggcgctcccccaccatagggtgattgaggtaaggcattcagtgctgccgctgcacctgggtgtgggtgcctccctaatcagaagtcctcccgtctcctctggctgtctgcctttcatctgtggcggggggaactttcatcctaattaagggtcctcttagaatagtgtcatcttcacaagcagaatcttatgtgggtttttagtgaacagcgttgctgtcatgcatccagaaaggaaattggaactgttgtatcctccccgcgacttgccctgtaagctctgatcattattctgcaagttaaggaacttaaggcctaagcagcatttcaaatcaagggacaataatagcacatgggcttaatgggtggcagggccacgcagttatcttaggttcagatgacctttttcctgctcccattttgtgggcagagtcttttgatactcaagatcatgacctagctaaattaatccctaaagaggacatccttcgagtcacagaatgtggcctgggaatcatttgaagtaaggcttttctcttactgagtaactctcattgggaagactagagggcttaggtagggcaagaggggctgcctcttagtggctttatttaggtggcttcattatgcatgaagattgtgagggaggatagaacttttgacctaggaagtggattttcttttttttttcttttttttttttttgagatggagtctcaccctgtcacgcaggatggagtgcagtgccgtgatctcggctcactgcaacctcctccttgtgggttcaagtgattttcccacctcagcctgtagctgggactacaggcatacaccatcacacccgactaatttttgtatttttagtagagacggggtttcaccatgttggccagattggtcttgaactcctgacctcaggtgatctgctcgcttcggcctcccaaagtgctgggattacaggcatgagccaccgcaccgggccggaagtggatttccttgacgtctttacggtgttggcattttaaatggctgggatgactgcatctcacaccaaaatgctttgcatgttctcggtgtagtaacttaggccaggatcactagcataatgtggactgtggccgggcaggtatgaaagggaagggggccggccctctgggatctcgcaaactccatgtacagacctcacgcagagggggtgctgtgactctgcccctgctctaacaggcaagagcatccttctcctctttttttttaagagaagctggaaaatctggcttcatatatgaaatttcttaatttttaacatgttggcaagtaattcaaacgtagaaaaaaaatactgtgctttcgaaatgaaatgtgtctatgggccagggatatgcccctgctctaacaggcaagagcatccttctcctttttttttaagagaagctggaaaatctggcttcatatatgaaatttcctaatttttaacatgttggcaagtaattcaaacgtagaaaaaaaatactgtgctttcgaaatgaaatgtgtctatgggccagggatagccatcttctgtcggtttgtgaccttggacgtagggtactcaatgacaaacttagcttccttaatgtaagaagcaaagtttgccatgaagcagctctcaggccatcggacagctggcatagaagttcctccaccagctttctcattactggcattccctctttctctctctaggttgggaataatgacatcgatgatgtaaacatcatagttttccggcagattaatcaatttgatttaagtggaaatgtgatcacttcctctgaataccttcctacgttatgggtaagtccagacttttaagctccaagtattgtgttccctttggctttgagacaagtacgaatgggatgtttttggttttgtgcctgtctcgtgccttaggtgtgacaggtggaggtgctccagagtgccgcctgctgagggttgaggttgagatttaagaaccttggaccacaacacgtatttgggagagtgattgccagttgtgggagagaatgtggtccagtttcagataactgtctgccatcagttaatcttccaaagaattatagtagaagcctgatcaatgatcaatacaatatggaatctaacgtggaaagccaattctaaagaaagcgccttgtaacttaaaattttctctggagtggaggtcgtattaaacgttcttgcattggtttaaagaaatgcctgaggctagataatttataacaaaagaggtttcattggctcctcgttctgtaggttgtacaggaagcatagtggcgtctgcttctggggaggcctcaggaggcttccaatcatggcagaaggtgaagtgggagcaggcatgtcatgtgggagaagctggagcaaaagagagagttggggcatggtgccacacacttttaaatgatcagatctcacaagactcataacgaagacagcaccaagccacgagggatccaccccaaagatccgatcatctcacagcaggccctacctccggcacgggggattacaattcaacatgagatttgggcagggacaaatatccaaacagtatcagaggtggtggacggtgggctggagagcaggtggtctgggctttctcttgtctccagtagtgactcaccttgctgcctgggccagtcacttcatttccacatgcctcgacttcgtcctctgcaaaacctagattttggactcagagacctcttataatcttgttcagctctaacaaaatctccatgttaccattaatgaagaaatgtttataaaataccctgcagaccctctgcggatgttagtgatttgctctgggggtacattgttaagatgcgcttgtaattttataagcagttaagtatttggcatgggtgagaaagtgtgtgtgcgctttagtccactctgtccagggcttgcaggcgtgtgcttgtagggaccaggcaggtaatgtcagagagtgcagagggttgggtagggtggggggcaaactggggaactcctgccccatccatgaggggcacaagggaggggaagaggcagagaggaggggagggcgccactctcttgctcctgagtgttgctgtgctagaattgaggctcagggttggtgtcacttcccagttttccggagaagctggaaattagaattatttgaaatcacctgatttttaaatatagtcggtgaattcagatttacttaagatgttatagaagaaaaaagaacacataagggatcttcaatgcgacccataaccttcagtctgtgactttcattttaggaaaattcccctggtgtgttatgtagaaaggtgccagtgtgggcccagggaggtggtcctggcattctcttgcggcaggtgcactgtggcatcctcacagcctttgccatcagccagggctgcaccttaaccctgctcatgccccatcccgtgtgggagtgagaacaggcaacaaccccagaaataaagccagaaacaaagtactccagtgcctcctgaagcagcgtggagagccacgtacatgatggaatgcgttttgagtttaacagattggtggagttaaggtgacatcatatgatgaggcagtgcaaggcgggaaggaccctcaggagtcgtcagggggttgagtcccaggctctaccatgtgtaagttgtgtgaccttaggtgactttggctctctgggtctccatagggataataacaatacctgttttgtagtcaggattggcgataatgtagataaaatatctggcgcctgcctggcatattacagatgttcaacacgtgttagaagctatttttaatattactattatattaacttatattactattttgagcaagaacatgggtagtcagaatctgatttgaatcttaatttctgtgcatgatacataactggatggagtctcagatgacagagggatgtgtgatgtctatggagggagctttctttttcaaatatccatgtttccaaagacacctacccagagagcggctgtcctgaggatgtctgctatgaaatattgattgtgtttcagtttcaaagcatgtctgactttgtttctccctccaggtcaagctttacaaaagcgaaaacctcgacaatccaatccagacagtttcccttggccagtccctgttcttccatttccccccactgctcagagatggcgaggtaatgcctgtggccggattctaccttctgcctttgttttaataattctgctgtttagtttaaggaagcacagttctctccttttctccctaaataccactctgcagaaatgcgctctctgaatcaaaagaggttgggttctgtagggattattttttcttcattgtttttctgtttacaaaaagaatacatattcatggcaggagattttgggaaaaagaagacataagcccatcatccagaaatagccactgctaacatggtgattggtatcctttgggtcttttttcaggcacgtgtgcgcatgcatgtataaatataaatagacatttattttaataattcaaaactgacactgttttgtacattgttttgtaatccatgctcttcaatgaagaatttatcacaaatctgttcctcatcatcaaatctttcttttttttttttttttgagacggagtctcgccttgtcgcccaggctggagtgcagtggcgcaatctgggctcactgcaagctccgcctcctgggttcacaccattctcctgcctcagcctccgaagtagctgggactacaggcgtgcgccaccacacccggctaatttttttttttgtgtatttttagtagagacggggtttcaccatgttagccaggatggtcttgatctcctgacctcgtgatccacctgcctcggcctcccaaagtgctgagattacaggcgtgagcccccgtgcctggccaaatctttcatactatgatttttatggacagtagtccataaactaggaaacgcgatgatttatttaaccaaggcctactgttgggcatgatcgactcttgcactttgaacatatcaccccatgctttcctgctaagaagtccacttttaaaaatgccttgtaatttttaaaaattcctctattttaacattctgctattgagtttagggaaatacagtttcctcatgatgggggatcccttgaatgagatgagttgcttttctcttgctgctttgaacgttctctctgtctttgataatctgattataacgtgtgtcgtgtagaacacttgcagctccaccttttcagtgtcctttgggttccatgaatctggatgtctccctccttggaactgggaagttttcagccattattctggccgtcatttactgattataaagtgcttattatcaattctatttggacagagctaacttgtagttggtgtggggagtgcaaactttgcaaagaatttggttcttttctggtggtcttagcctgaggatgtcaagtgtgagcctagagggtgacgtttcctctcctggctccttaccacctgccgtgaagatgatctactctggcctttctctgtggaaaatggctgcgaaataatgaaacaggctgtcacggaattttctcctcctctttctccaggggtgttgaaatagtcacttcctacagcgatgcggaaacatcttgggctttggggtcacacttcccctgagttcagagccttcatagatgtgtggcagccttcttagctgagtgaccttgggcaagttactcttagtctcttcgtgcttgactttcctcgtctataagacggggtgatgatcccgaccttgccagtggtagaaagcaaagcagccgcgggcctcatgcaatgtgcatggtgcctggcagctggtcggtgctcagcacacagagctgtgacgggcctcatgcaatgtgcatggtgcctggcagctggtcggtgctcagcacacagagctgtggctgcccctggtgccgttccagggatgctgtatttttaggatttgccagcttacgagcctctcaagcatcgtcccttagaagtcagccccgttgtggatcctcagttgtatcacgtacctccctcatcagaattggctcataataattttttgtgtttcataaagtcagatcctcagaggaccgtaattgtcaaggttgggtactcataaaaaggctgcaggctctgacagccttatcagaagccacagtctcagagacactggggacacatgcccgccactgatggaatagcccgctgaggttgatactttgaaggcagcaaccttggtttggatgtgtagtcttggggatttctttaaaaacataaagttctttacatcacagccatacgttaggttttagttttcatttgctttgccagagctgtccttataaaaataacttcttcccatgtgtgcacagaactatgttgtgcttctggactccacactccccagatcccagtatgactacatcttgcctcaagtttctttcaccgcagtgggctaccataaacacatcaccttgatttttaatcccacggtaagtaaaagagggagttaaaaaaaaatccatgggctgggtttggtggctcacgcctgtaatcccagcactttgggaggccaaggctggtggatctcttgagcccgggagtttcagaccagcctaggcaatacggtaaaaccccaactctacaaaaaatacaaaaattaaccgggcgtggtggaacgcacctatagtcccggctactcaggaggctgaggtgggaggatcacttgagcctgggaggttgaggcctcgatgagccatgatcatgcccctgcactccagcttgggtaacagagtgagaccctttctccagaagaaacaaaacaaaacaaaacaaaacaaaacaaaacaatccatggggtggcaaaagaaggcatgtccatacaacctgtgctccaggtcgcaggttgcagggcagatatttaaagggctcctggcattgggtcactttctcattctgccttctggattctgggcttccccagattgtttttagcttttctgagcactgatgcctgcgattccctttgaggaggaaactggtaataagagcagtgtaattgtttagatcggtggctcaggaatgattttgggggaggagggacaccactatcgctggtgtggcgtgtgcttctccatgagggagcacatggtacatggccacgcaaacccctagaaccaactgctactttacaggaaatagggaggacccaggagcacgcaaatgactccacagggatgcaggacaaccacctggagcctgatttgtttgacaaataaattgcaaggaaaaaaaaaccaacaacagatggacagaatacctgtgggttaaaagaaacttaacttatcgcttaattcattgcaatatgtggcccttactatttgcaatatgtgtatctgttgcatacggtctgtcctgtatccgataggctggaacagtggaacaaacaaaacatacacgtatcttttaccttcttgataaaattgtttagtgattcctaaagctcagatgcagtattgtcacctgatgattaaacagacacatcagcaatagcaaaaacagagtccagggctcagcctcaggactgctgattctgaacttgacggggtgaaagtgtagcacaggagtctgcattaaaaacaaaaatctggcctcatagctactgtgttggttgttgcttctaggccttttcagtgggcagaataagaactttattgttttcaaaagatgtaactgtaagtggaacaatatcctccgatcctcctttttccttttttgataacgacacagcattcctctgtgtggatataccgtgtgtcttaggccatttgggctgctattttgtatcttagactgggtaacttataaacaacaaacatttatttcttacagtactagaggctgggaagtccaagatcaaggcattggcagatttggggtctggcgaggacttgctgtctgcttcatagatggtgccacctagctgtgtccccacaaggcggaaaggggcaaacaagttccctcaggccactcttacggggcattaatccctgacttaatcacctcctaaaaagggtgtcctcttgacactatcacattatggattagggttcaacctatgaattacgtaggcacagacacattcagatcctggcactacatgtaggatattcagttagcccctggttgaggggcgtttgtgttgttactggttttctgctattacacataaccctttaatgaattgccttacgcatgcatgtttttgagtgttcgtcagtctctctttggaatagactcccagaagtggaattgctgagtcaaagggtaaatgcatacggaattttgattgatacggccacttcccatccatgggggttttactgttttatattcccgccagcagtgaatgagtacccttttttccccaacagagtattttgtcaaatttttcaatttttgcaggcttatagatgagaagtgatattatctcactgtacttctaattgcatttctctcttttcatgtggttaagagccatttgtattttctgtgaactatttaacctatttttctatagaatttttggtctttttcaaccattttcagctctttgtatactaggaatattaaccctttgtaatgtttgttgtacatatttttcccaatttgtcatttatcttttcacttggtttctgcaaagatttactttatttctgtgttaaatgtgttgattttttcttattgcttctggattttagagtcataggaaggttttcttcattcccagcttttacaggaatttatcgtgtttttttcaggcagacttttatagtttctgtttttacatttaaatctctctatccatttggagtttttcctggtatagatgtgaagtatggctccagattgtctttttccacatgctatccagttaccatttcatgcttttcaaacgccatcctgcatggaaggtggacaggaattacctttcatttagagatgagaagatgggaacctagaaggagatgtgagcagcccaaggtcaccagctcacgtggagcagtgctagggcttgagcagagctctgctgctgattctgggcttctgtgaagagtgattcatgctcagtgagcctgtaaatatgatcttacctgaacaagagagtttttctcatgacccacgaggaaacacttccttgttactcacagtagagacctggttagaaagtgctggagagggctaggtgtggtggctcacgcctgtaatcccagcattttaggaggctgaggtgggcagatcatttgaggtcaggagttcgagaccagcctgggcaatgtggtgaaagtgaaaccccatctctgctaacaatacaaacattagccaggcgtggtagcacgcacctgtaatcccagctactcgagaggctgtggcaggagaattgtgaacctgggatgcagagtttgtagtgagctaagatagccccagtgcactccagcctgggcgacagagcaagactgtctcaaaaaaaaaaaaaaaaaagaaagtgccagaaagataagcatatacaagaaccacttacctttgcttggggctgcattgtggcccagttgctgggagaggcttctgtgaaggccgttgatagctgcaggcagtgacattctcaggggcccctagcagacaactcatccgggctcagggacacacctgggagccagtggcaggaatgtggagacactgcttggtggtggccgagcagcccagcctcgtagctgctgcctgtcacttctgagaatgtaagaaactgtgccctggtgtgtgatgttccccttcctgtatacctatgtaactaacctgcacattgtgcacatatatcctaaaacttaaagtataattaaaaaaaaaaaaaaaagctgtgcctgctggggcttggattcccgagcagggccaagtgttgaatgaagagagcgcccactctgtgccaccccgtacagggccctcacaggttgatcctcacaacaagccttcaagcaggtgtgccattcctcccattttcacagaagcccagaaagattgagtcacttactgagtgttagcagaaccaggactcaagtgaggcagtttgtctcaagccacatggtttccacctcgttctgccctccgcgtgatgagtggctcagcattgcatgttcacgggggctttgtaagcacattggtttccttctttgttgatgtgactgcccacagcctcgcgactggattttactcagtattccatgccctgctgagcatttcacatactcctttcatcaagtttcacagcatccacccccagtgggtgttgttcatatgatctccatgtcatagttgagtaaactgagtctcaacgtggttgcctgagtttacccagtgaggcctgggacctgagcctagactgaatcactcttaattcctgctgaattaaacttttatttatttattcattattatttttttctgagacagagtcttgctttgttgcccctgctggagtgcagtggcacgatcttggcccactgcaacctctgcgtcccgggttcaagtgattctcacctcctgagtagctggaattacaggcatgcaccaccacttctggctaattttgtatttttatagagacggggtttcaccatgctggccaggctgttctcaaactcctgacctcaggtgatctgcccacctcagcctcccaaagtgctgggattacaggcgtgagccactgcacctggcctgaattaaacttttaagtaagtgtttacttcagtggaaaaatgggttgggttctaagagatgtccagagatacaggagtaggcagttgttgatggaaatctgttcctgcccttattctttcatttatgaaagggcatcccaggtacagcggcccccacagtcactctctagcccagcagttctcggatgggttggttgcaggacccctttatactgttaaaaattattgaggattttaaagagtttgagtttgcatggattatctctgtgtatatttatcatattagtaattaaaaccgagatgttgaaaacgcaagaactcacaagctacacattccgttagctgtgggcgtgatgacatcagggtgcgtagtctctggaaaagtccactgtgtgcttgcgaatgaaagagggcggaaaaggcacatcacatcttactattggctgaaaatagctgtggcctcgggaacctctgcgagaggagtcccggtatcctacactgagaacactgctctggctcattaacttgtttttatcattattgggaagttctccttccatttatttgcttcctttatgagagtagagtgggccaatgggatataggttcacttgatgctttagaacccagcatttcaggggctttagcaagatggaaatgtctgtctcatgtcaagtgtccaggagtgaccagtgcagagatagtctggtagctccaaggcgtcaggggacccaggccccttctgtctcattgtgctgttccagtgcattgcttttctccaaaatggggcaattggccaaatgctgtctacccagcaaaagggagggcacaccacttccctagggtccagccagggtgtggcacttaccgcttctgttcctgtaccattggccaaaatttagttccagggctgcgcctgctgcagggaaggctggaaaaggtgatctatattgtcggtggcccagataaaagttgggggttctattgggagaaagggagaatggccacagggatgctagtagcagtgcctgctttgcttcctcactagaccgtactggctgggaatagctgcccatcactgtgtgccctgggtctagaactgtaggttcttgatacatccttgtaggactaagtccctgcatgttgctgggactcaacaaactgagacccagttgcttttcaaccaccaagactctctgatagctgcatctcttcatttcctcagttgggaggagggtccagaggctgaggaatgccttgtcattggaatctctttgtccctgagtttcagaagcaaatagtgaagctttgggcagaagaggattcatgggaaaatacatccaaatcactttggttccttcctttggatagaaggaatttggatcatgagggcccctgggtgtcctcaagtggccactttggaaggctgggtgggtggtggctgtggcattgtggatgatggacaagcttgtggccttggtgaggagtgatggggctctcggtgtttgcagaggaagctgcctgaacaggacatcgcacaaggatcctacattgccctgccattgacgctgctggttctgctggccggttacaaccatgacaaggtaggaaatccagaggcctcaggagatggcgggcatgtcagggagagcgagtcctcacagctgcaggagtgatagcagagggatgtccagggtcacagaaatcacatttcccggtcgggagggcccgtgaaggcctcaagtccagacttaggtctcctttcaaggctgtaaacttctgtaacatctcctaatccttaaacctggaacacctctagggacatattaggcccggagagaggccagcccatccctggggactcattagtaagaggcctgcctcgtttgaactgaaacccacccattagcacgtggcagctgctgatcatgtctgaagaaggtgtgttgagaagtgaggctccgctgttcatctggcaaaagcctcctctttgtacccctctctctcacactttctctcttttctagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctcatcatagatgtatttcttggatgacatgcacgtaacccccgggagtcttcagttgagccaaatgtagagcaagtcagagtcctgagtgaagctggctggggcaggaaaaacacgagctcagccaacatggtccccagcagcttttggcgtcagtgatagagaaatcggagatagtggaggttgtggcaagttgaagtgtgcccaccacgtctaagggaagcttagggactcagctctggctcacccctgctgtgcagaaatgtgcgttcatttttctagagaagccagaaaaacaaagatttacgtgaaattttcccaattttaaatgttagccacaaatgcagtgtttttttaagaaaaccacacactttggccaaacaaaatgcctacgtcggccgggtgaggcttaaaggttgccggcttgcatcagagatccagaggaagtcacagcattttaacagctaaacttaatcctcacaggaagtcatcaagtgaattaagtgatattgaaggaggggacacatccatccatccgacatttattgagtgccacataggacaggcatgggtatgtgaggatgagtagggtagacaacactctacagcgagctggaagaggccagggaggccccgtctgccttgttcttcgtaccccaatgcttggcacttggtgggcattcagtaaggaatgaatgaacgcacgcacagaggaatgaatagatgggcacacagtgtgtgccctcacagcacatggcccatcactgggtagaaggcaagtcagtaagtagacaggggtaatgcagggagccgagggcctccaggtggaggaacatggaggaccacaggagcacagagcagagttctcatcccactggagagcttagggaactttctggatgtgatgcgtgagcagagtccaaaaggacaaaacagagagagggaaaacaaggtggaagttcttgttaggtgccactgccaccccagggggtcagcttgggggactccctggctcttgggggccaaccgcagagctgccctgttcccacctatcagctagcttggtgttggcaccgtggaaggaaagtgaacagtgttggagatctgggacagatgtgatattaatacaggatccatttcttggagtgttttccaactcttattccaagtggacacccagaaacatcccttttaaatgttaatggggtttttattgacggtataaaggttaagagcttgcgaaagatacaattgtcagtacactccttccagttccggaggccgccagtaagtggcagtctttccctgtcgctggctgcaggtcacccttggcctcggtggaacttgtgtgggtcattctcagtccatttgaaagttgggcctgttcggttgtgtataattttctgttcatcatttttctggcaatctcaggacagaagtcctctgatcctcctgtgagaagtaaacattaatgttattagattctttttttttttttttgagtttcgctcttgtggcccaggctggagtgcagtggcgtgatctcggctcactgcaacctctgcctcccggtttcaagcgatttcctgcctcagcctcccgagtagctgggattacaggtgcccaccaccacgctcgcctaattttttgtatttttagtagatacggggtttcaccatgttgtccaggctggtcttgaactccctacctcaggtgattcatcaaccttggcctcccaaagtgctgggattacaggcgtgagccaccgcacccgggctgttattagacttggaatgggacaaaagtcatatgagacagacttgtttgctgaggtatttaaaaaacaaaatggtctaagatggcagattcttggggaactctgctctgtgcacatttctgcctattaaagtggccgtaaaaacaaccataaatccttgatgaggacacctcaggagctttaggacggtgccattcttttttaattaaaagctttttatttgatttgatttttctgtagagacagggtctcggctatgttgaccaggctggtcttgaactcttggccttaagtgatccttctgcctcaacctcccaaagtgctgagattataggcatgagtcaccacacctggccagggcagtgccattctaaggcaacggcttcaactcggtcttcttttctggggttacaggagatgggaagggccgaaggtagcatgagaacgtgtgtgtgtgtgtgtttgtgtgtgtgtgtgtgtgtttgtgcatgtgtatgtggaaggactggtgagatggctggaggaagaggcagtccttctgcttaactctaatggcctaaatgtgagaaacaaagattcaggaaataaggaaaaagcaaatgagtgattgcctctctggatcaagcacaccagcaggcacaaccagcctttcttgagctactgtgtgccgggcgctgtgccgtgcccttgcatgcatgtggatgcttcatgagttcatgaagtaggtatgcttccagccccatttttcagagaaagaaactgaggctgaacaatcttgcagctgtcaagtggcagagcaggggtttgaacccaggtccaagagttcttaaccaccatgttttcctgcccttgatgtatgaaatgagatgatgtagtcacatgccagcttgtctagggatgactcagaggtttagagatggatgtcacgtggatgttgtacaggagaggcaggtataagctgtagtaaagttaggaaaggcacagtgacgtggagcactgtgtgcagtggacggggtcatggctgggggtgagaatggtggaggaccttcgattatttcatcagcgttgtttctgtaaccaaagagctgcatgaccaaaccctgagatctagttccttaataggaacaattattcggcacgattccctttacttaaaagcaggggccgtcctaagggaggagttggaaagagtttgggggataaggtttgcttggttgccttctgtttaggctgatgttcagtgggggtcaaaggctgtgtgtccagtccctggcatgtggcgggtgtttgtggtacacagccagcctcaggatggcccccagggatgcacactgcctttgtgtgtggtcccctcccacactgaatcaggctggctctgtgcgaccagtgggaagtggtggaagtgagtgatgatgtgtgacttctcgggctaggtcgtaacaggcattgcactttggctctcgggaagccaactgccttgcgtgagggtgctcaggcagcctcgtggggaggggtgaggcccctggcccccagcatgtacagcttgccaccacgtgagtgagccagcttggaagcgaatttccccgccccggtcaagccttctggtgagtgcaactgcagatgacatctgacttccaccactcaagagaccccaggtcagtgctgcccagctgagctcttcccaggttctttatgtcccccgaaaatgagctgttttaagtttagaaaacttaaaaacacagtgacaatgaagcacagatatgcattacatacagtcccaaatcagtaatgacttcaagctgtgtcctctctttccaagaaagacaaagcagagaacaaagttcaacctacagtgtcttcccaaattcttgacccacgggatctgtgaatatcttatacgactgaattaagcctctaagttttggggtaactcatgcaacattaggtaactggaatagtgctcaataaatgtctgtcacatgaatgggcagtgaccatggatgcatttctagttgtgtattagttaaggctctcttggtttcaagtaacagaaatccaactccaactagcttgagcaaaatggggcattcctctggtcaagtaacggagaaatccaagagtctctggcttcatgcatagcgggacccagtctcaatttccacctcctggctctgcttcccttgatgccaactttcaggaatcagctttctgaaagaccactctgctagaaacagacaggcccatcctttcaaccaggtccaggactgtttgctcagtcactgctctcagaggcaggggcagaggcagatgccgggcacacatccacagaagtggagatggcaggaaactgagagtggagtgctggaaagctggcttttgcctatgggttccgcttctgacatcatccggcaatgtcaggctttacattgcccccatctgcagacccagcagaaggacagcttccatcccaccacatcaatatgccagtcctggggcgggggaaggacttatgggcaacctttgcagaatcactggggcctggccgcacatgagccatgcccacgctcatgtgacaggcggcccctgtgcctggggtgctgtattacccagaggaataagtgatcctgggtgggcaaaagcaacagaagagaagtcagctccacttccttccaaaacttgagaaggcctggtcaaaatcaccctccaggcccggtgtggtggctcatgcctgtaatcccagcactttgggaggttgagatgggcagatcatgaggtcaagagatcgagaccatcctggccaatatggtgaaaccccgtctctactaaaactacaaaaattagctaggtgtggtggtgggcgcctgtagtcccagccactcgataggctgacaggagaatcacttgatccagggagtcggaggttgcagtgagccgagatcgcaccattgcactctagcctggcgacagagtgagactaaaaaaaaaaaaaaagaaaaaagaaaaaaatcagcctccatttttggctttctctttcattagaaaaatgaacctgactttatgaccatgacaatgaaatgcctagagaagggagcactcattttccagtgggcctactgtgtgctggggtggcgagactcttcctgccctggaacttggtgaggtcaggagggaagatattatatgactgccttcctctgtactttttcagtgggggcaggtgtttatgcttgatgatgcaatggtgagatcttggttggaatatgaacttttctttctttttttttttttagatgggttcttgttctgttccccaggctggagtacaatggcaccatcacagctcactgcagccttgatctcccagggtcaagggatcatcgtgcctcagcctgctgagtagctgggactacaggagtgcaccaccacacctggctaatttttttaaaaaaaatctttgtagagatgagctctcactaggttgcccaggctggtcttgaactcctgagctcaagcaatcctcccaccttgggctccctaagtgttgggattacaggcaagagtcaccacgcccagccaggatcacagacgtttaaattacactccttctgctgtgccttacagcagtagaaggggtgaaatttaaacgtctgtgatcctggggttgttgaagatgccacccatctacatattctttcagatgcacaatatttcactgtgtgaatgaaacagcagcccttcttacgtgtgctttttggaatttgaagattttgtaagataagatgaatgcattggaacaagtgatcctcaattctgtgcagtctgtgcctccggagactggcggctgcccctccctgtctagtcttgcaagagaggcagctggcaagaggacagaagccggcagctgctgcgttttcatcctgtttctgctcttggagctgagggggagaggtggctagcagccacccagtgatcaaacttgcagcctgcctctcttgcttccttttcacagactggagtgtgcctgggtatggagaaagaacattttgcttcttgcctctcagagtttcaagaacgcctcacctgagtggcatgcattcatggaatgagtaattattacagtggagaactcctcactgtgaattaattacacagatgatattcaagacttagactgggctagtgcaggggttagcaaactatggcccactgttcttgttttataaataaagtgttatgagcacacagccatgcccattcatttgcagattatggctgcttttgcctgacagtgccagatgtaagtagttgtggcaaagaccaggtagcctaaaaagcctaaaatacttgctatctgggtctttacagaagacattttgttgttgttgttgttgtttttgagatggggtctttctctgtcacccaggctggagtgcagtggtgtgatctcagctcactgcaacctccgcctcttgggttcaaatgattatcgtgcctcagcctccctagtagctgggattataggcgcctgccaccaagcctggctaatttttgcatttttagtagaaacagggctttaccatgttggccaggctggtctcaaaccccgacctcagatgatctgcctgcctcagcctcccaaagtgctgggattacaggtgtgagccactgcgcctggcctagaaaatgttttctaacctgttgtctagtgggtgctttgtaaagtttagttttagggggagcatcattaattcattcaacaagtattaactgagcatctcccctgtgctgggtgctgcttggcatactgggggtttagtggtgtgagagagaccgagcctcagctcttaggagcacagtgctgatggaggacgaaaggtaaacacacacattagaagttgttggataatgccaggcgttacgaagaaaagaagcagaacaaggcaatgtgacagaggatgattggtatcatggaaggtctctctgaggaggcagcatctgagctgagacctgaggaggggaagggccagttatgcaaagatctgggggaagagctgcccaggcagaggggaccataattgcaaaggcccccaggaggaaatgagctccctgagtttcaggaatagcaaagaggccagggtggccagagtcaagtgattgagaggaagagatgagaacgatggcagggaccgggtcatgtgggtgccctggaaaggagtttagattttattctaatggcaacagaaggcattggagggtttaagtagggaaaggggagtgatctgatgtatgtttttaaacaattgcttctttaaattttgaggagattggattattgggaagcaagaatgaatttagggagagaagcaaagaggacgttgtgttggtttaggcaaaagacagcaatggcttggattggggtgatggaagtaacagtggcaggaagtggtgagcttggggctatgcttcagagatagagcagaaaggtcttgctgatgtatttaatacaggaggtgagggaagggaggaatcaacgataagtgaatcgtttgtttctagctgaaccactgaaatgtgtaggtaaattgagacttctgttttggccatcgtgagtttgagatgcttatcagacacccgagtctgcagcctgggtgagaaatcacggctggagatgagacgtggtgagctgggagtgtttttggatgacagatgaggccacgggattgaataataggtatccttatgaagactgagaaaaggagagggctgggggccaagccctgggacagtgcaaccttcagaggatgggcgaggagggccctgcccaagagacagagaggaagtggcccgtgaggtagggggaagtccaggagaggacagtgtggtgaatacctaatgctttactcattcactggtgaatgaatggatggatggatggatggatggatggatggatgaatgcatgaatattccttaataatatggttggccatggtccatccatatgactcctacggacaccatgttaccatttcacactcgtcttctatttaggagaaatcagacgaaactgccatcttatatataggtcaaaaatggtttccataaccacccacctcacatgcttactgaaattcattaagtaatagatggggtggggggcgggaggtttacaggtcggcaaaggaggcaaggctagagtgatccatgtggcagtggattagagtggcaggcatcagtatgaacacatgtttagctcaatatagatacagatggctacatagagaaatatttatggatatgtgcatatacacaaattagtaagacacacattactaatcctggctgtcagcgaagagagcctagaagcaaggataccccagtagcaacaaacctctggtgcccaggtctctgttctccaataaacaccattctccagtaaaaggaaccaggcttcttgaacaaatgtcgatcctaggaccgagggaggaaatagataagaagaacctgaagcatcttgtagggtcacagggtgaggaggcgctaaatgaaacaaaatgaaactgctgcagtgatggggcatctcagagggacacaggagccagtggaaaagctcccaggggtcaaagccagaacaatttgagccccaaaaaagtactattggattagaattcaaagaataaatacccatgattccatactgctataaatgatcagataagagagaagagacaaatctcccaggcagaagaattccagattatttatttatttttatttaattttttttttttacacagggtcttgctctgttgcccaggttggagtgcagtgatgtaatcttggcttactgcaacctccacctcccaggttcaagcgattcttgtgcctcagcctcccgagtagctgggatcacaggcatgcgctgccacactcggctaattttttgtatttttagtagaggcggggtttcaccatgttgaccaggttggtctcaaactcctgacctcaagtgatcaccctcctcggcctcccattcaagtgctgggatgacaggtgtgagccaccgtgcccggccccaggtaatttatatagctattccatcgtcaaggaggtggagcggacttcccacatcctaagtgtgggctgtgcatagtgactctcttccaaagagtacagtgtgaaaagagaggagagagtaactttacagtggagaacacggacagactacctcagccaggtgatcaaagtcaacttcaatagcggcaagtcatcttgagagaatgcgtgcctgatacagagtgctgagaatgattcttaagctctgtggtcctcctcctcaaaacacacacaagccaagactaaggatgagaagcatctgccaaatcccagttgaggaacattctacaaaatacctggccagcactcctcaaaatgctccatgtggtatcctggaacagaaaaaggacattaagcaaaaactaaggcaatcagaatcaactatggactttaggtggccaggcacggtggctcgcgcctgtaaccctagcactttgtgaggccgaggccggcggatgggttgagcccaggagttcaagaccagcctgggcgacatggcgaaaccccatctctacaaaaaatacaaaaaattagccaggcttgtggtgtgcacctgtagtcctagctactcgggaggctgagatgggaggatcacttgagtccgggaagtcaaggctgcaagtgacccgtgattgtgccactgtataccagcatgggcaatgagagtgagaccctgtctcaacaaacaaacaacaaacaaacaaacaaaaacaaattctctggggatggtagcaggcacctgtatttccagctacttgggaggctgagatggaggatcgcttgagccaggggaggtggagggttgaggctgccatgaactatgatcacaccaccacactccagcctaggtgacgagcaagaccctgtccccacccccctaaaaaaagtatggactttagttcataatgcatcaagctatggggtacatggaaactctctgtactgctttcaccatttttctaaaactgttctaaaataaaaaatttacttaaacatttatttaaaaaaaaaaacaaaccatttgagtaccaacagtgtcatatgctcaacttagcacatctttttcctggtttggtttgtgggcgtgaatgtgtactgagccatctaaaccttggttgcccgaccttcaccgtagccactgacccaggttaacagacaaaaggcccaggttaaggttatgcccagtggccataaaatagcccagcatccagactgcactccttgatgtacccaaaaaagccaaggaataggacggatgggcggggagtggggggcaaactactgcccattgcccaactctggccagctgtctgttttataaataaagttttattggaacacagtcacacccattcatttattatcatctatggctacatttgcatgacaatggcagtgttgagtagttgcaccagagatcgtgtggcccacaaaatatttattatctagcactttacagaaaaagcttgtcaacctccaggacagtggccacaagttctgccatcatctcatcccttagcaagaagggaaaggaatgcccattaaggcacaaattgttttctgttgttgtttgtttgtttgtttgtttttgagacggagtttcagtcttgtcgcccaggctggagtgcaatggcgtgatcttggctcactgcaacctccgcctcccaggttcaagcgattctcctgcctcaacctcccgagtagctaggattacaggcgccagccaccacatccagcaaatttttgtatttttagtagcgacggggtttcactatgttgaccaggctggtctcgaactcctgaccgcaggtgatccacctgctttggcctcccaaagcgctgggattacaggtgtgagccaccgtgcctggccacaaggtggtcttttaacaacagagcacacagctggacaaagcccaacgctctcttctttggggccgaggtgggtcattaatattgaacatttacaatgtacttgctccaggtgattcagtttaatttctgccgtctcttgtaacagggctcccacgtgcacgggttggggccgtgtgtctgcctctgctttctgaggccccacagcgtattgattctgcgaaacgtacgtttctttgaaaacagcgtctcttgacatgacaggagatcacacatcgcttgttttctgtccctttcattgccctctgaacatgataaaatcatgacctagtgtcaccgagggacctcagcatctcttggaaagaaggacttgccttcttttttatctttgtcaagccagtgaggccaagtagaaaatttttagcagctttggagccagacagatcggagtgcgagttctgcccgttattgactggaccgtgtgaccctgggagagccgcctagtgtctatgagacggaggctgttgggcaagaaaatggggatggtcccagcattatggggcggttgtgagaattcagtgcaatgatgcagtgctcccagaacagctggtctagggcttggctcatgggactgtcccttcgcagaggcagcgtggacattccgctggtatccactggtgtggctgtgcctgtttggtcaccgtgtctgttctgattggtcggtgctcctgcatgtcaagagttcaatgttatgaaaatcatccctgcctagagatgaattcccccttcccctgaggtctagactggtatagctgcttttggagcctcacctgctgagagctcacagctgtccttctctagagaatcaccctcagatgggagccacattgcctgggatgggatgccatgcccagtaatggcccagtgactaactgatacagcaacgtgaatggctggtccctgccccacggtggggacgatcctgtggcgtgctctctgctgctcgtgggataggtcaaggcgggactttaagggaccacattctcactctgctctgtccccttctgcatcctgtagtcctcacctcccttctcctgaaagcccctttcaaaacaaaaacaaaaaccacatccacccaagtccctgtctccagctctgcctccaggaaagccggcggaaggccgccagtctcagctgtgacagatacagatatttctgcatttccaggactgaggtcaatccctggggacccagtgaggcggtatctgaagggccatggagctggcttgatggggtctacaggtaggcagggacctggtggggatgtgactcaaggatttttatcaaatatctttatcccctgacagatgcaaaaaaaaaaaaatgagatcagactccagggtttcctccatgccacactgtggccccattgtttgttgtgctatcagcagaagttgattttgcaaggaatgtacacgtgtatgtgatgtttgaatgcacctatctgtgtgtgcgtgcatttgtgtgtgtgtgtgtgcattcgcttgtgtgtgtgtgtgtgtgtgtgtgtgtgtgtgtgtgtgtgtgtgtgtgctgaggatgtgagccccacttccggcccagtgcccctgcccaggctggctctgccctcctgctgctctgggcccctcaggcagtgactacctggtacatagggaaggcatcagcatcccttattcatggggactgtatactgtctccaccatattgggccttttggcctcttggacatgacttggcctctgctggctttaagggactgccagagatgccatcttctctgggaaatgttctcagcctgggcacagcccactaaccactgcctgcttgtctgagacttctctgtccaggaaaacagcccagcctgaccagagatgggcatagagccatattttgggaaagactggttgggggtcaacttggtttctggaaccagttctgatttcagttgcaggggacagtgagccagttactgcccactggctgcatcctaagccttcctagaggagagctagcctcctcctagggttgcccaggctggaccacttctgcctgggtgatgggttgggagaaagacgttaatatttggagcagtgttatattagtcagccctcccatttgcaaacattagaaaaccagctcaaattagtgataaaagaaaatctcagctgaattaaatttaaagtagtttaattgagcaatgaatgattcgcgaattgggcagaccccagaatcacagcagattcatagagactccagcgcagccacgtggtggaagaagatttatggacaaaagaagggaaatgatgtacagaaatcagaagtgaagtacagaatggctggattgttacaagttggcgtttgccttatttgagtacagtttgaacactcagcagcgtatgagcggttgaactacggcctctgggattggccaagactcagctattgttacaggcgcatactcctaagttaggttttcaatcttgtctacctattaagctaggttgcaatttgtccacaaggactcaactatagaagtacgaagtcccactcaggccatatttagttcactttaacactagcttcggcaactgtctctcagagcccagggcagggcagggatgcaactgggcttcaggaaacttgaattcattgactgtctcttccccatcttagatgcagtgctaagggctttttagtaattttctcatttgactctcaaaacaaactgatgaggaaacggtctgagagtagttaggcagcttttcaaggtcacacagatagtaaatgtcatcactgggacttgaactcaggtctttctgactctcatgtctgtgcaacatgtcatctcagccactgttgacactgtatatgtggattagggttggctaaactgctgtaacaaatagacccaactcgaatggtgcatgtatgtacaataggggtttatttcttatgatatagttcacggtggtcccaggtgaataaggatgggtaggtctgcatttttcataatcatctggatttctgctcaggctcctagagtctctgccaccttccccatgtggcttccaaggccaccttggagacagagcttggtggagcacatgtggtaggattttttttgtttttttgagacggagtctcactgtattgcccagtctggagtgcagtggtgcaatctcggctcactgcaacctctgcctcccaggttcaagctattctcctgtctcagcctccctagtagctgggactacaggcacctgccaccacgcctggctaatttttgtatttttagtagaaatgggatttcaccttgttggtcaggttggtctcaaactcctgacctcaggtgatccacccacctcggcctcccaaagtgctgggattacaggcatgagccaccactcccagccagttctttttttcttttttccattttttttttttcgagacagggtcttactctgttgcccaggctggagtgcagtggcacaatcacggctcagcgcagccactgcctcctgggctcacacgctcctccggcctcagcctctcgagtacctgggactacaagtgtgagccagtttggctaattttggctaatttttgtagaaacggggtctcgccatgttggccaggctggtctccaactcctgggctcaagggatccaccttcctccccctctcaaagttctgggattaccggagtgacccactgtgccctgctggcaaatttcttaaactgtgcctcagtgacctcatttaataaagggaataattgtagcacactttttctagagctgtgaagattcaatggaataaataaggcaataaatgaatggatggggaatgaaggatgtgggtttcctccctcttgtctttcaataagctctcaccatcaacctcccattgcctgttctctctcttccccctctctccctctgtctctctcttagccaggaaacctggggtagggaggcttggagccagcgggtgcgtcgggaggctgcgggtactgactggggacgcgcacggagattgcgggagaaggatccacgccgcgggagaaggatccatgccgcgggagaaggatcagagtggagcctgtggctgctgcaggaggaggaagccgccgcctggcccacaccacaggagaagggcggagccagatggcaccctgcccaccgcttcccgcccacgcactttagcctgcagaggggcggagcgtgaaaaatacctcgtgcgcctcggccgactctacagtgcgacgggcggagcttccagacgctccgccccacgtcgcatgcgccccgggaaagcgtggggcggagcttccggaggccccgccctgctgccgaccctgtggagcggagggtgaagcctccggatgccagtccctcatcgctggcccggtcgcgctgtggcgaagggggcggagcctgcacccgccccgccccccctcgccccgtccgccctgcgccgcgcggggaggaggaggaggagccgcggcggggcccgcactgcagcgccaacgtccgagcgggcggccgagctcccggagcggcctggccccgagccccgagcgggcgtcgctcagcagcaggtcgcggccgcagccccatccagccccgcgcccgccatgccgtccgccggccccgcctgagccgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccttgcgagcccccctgcctctgcggcctagcgcccggcgccgcctgccgcgtcaactgctcgggccgcgggccgcgggctgcggacgctcggtcccgcgctgcgcatccccgcggacgccacagcgctgtgagtagcgggcccagcggcacccgggagaggccgcgggacgggcgggcgtgggcgcgttccctggcccgggacgggaagcaggacgcgggccaggacgctcccagggcgaggctccggcgcggcacagcggccctgctaaataaggaacgcctggagccgcggttggcacggccccggggagccgaaaaaccccgggtctggagacagacgtccccacccgggggctctgcggacgccagcgggggcggggcgcggaggccgcgctcagctgggaggacaaacagtcgctaattggagaggaattgggattcggcctggggctgcggggtacccggagagatggggatggctgtagggggctgcagggaagagttccaggaggtgtctggacaaggatttgatggatgtgcaagaattgggctgatgcttaggaaggggcgatgaggtgggtccagaagaaggggggtgaacggtgtgagcaaagaccgtgaggctggaggctggccacgggaggtgtgaggggtaggggcagggtgggaggtgggctcgcgggtgggctggggtcatgaagggcctcaggcgctctgctattgggttccaaggctatcctgagaacaggggtgagggcggattgccgtggggggttaaagccttgtcatgttcgctttcgggagataaaaacaacaggtggcctttatggagacgctgcccagagccaggtctgtgccaggctcctgttgggggtcgtcatgcggaatcctgactctgaccatccgaggcatagggaccgtggagatttgcatttcacagatgaggaaacaggtttggagaggtgacacgacctgtcccaggcatcacagccaggacaggacctgtcccaggcatcacagccgggatgtgcatagcaggggtttggaactatgaggtgcccaggacccagggttggattgaaaagggcgcaggggactaagataagcagacagttgtccccagcgctggggagagtcttgggaccagtctgatgccttgtatttcccaggctccaggctcctcgccgggacagtgtctctttgggtgcgtgctggatccctgggggacgtggcacatccccaggctttctaaacattgggtgggttctggcatttggttttgtaacgtttctgggtcactcccgcctgtggccacccttccttaggggagccgtgtgtccttggggctttgctgggtggtctcgagggtgggagaagaatgggttctcctggaccaatggagcccgtgcccctcggggccacattgctcctgcgctccctgactgcggacgcgtgtgtctcgcggctgtctctgtggagatggcctcctcctgcctggcaacagcacccacagaattgcatcagacctaccccacccgttgtttgtgatgctgtagctgagggctcctctgtctgccaggccggtcactggggactctgtccaggtcctggtggttcctgcttcccagcacctgatggtgtccatgagagcagcccctcgggagctgtccgggagagaagggcgctggtggctgctgagcggagagcaaggcccgtgttctccaggcccttggcacagcagtggaacccccgcccctgccttgtgttgtcctcttaggctctggtcctggggtttggaggagggggaccctgggggttggtggcctgtcccagcctgagctggcaagattccgaatgccaggcccctcaagtgtgcaacagggcacagggtgacctcgtgggcaggtgggtgctgttctgtacacacctggggccgccgctgggagagttctggaaggtggggtgaggggacccatgggaaactagggccctaggaaggatgtgaaggccctggctggccccccaggccaccctctgtgctgtggggcagcccagccattttgctgtctaccctgcaaactcctcctcggggagacggctgggttttccccagggaagaggggtcaagctgggagaggtgaaggacacagatcacagctgctggcaggtgttcaagggtccaggagcgttgctgtctgggtgtcaccagtagccttcctggggggctcacgcaggtgcctctccacttgtggctccctggctgctgaagctcagcagggacagctgtgtccagttccaggtggaggacagccggggcttctgaggccacagcctgccttgggttaaggatgctgccgagaggtggtggcttttggaaaagatggcgtactgcaaaacgtgctgctctgcatggctcgaagcttcgtggggagacgtgggcagagccgtggctgactcacagaccccccaccccagagcctgccctgccctccctgccccgacccttcccctcctgacccatgtgttttttgtttttttttttgagacagagttcactcttgttgccaaggctggagtgcaatggcacgatctcggctcatggcaacctccgcctcctgggttcaagcgcttttcctgcctcagcctcccgagtagctgggattacaggcgtgcaccaccatgcctggctaattttgtatttttagtagagacagggtttctccatattggtcaggctggtcttgaactcctgacctcagatgatccgcccgcctcggcctcccaaagtgctgggattacaggcatgagccaccacgcccagccctgacccatgttttgaaccaaattccagccacccttttatctgcaagcattttggagggcatcgcaataccgcagacccacctaacacaacagacaattccttcatgccaccgaaggcctggtgtgttcacatttttggtttaatagtttgaattaagagccaaataaggtccacacactgcaattagttgatgtcttttttttttttttttttttttttttttgagacggagtcttgctcttgtctccaggccgcagtgcagtggcatgatctcagctcgccgcaacctccgactccctggttcaagtgattctcctgcctcagcctcccgagtacctggtagctgggtttacaggcatgcaccaccgtgcccagctaatttttgtatttttagtagagacggggttttaccgtgttggccaggatggtctcgatctcctgacctcgtgatctgcccacctcggcctcccaaagtgctgggattacaggcgtgagccaccgcacccggccaatgtcttttaaaaatatatacttttttttttttttttttgagacagagtttcgctcttgttgcccaggctggagtgcagtggcgcgatctcagctcacggcaacctccgcctcccgggttcaagcgattctcctgcctcagcctctccagtagctgggattacaggcgtgtgccaccatgcctggctaattttgtatttttaggagagacggggtttctccacgttggtcaggctggtctcaaactcctgacctcaagtgatccgcctgccttggcctcccaaagtgttgggattacaggtgtgagccagcgcgcccagacaaaaatgtatatgtgtgtctttaaggctggtcaagcaaagcagtggaactggagaaagaatgaagaattctacctggctgtgatcaattcgttgtgaacaccactgtgcttggaccagctagctgatgtcttttgttttgttttgtttgagacggagtctggctctgtcacccaggctggaggacaatggtgtgatctcggctcactgcagcctccacctcccgggttcaagcgattctcctgcctcagcctcctgagtagctgggattacaggcgcgcgccaccacgcccagctaatttttaaaaatatttttagtagagatggggtttcaccatgttggtcaggctggtcttgaactcttggccttaggtgatctgcttgcctcggcctcccgaagtgctgggattacaggtgtgagtgatgtcttttatttatttatttatttattttttattattatttgagatggagtctcactctgttgcccaggctggagtgcagcagtgccatctcggctcactgcaagctccgcctcctgggttcacaccattctcctgcctcagcctcccgagtagcctggactggtgcccgccaccacgcccagctaatttttgcatttttagtagagacggggtttcaccctgttggccaggatggtcttgatctcttgatctcatgatccacccaccttggcctcccaaagtgctgggattacaggagtgagccaccgtgcccagccatctttcttttcttgctttctctttcttttctttcgagaccgggtcttgctctgtcgcccaggctggactgcagtggcacaatcatagctcactgcagcctcgacctccctggctcaagcgatccttcctcctcagccccccgagtagttggaactacagctccacaccaccatgcctggctgattctttttttccttgtagagatggggtcttgctatgctgtccatcctggtctcaaactcctggccttcccaaagcactgggattacaggcataagccaccacagccagtttccttttcttctttttaactggaatagttgactttttctttattagctgtgtgtcaggagggtatttttggcctttagtatgtcgtctaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcaccccagctggagtacagtgatgcgatctcagctccctgtagccttgacctctctgggctcaagtgatttttctctcctctacctcccgagtacttgggaccccaggcgcatgccgccatgcctggctaatgtgtatttttttgtagatacggggtctcactgtgttgcccagggtggtttcaaaatcctgggctcaggcgatccttccgtctcagctcccacggtgctgtgttaccggcgtgtgccccagtgcctggccgtcttggaggtcttgtttctctgggtttatgcctcaaggtggcgcctgctccgctgtgctccctggtagcctggtagtgagcctgcttctcacacagtcatacctggttgtggtcccacagtgggaccaccctgttgggttcagaacaggagatgggggcccctcgagtctgtgtgggggctgtagacagggttgggagaccttggctctgtgggggactgtggacaggggatggggggccttggccctgcgtgggatgggttgggggtccgtgcccttcctggccctgggtggacaggtccaggtggcactcggcatagggctgagatgggtgcagagggctgaggcccccaggcctctcccggcttggtttccccagatgagtgttcatttgggtcttccatcagaaaggcccctcctgacctctgggagtggggagctcaagggtgggaggccatagcttggggatgctggaaatgtgtgggatgggcccagggatggcctctggcctactaagggctctggccctgacccacggccactcactcctcagagacgtctcccacaacctgctccgggcgctggacgttgggctcctggcgaacctctcggcgctggcagagctgtgagtgtcccccagtcgtgccagcatgcggggctcactccgggtgggctggcggcaccgcctcttgctgctcagctgtgggggcttccgtcagctttgccgaatcccccctctcttccagggatataagcaacaacaagatttctacgttagaagaaggaatatttgctaatttatttaatttaagtgaaatgtaagttgtggttctttgggtggggtcctggctggaccccaggcccccagtatcccttctgccctcccagttggtccgtgtccccttccaggcttgagaccagatcctgggggcagttcactacctgcttggagccccccagtgccggcttggttggggcaggggaggcggtgctgtcagggtggctccagggcctggttgccagtggggggctggcatagacccttcccaccagacctggtccccaacacctgcccctgccccgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggcagctctgtccttcccagccaggtgggacctgggccctgcagacactgggcagggctcaggaaggcctctctggggggggcctccgggccaagggaacagcatgggagcctgtgagtgcggcgggcggatgggggggtgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctccgagcagggctggtgcctgtgtgggtcagcccagccctccagtgcctccttcgcctgcctgtccctctgctccggccccccgccgcctcctgcccccacctgtaggggccccaccctcctccagcacgtcttccctgcctccccaggggcccccctggtggggccccacggacccctggcctccggccagctagcagccttccacatcgctgccccgctccctgtcactgccacacgctgggacttcggagacggctcccccgaggtggatgccgctgggccggctgcctcgcatcgctatgtgctgcctgggcgctatcacgtgacggccgtgctggccctggggaccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaatgggcactgctaccgcctggtggtggagaaggcggcctggctgcaggcgcaggagcagtgtcgggcctgggccggggccaccctggcaatggtggacagtcccgccgtgcagcgcttcctggtctcccgggtcaccaggtgcctgccccaccccccgaggggccataggttgggagatctctgaagcagtggggcagagcctgcggctggggagtctcaggaggagggaggtgggagctgggccggccctggtgagcaggtggcgccggccggtggggccgttcctgtcagctctgcagatgcagaggtggacgcgagctgggggcagcctccggacactcctgggcacgccatacgggaggtggcctgcacggggatccctgccggtgcccacaggccccgtgggtgggtgctgctgtgagcctgggctggtgggccctgttctccgggctctgagcctcagtttccccatctggaaagggggacagtgacggggctcccagcgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcggcctggaggtgtgcgaggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgtagggacccctgatgcctctggcacggcaggacggcctctcagccccgcacgagcccgtggaggtagtcggccccccacgttctataacctgccctcctgcctgcccctggaggcctcgcctgccctgcccactgtgggtctcgccaaaaaacttgggggccttaatgttgcttgtgcccagtgaagatggttgggaaaatccagagtgcagagaggaaagcgtttactcacattacccccaggccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgcgaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccatgggcgaatcagggccccaacaccctcccctcctcgcagggaccccggagaacggcagcgagcctgagagcaggtccccggacaacaggacccagctggtccccgcgtgcatgccagggggacgctggtgccctggagccaacatctgcttgccgctggacgcctcctgccacccccaggcctgcgccaatggctgcacgtcagggccagggctactcgggtccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcctttgcccctctcccagtgggagaagctctcgcctgggcccttggcacgagctgtgcctcctcttcctctctcccagcacagccgctccttcctgtctgtcaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggctcgctggcctgggggcagtgtcagcgcccgctttgagaatgcctgccctgccctggtggccaccttcgtgcccagctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcggcagcccagttactggggacgtcggccccgggcaggtcctgctggctggctcctcaggctacctggtgggctttaaattcctggaaagtcacggctctgacagcggctccgctaactcattccaccgtctcatttcacgaaatgaatttaaaactccgctccctgacctcacacgagtccccgtgagtctctcacgccctctgctgtgttctcgcctggctaaagcaagtggcttttgaggtggagtccgaacccctgatgggaaactgcgggctgcccgcagtgccaccatgctgggtacatgggggacagggctgttccatcttgcgggtacctgccccttcaccaggggccttgggaggggccatcagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctctcatggcatgcagagccccgggcacctcctctcctctgtgccccgcgtgggactctccagcccgacgggaggtgtgtccaggaggcgacaggctaagggcagagtcctccacagagcccaggctgacaccagtccccccgcagaggtacagccccgtggtggaggccggctcggacatggtcttccggtggaccatcaacgacaagcagtccctgaccttccagaacgtggtcttcaatgtcatttatcagagcgcggcggtcttcaagctctcagtaggtgggcgggagtggggaggggaggggatggggcggggcgggggcgggctccaccttcacctctgccttctgctctgcttcatgctgcccgaggacgctgccatggctgtggtgagtggagggagggacgccaagcagggcaggcctctcacctgccacctgggcccactgatgcctgtccctgcagctgacggcctccaaccacgtgagcaacgtcaccgtgaactacaacatcaccgtggagcggatgaacaggatgcagggcctgcgggtctctacagtgccagccgtgctgtcccccaatgccacgctggcactgacggcgggcgtgctggtggactcggccgtggaggtggccttcctgtgagtgactcaggggccggtttggggtgggcaccaggctcttgtccgggcaccaggctcttgtcccggctccagcctcagccgagggaccccacatcagggggttgcttttctgagcctcggtttccctgtctgttgggaggtactgggtgcacaggagccctgaggctgcacgggagccgggagaggcctcagcacagccgggtgggccctgaatggaggcccggggcgtgactgcagagtggagcctcggctgggtcccaagcaccccctgccccgccaccgcgcacctgtgccccgccactgcgcacccctgtcccggttcactcactgcctcccaccgccccggcaggtggacctttggggatggggagcaggccctccaccagttccagcctccgtacaacgagtccttcccggttccagacccctcggtggcccaggtgctggtggagcacaatgtcacccacacctacgctgccccaggtgagggatgagggggtgagggggccactgcctttcaggctctgagcacggggcccccccagtcccccagtcaagctgccccgcttcctccccaacagccctcactgtgacctcacctgggctgatggcttaggcccctactggggtgagggaggggccaggcgtgggaggagtggacagggaagctgggccccctgaactgccccccaccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggtgcagccgttcaccccgggctcctcaggcggggggcttctgccgagcgggtggggagcaggtgggggtgccgcggctgccccacttgggcctgtccccacaggtgagtacgtcctgaccttgctggcatctaatgccttcgagaaccggacgcagcaggtgcctgtgagcgtgtgcgcctccctgccctctgtgagcgtgtgcgcctccctgactggggcctgctggtaccccagagtgggtgtctgttccccagtccctgctttcctcagctggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccacacatacgtctgttcccacacgcatccccccaggggccctcagtgagcattgcctgcctcctgccagggtccagctgggtccagtacaccagaacgcacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgctgcctcttcccactgggcgctgtgcacgctctcaccaccaaggtgcacttcgaatgcatgggtgagtgcaggcctgcgtagggggagcagcgggatcccccgactctgtgaggtcacggagccctcctgtgatgccgtggggaccgtccctcaggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccaggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctctccccgccccgcatgcctgccagggtactgggttcagccccccagggcagacgggcagcttggccgaggagctgagcctccagcctgggctccttcctgccatggcgttcctcggtctctgacctgcttcagtagcctcagccattctgctgtcctgtgtgaacgcagggtgcctctcgggggacccagggtgtaaagaggggcccagatgtggggagggactaagaagatgctgctctgtgccctccactctcccctcccctcccccttccctcccctagcccctcccctccccttccctcccctaacccctcccctcccccttccctcccctagtccctcccccctcccctagcccctgcctcctcccccagcccctcccctcccctagcccttcccctcctcccctcccctagaccttcccctcacctcatcccgctgagcccctccactcctcccccagcccctccatcccctcacccctcccctcctccttcctcccctccctctcctctcccccttctctctccttccctctcctctccccccttttctccacttccctctcctctctcccttctgccctcctccttctctcatgtgaagaggtgccttgtgtggtcagtgggctgcatcacgtgttccccaggtggaggccctgggtcatgcagagccacaaaaaatgcttagtgaggaggctgtgggggtccagtcaagtgggctctccagctgcagggctgggggtgggagccaggtgaggacccgtgtagagaggagggcgtgtgcaaggagtggggccaggagcggggctggacactgctggctccacacaggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggtgccgcggcccgtgccccacgccacccgcccgccccacgtggcccgtccgccccatgccgccctttcctctgcctccctcctccccacaaccgcctcgcctttgccccatcccatcttcgtccccctcccctccccccaattcccatcctcatccccctcccccaattcccatcctcatcccgctcccccaattcccatccttatccccctcccccaattcccatccttatccccctcccccaattcccattctcctccccctcccccttccctattaccatcccttttctccatctctctccccttttctccatttcccccccgatcctccccgtccttttgtccattcccctcatctttcttatcccccttatcctccttcccctcccttatcccccttcccctcccttatcccccttatccccttcccctccctttcaccctgctcctcttcttctcccctttctcttttctctacccttttccttcctttttcctccctctccccatcatccccctcatcttcgtcctcatccccatccccttccccctccccctccaccactctctctccagcttccctcttccttctgcctgcacctcgctctctgccccctcaggttccccctttctcccagtccccaccctccggctccccctttttgcctgcccccaccctccctctgcctccctgtctctgcactgacctcacgcctgtctgcaggagacctcatccacctggccagctcagacgtgcgggcaccacagcgctcagagctgggagccgagtcaccatcgcggatggtggcgtcccaggcctacaacctgacctctgccctcacgcccatcgtcacgcgctcccgcgtgctcaacgaggagcccctgacgctggcgggtgaggagatcgtggcccagggcaagcgctcggacccgcggagcctgctgtgctatggcggcgccccagggcctggctgccacttctccatcccctaggctttcagcagggccccggccaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgcctcaccgtgaaggtgcccaacaactcggactgggctgcccggggccaccgcagctccgccaactccgttgtggtccagccccaggcctccgtcggtgctgtggtcaccctggacagcagcaaccctgcggccgtgctgcatctgcagctcaactatacgctgctggacggtgcatgcagcggttggggcacacgcggccccctggccttgttcttggggggaaggcgtttctcgtagggcttccatgggtgtctctggtgaaatttgctttctgtttcatgggctgctgggggcctggccggagaggagctgggggccacggagaagcaggtgccagctctggtgcagaggctcctatggcctttcaggcccatggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgcgggccggcctggcagggcagggcagggcatcatgggtcagcattgcccgggttacgggccccgtggggacggcaggcagcgaggggactggaccgggtatgggctctgggactccgacatccaacctggcggagcctgggctcacgtccactgccccttcccttcccaggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcatgcccccaagccatgtacgctttgtgtttcctgtgagtgaccctgtgctcctgggagcctctgcagagtcgaggagggcctgggtgggctcggctctatcctgagaaggcacagcttgcacgtgacctcctgggcctggcggctgtgtcttcacaggagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctacacagtagcgtagccccacaagttacgtgagcatcgctaccactgtgggagaccatgcatccacccgcgatcctgactgcatagctcgtctctcagacggaggcgccagcaccctccccgtggctgtttcttcaatacctccattttcctttctttggaattgcccttctggcattccctttttgttttcgtttttctttttttggagacggagtctcgctctgttgcccaggctggagtgcaatggcgtgatcttggctcacagcaacttccagctcctgggtttaagcgattccccttaagcgattctcctgagtagctgggagtacaggtgcacaccaccacacccagttaatttttcaccatgtcagccaggcgaactcctgacctcaggtgatccgcctgcctcggcctgccagagtgctgggatgacaggtgtgagccaccacacctggccgtgttcccattttttatttccatgctgctttcatcttcatttcccagttctttcttttgattacctacttttaaaaactgtcggccgggtgcggtggctcacacctgtaatccgagcactttgggaggctgaggcaggctaatcacggggtcaggagatcgagaccatcctggctaacggtgaaaccctgtctctactaaaaaatacaaaaaaattaggccggcgtggtggcaggcgcctgtagtcccagctcctcgggagactgaggcaggagaatggcgtgaacccgggaggcggagcttgcagtgagctgagattgcgccactgcactccagcctgggtgacacagcaagactccatctcaaaaaaaaaaaaaaaaaaaaatactgtcacctgggtctgtcactgggagaggaggtgacacagcttcacgcttcgcagtctgtgcatgaactgagggacgggtgtgtggtgcaggtcaccggttgtggcgtgactgaggtgtggacaggtgtgcagtgcgggtcactggttgtggtgtggactgaggcgtgtgcagccatgtttgcatgttacaagttacagttctttccatgtaacttaatcatgtccttgaggtcctgctgtttattggacaaattgcagtaaccgcagctcctcgtgtatagcagagctgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagcggccaccggcacctggacggcgacagagccttccaccgcaacagtctggacatcttccagatcgccaccccgcacagcctgggtagcatgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcggagctgtttcactcgcatccagagggccacctgctgcgttctcctcatctgtctcttcctgggcgccaacgccgtgtggtacggggctgttggagactctgcctacaggtgggtgccgtaggggtcgggacagcctcttcctgcccagcccttcctgcccctcagcctcacctgtgtggcctcctctcctccacacagcacggggcgtgtgtccaggctgaacccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcatgcctgtaatcccaacactttgggaggccgaggcgggcagatcagttgaggtcaggagttcgagaccagcctggccaacacaatgaaaccccatctctactacaaatacaaaaacagctgggcatggtggcgggcgcctgtagtcccagctactcgagaggctgaggcaggagaatggcatgaacccaggaggcggagcttgcagtgagccgagattgcgccactgcactccatcctgggcaacggagcaagactccgtctccaaaaaaaaaaaaaaaaaaaatcccacaaagaaaagcccaggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccagcaggggttgctcccgagtccgtggcaggaaccagaggccacatgtggctgctcgtatttaagttaattaaaatggaacgatggccgggtgtggtggctcacacctgtaatcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactaaagaggctgagccaggacggacaatcgcctgaacgcgggaggtggaggttgcagtgagctgagattgcgccagtgcactccagcctgggtgacagagcgagactccatctaaaaaaaaaaaaaatgaaatttaaaactctgttccttagctgcaccagtctgctgtcaaccgttcagtggcacatgtcgcgaggggctgccatcacggacggtgcagatgtcccatatatctagcattctagaacattctgtcagatggcaccgggctctgtcctgtctgctgaggaggtggcttctcatccctgtcctgagcaggtctgagctgctgcccgctgaccactgcccttgtcctgcaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggtgggttccctagagaaacctcgagccctggtgcaggtcactgtgtctggagtaccgggggtgtgcgggctgcgtgtccttgctgggtgtctgtggctccatgtggtcacaccacctgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttggccggacctgctcagtgacccgtccattgtgggtagcaatctgcggcacgacccccacttactgggtctctccttttacaaccaacacaaccgaaatctagggcttcttctttttttttttttttttttgagacagagtctcattccattctgtcacccaggctggagtgcaatggtacgatctcggctcactgcaacctccgcctcccaggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacagacgtgagccaccatgcccagccaaatctagggctggaacatggctgcagcatataaatagaattgaattccatagttttgttaaccctgttttttgtttgtttgtagttgttgctgtttttgagacagagtctcgctctgtcgcctaggctggagtgcagtggtgcaatctcggctcactgcagactctgcctcccgggttcaaactgttctcctgcctcagcctcccaagtaggtgggactacaggcgcccaccaccacacccggctaatttttgtattttattagagacagggtttcaccatattggccaggctggtctggaactcctgaccttgtgatccgcccacctcggcctcccaaagtgctgggattacaggcgtgagccaccacccccagcccctgttttgtttttgttttgcttgcttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagtttgggcacactctgtgtgatcgggcagaaggcctgtgggaagtttagctgaggacagggccaggaaaggtgatggacagtgggggtctgtcctggtcaccaggcccctgggtcctgcccacctgcttggagctccccacccatcacacatgatgctgccaagccctctgggtattgtgggcaaataccttaggagagaagctgatgaactttgtttcttgaaatgcacagattccttggacgtccctgagagctcagtcatgaaagtcagcttggttttctccccctcatttgggttcagaatttaaagtccacacacacgggcagtaagatgatatagataaggacatcatcactcggtttcggatgttaaaatgtctaggtgggttaggggtgatttgagatcacacaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggtttgtgaaggttccagagaggacctggccttgggaggagcgtgggggactgagaagggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctcctaattgctcctaagcctcacgctcccttgccccgcctgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccttcccctccccctcccctccccctccccaactcagatcgggcccggtccccgtccccttccctcccccctgccctaagccacctccacctctgtcctggctgcctcagggcgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggctgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggccccgctgcactcttgtctctaacaaacaaaacggaccaaaacaaagtgaaatgtcatttgatttgtgtcatctggtttgatgacttttttttttttttttaagacagagtctcattctgtcgcccaggctggagtgcagtggcaagatctcggctcactgcaacctccgcttccggggttcaagcaattgtcctgcctcagcctcctgagcagctcagattacaacgcctggctaatttttgtatttttagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttatttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtccggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcatagcttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaattttttttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtattttttttttttttacttatgctgagctttaaatgacaaagattcatataatccaagagagaagtattatttagagggattcttttaccatgtgatatataataaatgcatccaatgttatacatcaatttaaaaaacaagtaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatgacaaaaccccatctccacaaaaaatacaaaaatttgctgagtgcactgtcaggcacctgtactcccagctactcaggaggctgaggcaggagaatcacttgaacctgagaggcagaggttgcagtgagccgagagcacaccactgcactccagcctgggtgacagagtgagaccccatctcaaaaacaaacaacaaacaaaaacaaaaaaaatggcctggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagaggggcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggaatgagatcagtatgtcaaaagtctatacttggtaagaatttggctgctaagttgtgccataatttgtcttttgagccttttatcctttgcgtaagttgagctctacattttgtcttgccattcatgacaataaaaatgtggttgtgtgggggctgaacctccttctgaacaatgatccaagataaaagtactaaaccacaatgcttttttatattcaagggaagaggaagtatgtttcagttttaccgcctagataattacacgtcatttggcactgcctttcaagatatgtagaaaacagaaaatatatgagttatgaagatatctaggcacatttaacattctctatgccacttagtcctgaacagagaattttcggtataaattggaggaagcttttttttttttcttttctcacccccaagaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagtgtgagtcaccacgtgagccaggggaagtttttaaatttaccactttttaacaattccatttaggaaagttcagttgagctgttggacttggacaactttgcacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttaatcctatgtgcagaaatcaggaaaaaacaagttctacaaagaatttgaaagatattatttcaggccaggtgtggtggctcatgcctgtaatcccagcactttgggaggctgaggcaggtggatcacttgaggtcaggagttcaagaccagatgggccaacatagtgaaaccccatctctactaaaaagacaaaaattagccaggcatggtagcaggcacctgtaatcccagctacttgggaggccgaggcacaagaatcgcttgaatctgggaggtggaggttgccgtgagccaaggtagtgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcgttaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattaattacttccttttcaagttgtgaaacatgttaacctgtggtaaaatacttacaagatgataattaccatctaaccgtgttgaagtgtacagttcagttgtgtgaagtatattcatgtcattttttttttttttttttgagacggagtctcactctgtcaccaggctggagtgcagtggtgggatcttggctcactgcaacctctgcctcttgggttcaagcagttctcctgcctcagcctcccgagtagctgggactacaggcgtgcgccaccatgctcagctaatttttgtatttttagtagagacggggtttcaccatgttgcccaggatggtctccatctcttgaccttgtgattcacccgcctcggcctcccaaagtgctgggattacaggcgtgagctaccgcacctggcctatatatttttttttttttttttgagacagagtttgaattttgttgcccatgttggagtgcaatggcacaatctcagctcaacacaaccttttcctgctgggttcaagtgattctcctgcctcagcctcccgactagctgggattacaggcatgcaccaccatgcctggctaattttgtatttttagcagagacagcgtttctccatgttggtgaggctggtctcaaactcccgacctcaggttatccgcctgcctcggcctcccaaagtgctgggattacaggagtgagccaccatgccagcctcatgtcattcttgtgtgttgtgtgtgtgtgtgtgtgtgtgtgtgtgacagagtctcattctgtcactcaggctggagtgcagtggtgtgatctcggctcactgcaacctccacctcccagcttcaaacggttctctgcctcagcctcccgagtagctcggattacaggcgcccactgccatgcccggctaatttttgtatttttagtagagatggggtttcaccatcttggccaggctggtcttgaactcctgaccccgtgatccaccctgcctcggcctcccaaagtactgggattatacgcatgagccaccgtgcccagccgtcattcttatattattatttcctaggtgtctttcctgaagactatcttcccgtctcaaaatggacatgatggatccacggatgtacagcagagagccaggaggtccaactgccgtagacaggaaggtatggctctgttggagtccccatagtgtggaaatgagtttgccctggaaagggaaagaacagcttcttgccctcaggtttctcaccttctcctctcctcactctcaccaagggctgaggtccgtttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttctacaatatttgtggcaaattcagtgggttcaaaattgagcttgtcctttctgcttcattagtttaagctgtataattcctttcccttcctacattcttgtttgtcattttttcaggggaagaggagttgctagtactggcattggttttcctttctctctctctttttttttttttttcctgaaatggagctttgctcttgttgcccaggccgtagtgcaatggcacaatctcagctcactgccttttgggttcaagcaattctcctgcctcagcctcccaagtagctgggattacaggtgcccaccaccacgcccagctaatttttgtatttttactagagatggggtttcaccatgttgtccagactggtctcgaacttctgacctcaggtaatccacccgcctcagcctcccaaagtgctgggattagaggtgtgagccaccacacccaggctttttttttttttttttaattttgagatagagtctcgctctgtcgcccaggctggagtgctatggtgcaatcttggctcactgcaacctctgcctcccagtttgaagcaattctgccttggcttcccgagtagcttggattacaggtgtgtgccaccacattcggccaattttttttttttttttttttttttgagacagagtctcactctgtcacccaggctagagtgcagtggcatgatcttggctcactgcaacctccgcctcccaggttcaaacgattcttatccctcagcctcttgagtagctgggactacaggcatatgccaccatgcccagataatttttgtatttttagtagaggcagggtttcaccatattggccaagctggtctagaactcctgacatcatgatccgcacaactcggcctcccaatgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaattcaatgcttgggtcacctccaaattcattttcacagtctttcatgttttggtcatactacattgtattttgctgccatatgactgatctttttttgttaaatgtgagatactttttaaaaaatatttaacaatgcattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatgggttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgctgtcctcactggcttctcatttgcattaaactgtgagcttctttagcgtggggacaggaccctgctcccattgcattgtcagcacctcaccacacacaccttgtttgaggccactccagacagcatgtgctgaaggatgccctgtggtcagaaacaagttcattaactttctctttgaagtgatttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaactgaaccttgttaaagtcagtcaacaccagggtggatggtttgccgttgtcacctattttcaggacataacatcctgacttaggagccattccgatcatttctaattcaatagatgcgcccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggaggagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgatttttttttgtccctcaatgggaggtgtccattcttccttcggttgtgagaatcagttggttcatttgtgggaaggttgcaggggggatctttgaatcagccttcagatgccagaagggcagagggaatcccacacgtgctggtggatcatgtgtgtgcatttctctcccttctagtctgaggaaactaagcatgaaagaacgtgagcacggagaaaaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagactgtacagttttttttgtttttgtttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggcgcctgccaccacccccgcctaattttttgtatttttagtagagacggggtttcactgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtatcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaatactgcagtccttatgttattgctttgtttcaatatctggtatgattgcctgagggacctgaggtttttaatcgtaggggtttttttaatctttagaagtggttggttatgtaaaatattattatttgttttttttttgagactggagtttgctctgtcacccaggctggagtgcagtggctcgatcacagctcactgcagcctcaacctcctgggcttcaagcaatcctcctgccccagcctcccaagtagctgggatcacagatgtgtgccaccacgcctggccaatgttaaaaaatcctttaacttttttgtagagatgcactcctggactcaagcaatcctcctacttgtcccgaccaccagcctctttctgataaacatttacactgtttattatctgatgccatttctatcttcttccttgtcatccagacatcaaagaattaggtttcttcagggttttctttttcaagtgctcagtgttaaagatcactcacattagggccagacaccacggctcatgcctgtaatcccagcactttgggaggccgaggcgggcagagcacttgaggtggggagtttgagaccagcctggccaacttggtgaaaccccacctctactgaaaaaatacaaaaattagctgggcgtgatggtgcatgcctgtagtcccagccacttgggaggctgaggcatgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagactttgaagcagtggttattgcaacaggggcacggaagtcatctggctatgccagggtgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaagctctctcctggccctcctctcttgccaggactatgggtgactgaagacccccagggaggcacagcatcctcttatctaagattttttttttttttttttttttaagagacagggtctttctctgtcgcccaggctggactgcagaggcacaatcatagctcacggcagccttgaactcctgggctcaagcgatcctcccacttcagtgtcccaagtagctgagactacaggcacacgccagcatgcccggctggttttttaatttgtatttcctttgagacagcgtatctctctgttgctcaggctggagtgcagtggctcaatcagctcactttagccttgaactcctgggctcaagtgatactgccacctcaacctcccaagtctgctactacaggaacacaaactccttttttaaattttttatggatatggggtcttactatgttgcctaggctggtctcgaactcccaggctcaagcagtcctcctacctcagcctccccaaatgctgggattacaggtgggagctactgtacacctggccttatctaagctgtttccctgaaaatccccgtcttgggtaatgattccattggccccaccatgccctctgccttcctggctgtgcccaagcttggtccctgcctgcctgcctgcctccctctctgggtcttgagctcctgtgacacatgactcctctctcttcctggagtgatccaagccctgccacttcctgactttgcccacactgtaccctctgcctggggcaacttcatgtctgcccattgtcccttaggcctcagcccaggcacaagcccctgcctccggaggtcatccaggcctcaccaggctacaccctctcgtaaaattggattccctcccttcagggcaggtttataatgaaatcctcctcagaggccaggtgcggtgacacccatctgtaatcccagcactttgggaggctgaggtgggaggatcacttgaggccagggggtcgagaccagcctgggcaacataagagagactcttgtctctataacaaatttaaaaattacctcaccaggccaggctcagtggctcatgcctgtaatcccaacactttgagaggccgaggcaggtggatcacgaggtcaggagttcgagagcagcctgaccaacatggcgaaaccctgtctctactaaaaatacaagattagccaggcatggtggcacgcacctgtaatcccagctactcgggaggctgaggtaggagaattgcttgaacccaggaggtggaggttgcggtgagccaggatcacgccattgcagtccagcctgagcaacagagcaagactctgtctcgagacaataaaaacacacaaaaaattaactcgccatgatggcacatgcctatagtcctagctacttgggaggctgaggtgggaggattcccttcagcccaggagtttgaggctgcagtgagccactatgattgtgccactgcactctaacctgggcaaaagcgagaccccaggctagagtgcatgattttgggtcactgcaacctccacctcccaggttcaagtgattctcctgcctcagcctcttgagtagctgcgactacaggcatgtgccaccacgcctgggtaatttttgtatttttagtagagacagggtttagtagagaccatggtgaaaccccgtctctattaaacaaatctctactaaccccatctctacaaaaatcagctgggcgtggtagtgcacacctgtaattctagctacttgggaggctgaggcacgagaatcatttgcatcttggaggcagagtttgcagtgagctgacatcgcaccactgcgctccagccgggatgacagaacaagaccctgtctcaaaaaaaagaaaaaggaacaaacaacagcaacgacaacaaaaaaacctctgtgtcaatcacagccttcaagctaggggagaggcggccgaattctgccctctgctaactaactatagctttgtggaaatgggtgaatggcgtgcccttgtgagcctcagggccccatctgtaaaatgggcataactgtcatgcccgtctttaagaacagccttgggggtaaatgagtggaagtcatggaaagatctcagcccacaaccttccacagaacagacgcttctcacacagtaagtagcaggagtgcagaggctgcaggcatgaatccagccagactgcctgggttcaagtcccagctcccacgtcttggtaactatgtggcctcagacaagttacttaatatttctttttttttttttcagacggagttttgctctgtcacccaggttggagtgcagtggtgtgatctcggctcattgcaacctctgcctcccgggttcaagcaattctcctgcctcagcttcctgagtagctggaattacaggcacctgccaccacacacagctaatttttgtatttttagtagagacggggtttcaccatgttggccaggatggtctcgaactcctgacctcgtgatctgcctgcctcagcctcccaaagtactgggattacaggcgtgagccaccgcacctggacacgttactgaatatttctgtgcctaggtttcttcatgtgaaatgggattgttgtgagaacacaaagggattcccagggcagttcctagtgcatagtctggctgcctttgtatgtgtgtgtgtgtgtgtgtgcacgcgcgtgtgtgtgtgcacgcgcgtgtgtgtgtgtgtttaatatagagacagggtctcactctgttgcctaggctcgtttcaaactcctgggctccagtgattctcctgcctcgacccaaagtggtgggattacaggcatgagtcaacacacctggtcactttatattattattatttttttcttttgagacagggtttggcactgttgtccaggttggaatacagcggtgcaatctcaactcactgcaaactccgcctcccgggttcaagcaattctcctgcctcagtctcccgagtagctgagattacagacgcctgccaccacacacagctaatttttgcatttttagtagagatggggtttcaccatattggccaggctggtcttgaactcctgacctcaagtgatctgccggcctcggcctcccaaagtgctgggattacaggagtgagccaccgtgcccagccatctttcttttcttgctttctctttcttttctttcgagaccgggtcttgctctgtcgcccaggctggactgcagtggcacaatcatagctcactgcagcctcgacctccctggctcaagcgatccttcctcctcagccccccgagtagttggaactacagctccacaccaccatgcctggctgattctttttttccttgtagagatggggtcttgctatgctgtccatcctggtctcaaactcctggccttcccaaagcactgggattacaggcataagccaccacagccagtttccttttcttctttttaactggaatagttgactttttctttattagctgtgtgtcaggagggtatttttggcctttagtatgtcgtctaagttgctagtgcttttctgagattgtagtttgttttctaattttatttatattttgcgtagaagttgtgtattttagatggagttaggtcggctggtctttgatgttttatttattaattatgtatgtatttatttatttttgaggtagagtctcgccgtttcaccccagctggagtacagtgatgcgatcttagctccctgtagccttgacctctctgggctcaagtgatttttctctcctctacctcccgagtacttgggaccacaggcgcatgccgccatgcctggctaatgtgtatttttttgtagatacggggtctcactgtgttgcccagggtggtttcaaaatcctgggcccaggcgatccttccgtctcagctcccacggtgctgtgttaccggcgtgtgccccagtgcctggccgtcttggaggtcttgtttctctgggtttatgcctcaaggtggcgcctgctcccctgtgctccctggtagcctggtagtgagcctgcttctcacacagtcatacctggttgtggtcccacagtgggaccaccctgttgggttcagaacaggagatgggggcccctcgagtctgtgtgggggctgtggacagggttgggagaccttggctctgtgggggactgtggacaggggatggggggccttggccctgcgtgggatgggttgggggtccgtgcccttcctggccctgggtggacaggtccaggtggcactcggcatagggctgagatgggtgcagagggctgaggcccccaggcctctcctggcttggtttccccagatgagtgttcatttgggtcttccatcagaaaggcccctcctgacctctgggagtggggagctcaagggtgggaggccttagcttggggatgctggaaatgtgtgggatgggcccagggatggcctctggcctactaagggctctggccctgacccacggccactcactcctcagagacgtctcccacaacctgctccgggcgctggacgttgggctcctggcgaacctctcggcactggcagagctgtgagtgtcccccagtcgtgccagcatgcggggctcactccgggtgggctggcggcaccgcctcttgctgctcagctgtgggggcttccgtcagctttgccgaatcccccctctcttccagggatataagcaacaacaagatttctacgttagaagaaggaatatttgctaatttatttaatttaagtgaaatgtaagttgtggttctttgggtggggtcctggctggaccccaggcccccagtatcccttctgccctcccagttggtccgtgtccccttccaggcttgagaccagatcctgggggcagttcactacctgcttggagccccccagtgccggcttggttggggcaggggaggcggtgctgtcagggtggctccagggcctggttgccagtggggggctggcatagacccttcccaccagacctggtccccaacacctgcccctgccccgcagaaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgagtgccggtgggtggggcagctctgtccttcccagccaggtgggacctgggccctgcagacactgggcagggctcaggaaggcctctctggggggggcctccgggccaagggaacagcatgggagcctgtgagtgcggcgggcggatgggggggtgtggggtggagccaggaggagcagaacccggggtccagtggctgcctcttctaggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctccgagcagggctggtgcctgtgtgggtcagcccagccctccagtgcctccttcgcctgcctgtccctctgctccggccccccgccgcctcctgcccccacctgtaggggccccaccctcctccagcacgtcttccctgcctccccaggggccaccctggtggggccccacggacccctggcctccggccagctagcagccttccacatcgctgccccgctccctgtcactgccacacgctgggacttcggagacggctcccccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgtgttggttcaggcctggaggccgcctacagcatcgtggccctgggcgaggagccggcccgaggtgagtgtctgctgcccactccccttcctccccagggccatccagatggggcagagcctggtacccccgtcttgggcccacactgaccgttgacaccctcgttcccaccggtctccagcggtgcacccgctctgcccctcggacacggagatcttctctggcaacgggcactgctaccgcctggtggtggagaaggcggcctggctgcaggcgcaggagcagtgtcgggcctgggccggggccgccctggcaatggtggacagtcccgccgtgcagcgcttcctggtctcccgggtcaccaggtgcctgcccccaccccccgaggggccataggttgggagatctctgaagcagtggggcagagcctgtggctggggagtctcaggaggagggaggtgggagctgggccggccctggtgagcaggtggcgccggccggtggggccgttcctgtcagctctgcagatgcagaggtggacacgagctgggggcagcctccggacactcctgggcacgccatacgggaggtggcctgcacggggatccctgccagtgcccacaggcctcgtgggtgggtgctgctgtgagcctgggctggtgggccctgctctccgggctctgagcctcagtttccccatctggaaagggggacagtgacggggctcccagtgggctgctgtgagggtgggaggatggaggagtgccctgagccccctgccatcccacacccgcccccaggagcctagacatgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgctgcacagctacgtctgcgagctgcggcctggaggtgtgcgaggggccaggcaggggcctgagacgctggctgtggttaggggcctgccgagcgcccgcggtggagcctgggctgaggaggaggggctggtgggggggttctcgggcggctcggtccccagtctgttcgtcctggtgtcctgggccctggcccggcgcctcactgtgcacttgccaccccaggcccagtgcaggatgccgagaacctcctcgtgggagcgcccagtggggacctgcagggacccctgatgcctctggcacggcagtacggcctctcagccccgcatgagcccgtggaggtagtcggccccccacgttctaaaacctgccctcctgcctgcccctggaggcctcgcctgccctgcccactgtgggtctccccaaaaaacttgggggccttaatgttgcttgtgcccagtgaagatggttgggaaaatccagagtgcagagaggaaagcgtttactcacattacccccttttctctgagtgtgggtgagttattcctgaaaggcaggtcaggggtcctgccccccatggacagtttccatcggagtcttcctctcgagcgacaggagccaggcctgtgggggtccgatggctcgctctccttccctcccctcttcctgcgaagttcgggtggggggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctggggtggtgggcgccgcaggactcggggtggcctctctgagctctcacgtctgctggtcctgtggccatcagagtggttcccagtcttaggtggacagagcaggggttccagagacaccagctcattccaggtgtcctgggggtggatcgggtggggcctgcctggggaccggcctgggtcagtcagctggccggagacagggacgcagcactgggctgggagtgctgcccgggcggggagacctgtcctcacagcaaggccaggctcgctggtgcaggcagttgggcatctctgacggtggcccgtgggcgaatgagggccccaacaccctcccctcctcgcagggaccccggagaacggcagcgagcctgagagcaggtccccggacaacaggacccagctggcccccgcgtgcatgccagggggacgctggtgccctggagccaacatctgcttgccgctggacgcctcctgccaccccaggcctgcgccaatggctgcacgtcaggggccagggctactcggggccccctatgcgctatggagagagttcctcttctccgttcccgcggggccccccgcgcagtactcggtgtgtggccctgacctgggtctgttccctgcatctcctcaggccaccttcctgtctgctgcccagggtctgggtctgcgcagcagacacacccagcctgcaggcccctcccacgtccttgccacctctgacctccgacctccgacctccaacctccgacctctgcagtgcccttgcccctctcccagtgggagaagctctcgcctgggcccttggcacgagctgtgcctcctcttcctctctcccagcacagccgctccttcctgtctgccaggtcttggcctgtgtcctctccccgtgtgtccccctgtctgcaactgtcctgcctgtccttgtcacgagcactgtggggaggctccctgaggtgtggctgacgaagcggggagccctgcgtgtccaccctcatccgtcgtgcaggggtccacgggccatgaccgtgaggacgtgatgcagccctgcctccctctccacaggtcaccctccacggccaggatgtcctcatgctccctggtgacctcgttggcttgcagcacgacgctggccctggcgccctcccgcactgctcgccggctcccggccaccctggtccccaggccccgtacctctccgccaacgcctcgtcatggctgccccacttgccagcccagctggagggcacttgggcctgccctgcctgtgccctgcggctgcttgcagccacggaacagctcaccgtgctgctgggcctgaggcccaaccctgggctgcggctgcctgggcgctatgaggtccgggcagaggtgggcaatggcgtgtccaggcacaacctgtcctgcagctttgacgtggtctccccagtggctgggctgcgggtcatctaccctgccccccgcgacggccgcctctacgtgcccaccaacggctcagcctcggtgctccaggtggactctggtgccagcgccacggccacggctcgctggcctgggggcagtgtcagcgcccgctttgagaatgcctgccctgccctggtggccaccttcgtgcccggctgcccctgggagaccaatgataccctgttctcagtggtagcactgccgtggctcggtgagggggagcacgtgatggacgttgtggtggaaaacagcgccagccgggccaacctcagcctgcgggtgacggcggaggagcccatctgtggcctccgcgccacgcccagccccgaggcccgtgtactgcagggagtcccagtggtgagtatggccgaggctccaccaccagcccccaggcaggtgcctgcagacagggtgctcacacagggcgtgaggcctggcttcccagtgagggcagcagcccagttactggggacgtcggccccgggcaggtcctgctggctggctcctcaggctacctggtgggctttaaattcctggaaagtcacggctctgacagcggctccgctaactcattccaccgtctcatttcatgaaatgaatttaaaactctgctccctgacctcacacgagcccccgtgagtctctcacgccctctgctgtgttctcacctggctaaagcgagtggcttttgaggtggagtctgaacccctgatgggaaactgcgggctgcccgcggtgccaccatgctgggtacatgggggacagggctgtctccgtcttgcgggtacctgccccttcaccaggggccttgggaggggccatcagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccgggcttggctcccatggcatgcagagccccggccacctcctctcctctgtgccccgcgtgggactctccagcctgacgggaggtgtgtccaggaggcgacaggctaagggcagagtcctccacagagcccaggctgacaccagtccccccgcagaggtacagccccgtggtggaggccggctcggacatggtcttccggtggaccatcaacgacaagcagtccctgaccttccagaacgtggtcttcaatgtcatttatcagagcgcggcggtcttcaagctctcagtaggtgggcgggggtggggaggggaggggatggggtggggcggggcgggctccaccttcacctctgcttcatgctgcccgaggacgctgccatggctgtgggtgagtggagggagggacgctaagcagggccaggcctctcacctgccacctgggcccactgatgcctatccctgcagctgacggcctccaaccacgtgagcaacgtcaccgtgaactacaacatcaccgtggagcggatgaacaggatgcagggcctgcgggtctccacagtgccggccgtgctgtcccccaatgccacgctggcactgacggcgggcgtgctggtggactcggccgtggaggtggccttcctgtgagtgactcgggggccggtttggggtgggcaccaggctcttgtcccggccccagcctcagccgagggaccccacatcagggggttgcttttctgagcctcggtttccctatctgttgggaggtactgggtgcacaggagccctgaggctgcacgggagccgggagaggcctcagcacagccgggtgggccctgaatggaggcctggggcgtgactgcagagtggagcctcagctgggtcccaagcaccccctgcccccccaccgcgcacctgtgccccgccactgcgcacccctgtcccggttcactcactgcctcccaccgccccggcaggtggacctttggggatggggagcaggccctccaccagttccagcctccgtacaacgagtccttcccggttccagacccctcggtggcccaggtgctggtggagcacaatgtcacgcacacctacgctgccccaggtgagggatgagggggtgagggggccactgcctttcaggctctgagcacggggcacccccagtcccccagtcaagctgccccccttcctccccaacagccctcactgtgacctcacctgggctgatggcttaggtccctactggggtgagggaggggccaggcgtggggggagtggacagggaagctgggccccctgaactgccccccgccgcggcctggctcttgctgctctgctgccccgagtgcagctgcacttggaggcggtgccgtcctcaccaggcagccctcagtgctgctgcacctgtgctccgtcccgcacgtggcttgggagcctgggacccttaaggctgggccgcaggtgcagccgttcaccccgggctcctcaggcggggggcttctgccgagcgggtggggagcaggtgggggtgccgcggctgccccacttgggcctgtccccacaggtgagtacgtcctgaccgtgctggcatctaatgccttcgagaaccggacgcagcaggtgcctgtgagcgtgcgcgcctccctgccctccgaggctgtgggtgtgagtgacggcgtcctggtggccggccggcccgtcaccttctacccgcatctgctgccctcgcctgggggtgttctttacacgtgggacttcggggacggctcccctgtcctgacccagagccagccggctgccaaccacacctatccctcgaggggcatctaccacgtgcgcctggaggtcaacaacacggtgagcggtgcggcggcccaggcggatgtgcgcgtctttgaggagctccgcgggctcagcgtggacatgagcctggccgtggagcagggcgcccccgtggtggtcagtgccgcggtgcagacgggcgacaacatcacgtggaccttcgacatgggggacggcaccgtgctgtcgggcccagaggccacagtggagcatgtgtacctgcgggcacagaactgcacagtgaccgtgggtgcggccagccccgccggccacctggcccggagcctgcacgtgctggtcttcgtcctggaggtgctgcgcgtcgagcccgccgcctgcatccccactcagcctgacgcgcggctcacggcctacgtcaccgggaacccggcccgctacctcttcgactggacctttggggatggctcctccaacacgaccatgcgggggtgcccgacggtgacacacaacttcacgcgtagcggcacgttccccctggcgctggtgctgtccagccgcgtgaacagggcgcgttacttcaccagcatctgcgtggagccagaggtgggcaacgtcaccctgcagccagagaggcagtttgtgcagctcggggacgaggcccggctggtggcatgtgcctggcccccgttcccctaccgctacacctgggactttggcaccgaagaagccgtccccgcccgtgtcgggggccctgaggtgacgttcatctaccgagacccaggctcctatcttgtgacagtcaccgcgtccaacaacatctccgctgccaatgactcagccctggtggaggtgcaggagcccgtgctggtcaccagcatcaaggtcaatggctcccttgggctggagctgcagtagccgtacctgttctctgctgtgggccgtgggcgccccgccagctacctgtgggatctgggggacggtgggcggctcgagggtccggaggtcacccacgcttacaacagcacaggtgacttcaccgttagggtggccggctgcaatgaggtgagccgcagcgaggcctggctcaatgtgacggtgaagcggcgcgtgcgggggctcatcgtcaatgccagctgcacggtggtgcccctgaatgggagcatgagcttcagcacctcgctggaggccggcagtgatgtgcgctattcctgggtgctctgtgaccgctgcacgcccatctctgggggtcctgccatctctttacaccttccgctccgtgggcaccttcaatatcatcgtcacagctgagaacgaggtgggctccgcccaggacagcatcttcgtctatgtcctgcagctcatagaggggctgcaggtggtgggcggtggccgctacttccccaccaaccacacggtacagctgcaggccgtggtcagggatggcaccaacatctacagctggactgcctggagggacaggggcccggccctggccggcagcggcaaaggcttctcgctcactgcgctcgaggccggcacctaccatgtgcagctgcgggccaccaacatgctgggcagcgcctgggctgactgcaccgtggacttcgtggagcctgtggggtggctgatggtggccgcctccccgaacccagctgccgtcaacacaagtgtcaccctcagtgccgagctggctggtggcagtggtgtcgtatacacttggtccttggaggaggggctgagctgggagacccccgagccatttaccacccacagcttccccacacccggcctgcacttggtcaccatgacggcagggaacccgctgggctcagccaacgccaccgtggaagtggatgtgcaggtgcctgtgagtggcctcagcatcagggccagcgagccgggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttcaacatccggctcaatgcctccaacgcagtcagctgggtctcagccacgtacaacctcacggtggaggagcccatcgtgggcctggtgctgtgggccagcagcaaggtggtggcgcccgggcagcttgtccattttcagatcctgctggctgccggctcagctgtcaccttccgcctgcaggtcggcggggccagccccgaagtgctccctgggccccgtttctcccacagcttcccccgcatcggagaccacgtggtgagcgtgcagggcaaaaaccacgtgagctgggcccaggcgcaggtgcgcatcgtggtgctggaggccgtgagcgggctgcaggtgcccaactgctgtgagcctggcatcgccatgggcactgagaggaacttcacagcccgcgtgcagcgcggctctcgggtcgcctacgcctggtacttctcgctgcagaaggtccggggcgactctctgttcatcctgtcgggccgcgacgtcacctacacgccgtggccgcggggctgttggagatccaggtgcgtgccttcaacgccctgggcagtgagaaccgcacgctggtgctggaggttcaggacgccgtccagtatgtggccctgcggagcggcccctgcttcaccaaccgcttggcgcagtttgaggccgccaccagccccagcccccggcgcgtggcctaccactgggactttggggatgggtccccagggcaggacacagataagcccagggccgagcactcctacctgaggcctggggactaccgcgtgcaggtgaacgcctccaacctggtgagctttttcgtggcgcaggccacggtgaccgtccaggtgctggcctgccgggagccggaggtggacgtggtcctgcccctgcaggtgctgatgcgacgatcacagcgcaactgcctggatgcctacgttgacctgcgcgactgtgtcacctaccagactgagtaccgctgggaggtgtaccgcaccgccagctgccagcggccggggtgcccggcgcgtgtggccctgcccggcgtggacgtgagccggcctcagctggtgctgccgcggctggcgctgcctgtggggcactactgctttgtgtttgtcgtgtcatttggggacacgccactggcacggagcatccaggccaatgtgacggtggcccccgagcgcctggtgcccatcactgagggtggctcctaccgcgtgtggtcagacacacaggacctggtgctggatgggagcgagtcctacgaccccaacctggaggacggcgaccagacgccgctcagtttccagtgggcctgtgtggcttcgacacaggtcagtgcgtggcagggccgtcctccctgcccctcacccgtccacacccatgagcccagagaacacccagcttgccaccagggctggcccgtcctcagtgcctggtgggccccgtcccagcatggggagggggtctcccgcgctgtctcctgggccgggctctgctttaaaactggatggggttctcgggccacgtcgccccttgttctcggcctgcagagggaggctggcgggtgtgcgctgaactttgggccccgcgggagcagcacggtcaccattccacgggaacggctggcagctggcgtggagtacaccttcagcctcaccgtgtggaaggccggccacaaggaggaggccaccaaccagacggtgggtgccgcccgcccctcggccacttgccttggacagcccagcctccctgctcatctactgttttccgtgttttagtgctggtggaggccgcgcgctctcccctctctgtttctgatgcaaattctatgtaacacgacagcctgcttcagctttgcttccttccaaacctgccacagttccacatacagtcttcaagccacatatgctctagtgacaaaagctacacagtcccccagcaataccaacagtgaggaagagccccttcccaccccagaggcagccactgtccccagcccatgtccctgttgctggatgtggtgggccggttctcaccctcatgctccccactctggaccggccaggaggcttggtgaccctgagcccgtggtggctgctcctgctgctgtcaggcggggcctgctggtgccccagagtgggtgtctgttccccagtccctgctttcctcaacgggcctgattgggggtctgcccagaggggtcgtctgaggggagggtgtgggagcaggttccatcccggctcagcctcctgacccaggccctggctaagggctgcaggagtctgtgagtcaggcctacgtggcaactgcggtcctcacacccccacatacgtctgttcccacacgcatccccccaggggccctcagtgagcattgcctgcctcctgccagggtccagctggctccagtacaccagaacacacaccccagtgtcctctgccctgtgtatgcccttccgccgcccaggttggaaggtggcaaaccggatgagtatcctgggagggggtgagctcaccggcagtggccaggcccctgggaaacctggagtttgggagcagcatcctccacgggtcccccagaccttccagcaggccaaatagacctgtgttggaggtaaccccactcccacgccaggtgctgatccgcagtggccgggtgcccattgtgtccttggagtgtgtgtcctgcaaggcacaggccgtgtacgaagtgagccgcagctcctacgtgtacctggagggccgctgcctcaattgcagcagcggctccaagcgaggggtgagtgttgagcggggtgtgggcgggttggggatgggtcccatggccgaggggacggggcctgcaggcagaagtggggctgacagggcagagggttgcgccccctcaccatcccttctgcctgcagcggtgggctgcacgtacgttcagcaacaagacgctggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgctgcctcttcccactgggcgctgtgcacgccctcaccaccaaggtgcacttcaaatgcacgggtgagtgcaggcctgcgtagggggagcagcgggatcccccgactctgtgaggtcacggagccctcccgtgatgctgtggggaccatccctcaggctggcatgacgcggaggatgctggcgccccgctggtgtatgccctgctgctgcagcgctgttgccagggccactgcaaagagttctgtgtctacaagagcagcctctccggctacggagccgtgctgcccccgggtttcaggccacacttcgaggtgggcctggccgtggtggtgcaggaccagctgggagccgctgtggtcgccctcaacaggtgagccaggccgtgggagggcgcccccgagactgccacctgctcaccacccccctctgctcgtaggtctctggccatcaccctcccagagcccaacggcagcgcaatggggctcacagtctggctgcaccggctcaccgctagtgtgctcccggggctgctgcggcaggccgatccccagcacgtcatcgagtactcgctggccctggtcactgtgctgaacgaggtgagtgcagcctgggaggggacctcacatctgctgcatgcgtgctggggaccaagacctgttcccctgcctggagctttgcggagggctcatcccgggccccagagataaatcccagtgaccctgaagcagcaccccgacgttccgctcccagcagccacacccaccgggccctctccggcgtctgctttccacaatgcagcccccgcccaggagggcccatgtgcttaccctgttttgcccatgaagaaacagctcagtgttgcgggtcagtgcccacatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctcaccccgccccgcatgcctgccagggtactgggttcagccccccagggcagacgggcagcttggccgaggagctgagcctccagcctgggctccttcctgccgtggcgttcctcggtctctgacctgcttcagtagcctcagcctttctgctgtcctgtgtgaacgcagggtgcctctcgggggacccagggtgtaaagaggggcccagatgtggggagggactaagaagatgctgctctgtgccctccactctcccctcccctcccccttccctcccctttctccatctctctccccttttctccatttcccccccgatcctccccgtccttttgtccattcccctcatctttcttatcccccttatcctccttcccctcccttatcctccttcccctcccttatcccccttatcccccttcccctccctttccccctgctcctcctcttctcccctttctcttttctctacccttttccttcctttttcctccctctccccatcatccccctcatcttcgtcctcatccccatccccttccccctccccctccaccactctctctccagcttcccccttccttctgcctgcacctcgctctctgccccctcaggttccccctttctcccagcccccaccctccagctccccctttttgcctgcccccaccctccctctgcctccctgtctctgcactgacctcacgcctgtctgcaggagacctcatccacctggccagctcagacgtgcgggcaccgcagcgctcagagctgggagccgagtcaccattgcggatggtggcgtcccaggcctacaacctgacctctgccctcatgcgcatcctcacgcgctcccgcgtgctcaacgaggagcccgtgacgctggcgggcgaggagatcatggcccagggcaagcgctcggacccgcggagcctgctgtgctatggcggcgccccagggcctggctgccacctctccatcccctaggctttcagcagggccccggccaacctcagtgacgtggtgcagctcgtctttctggtggactccaatccctttctctttggctatatcagcaactacaccgtctccaccaaggtggcctcgatggcgttccagacacaggccggcgcccagatccccatcgagcggctggcctcagagcgcgccatcaccgtgaaggtgcccaacaactcggactgggctgcccggggccactgcagctccgccaactccgttgtggtccagccccaggcctccgtcggtgctgtggtcaccctggacagcagcaaccctgtggccgtgctgcatctgcagctcaactatacgctgctggacggtgtgtgcagcgggtggggcacacgcggccccctggccttgttcttggggggaaggcgtttctcgtagggcttccatgggtgtctctggtgaaatttgctgtttcatgggctgttgggggcctggccggagaggagctgggggccacggagaagcaggtgccagctctggtgcagaggctcctatggcctttcaggcccgtggcagagggtgggctcaggagggccatcgtgggtgtcccccgggtggttgagcttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggtgagctctgtgggccggcctggcagggcagggcagggcatcatgggtcagcattgcccgggttacgggccccgtggggacggcaggcagcgaggggactggaccgggtatgggctctgggactccgacatccaacctggcggagcctgggctcacgtccactgccccttcccttcccaggaccagagacccagtggggagttaccgtctgaacctctccagccacttccgctggtcggcgctggaggtgtccgtgggcttgtacacgtccctgtgccagtacttcagcgaggaggatgtggtgtggcggacagaggggctgctgcccctggaggagacctcgccccgccaggccgtctgcctcacccgccacctcaccgccttcggcaccagcctcttcatgcccccaagccatgtacgctttgtgtttcctgtgagtgaccctgtgctcctgggagcctctgcagagtcgaggagggcctgggtgggctcggctctatcctgagaaggcacagcttgcacgtgacctcctgggcccggcggctgtgtcttcacaggagccgacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtgaggggcgcggcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctgcacagtagcgtggccccacaagtgacatgagcatcgctaccactgtgggagaccatgcatccacccgcgatcctgactgcatagctcgtctctcagacggaggtgccagcaccctccccgtggctgtttcttcaatacctccattttcctttattggaattgcccttctggcattccctttttgttttcatttttctttttttggagacggagtctcactctgttgcccaggctggagtgcaatggcgtgatcttggctcacagcaacttccagctcctgggtttaagcgattccccttaagcgattctcctgagtagctgggagtacaggtgcacgccaccacacccagttaatttttcaccatgtcagccaggcgaactcctgacctcaggtgatccgcctgcctcggcctgccagagtgctgggatgacaggtgtgagccaccacacctggctgtgttcccattttttatttccgtgttgctttcatcttcatttcccagttcttttgattacctacttttaaaaactgtcggccgggcgcggtggctcacacctgtaatccgagcactttgggaggccgaggcaggcaaatcacggggtcaggagaccgagaccatcctggctaacggtgaaaccctgtctctactaaaaaatacaaaaaaattagcccggcgtggtggcaggcacctgtagtcccagctcctcgggagactgaggcaggagaatggcgtgagcccgggaggcggagcttgcagtgagctgagattgcgccactgcactccagcctgggtgacacagcaagactccatctcaaaaaaaaaaagaaaaaaaatactgtcacctgggtctgtcactgggagaggaggtgacacagcttcacgcttcgcagtctgtgcatgaactgagggacgggtgtgtggtgcgggtcactggttgtggcgtgactgaggcgtggacaggtgtgcagcgcgggtcactggttgtggtgtggactgaggcgtgtgcagccatgtttgcatgtcacaagttacagttctttccgtgtaacttaatcatgtccttgaggtcctgctgtttattggacaaattgcagtaaccgcagctcctcgtgtatggcagagccgtgcaaagccgggactgcctgtgtggctccttgagtgcgcggaggccaaagctgagatgacttgcctgggatgccacacgtgttgggcagcagaccgagcctcccacccctccctcttgccctccaggtaccacggcccacgtgggcatcatgctgtatggggtggacagccggagtggccaccggcacctggacggcgacagagccttccaccgcaacagtctggacatcttccggatcgccaccccgcacagcctgggtagcgtgtggaagatccgagtgtggcacgacaacaaaggtctgtgcggaccctgccaagctctgcccctctgcccccgcattggggcgccctgcgagcctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggctgcgagtaaggcctcgttccatgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccacctcgtagctgtttcactcgcatccagagggccacctgctgcgttctcctcatctgcctcttcctgggcgccaacgccgtgtggtacggggctgttggtgactctgcctacaggtgggtgccgtaggggtcgggacagcctcttcctgcccagcccttcctgcccctcagcctcacctgtgtggcctcctctcctccacacagcacggggcatgtgtccaggctgagcccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcacgcctgtaatcccaacactttgggaggccgaggcgggcagatcagttgaggtcaggagttcgagaccagcctggccaacacaatgaaaccccatctctactacaaatacaaaaacttagctgggcatggtggcgggcgcctgtagtcccagctactcgagaggctgaggcaggagaatggcatgaacccaggaggcggagcttgcagtgagccgagattgcgccactgcactccatcctgggcaatggagcaagactccatctccaaaaaaaagaaaaaaaaaatcccacaaagaaaagcttgggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgttggccgggcgtggtggctcacacctgtaatcccagcactttgggaggcggaggcgggcagatcacttgaggtcaggagttccaagaccagcctggccaacacagtgaaaccccgtctctactaaaaatacaaaaaattagctgggcatcgtggcaggcacctgtaatcccagctactcaggaggctgagccaggacaatcgcctgaacgcgggaggtggaggttgcagtgagctgagattgcgccagtgcactcctgcctgggtgacagagcgagactccatcttaaaaaaaaaaaaaaaatgaaattcaaaactctgttccttagctgcaccagtctgctgtcaagtgttcagtggcacatgtcgcgaggggctgccatcacggacggtgcagatgtcccatatatccagcattctaggacattctgttagatggcaccgggctctgtcctgtctgctgaggaggtggcttctcatccctgtcctgagcaggtctgagctgccgcccgctgaccactgccgtcgtcctgcaggtggctgggagcctgagccccacacctgccgggcagtaggtgctggacatcgacagctgcctggactcgtccgtgctggacagctccttcctcacgttctcaggcctccacgctgaggtgagggctctactgggggtcctgggctgggctgggggtcctgccgccttggcgcagcttggactccagacactgtgcacctctcagcaggcctttgctggacaggtgaagagtgacttgtttctggatgattctaagaggtgggttccctagagaaacctcgagccctggtgcaggtcactgtgtctggagtaccgggggtgtgcgggctgcgtgtccttgctgggtgtctgtggctccatgtggtcacaccacgtgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttggccggacctgctcagtgacccgtccattgtgggtagcaatctgcggcacaacccccacttactgggtctctccttttacaaccaacacaaccgaaatctagggcttctttttttttttttttttttttgagacagagtctcattccattctgtcacccaggctggagtgcaatggtacgatctcggctcactgcaacctccgcctcccgggttcaagggattgtcctgcctcagcctcctgagtagctgggattacaggcgtgtgccaccatgcctggctaatttttgtatttttggtagagacggggtttcagcatgttggtgaggctggtctcgaactcctaacctcgtgatccgcctgcctcagcctcccaaagtgctgggattacaggcgtgagccaccatgcccagccaaatctagggctggaacatggctgcagcatataaatagaattgaattccatagttttgttaatcctgttttttgtttgtttgtagttgttgctgtttttgagacagagtctcgctctgtcgtctaggctggagtgcagtggtgtaatctcggctcactgcagactctgcctcccgggttcaaactgttctcctgcctcagcctcccaagtaggtgggactacaggtgcccaccaccacacccggctaatttttgtattttattagagacagggtttcaccatattggccaggctggtctggaactcctgaccttgtgatctgcccacctcggcctcccaaagtgctgggattacaggcgtgagccaccacccccagcccctgttttgtttttgttttgcttgtttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagagagtttgggcacactctgtgtgatcgggcagaaggcctgtgggaagtttagctgaggacagggccaggaaaggtgatggacagtgggggtctgtcctggtcaccaggcccctgggtcctgcccgcctgcttggagctccccacccatcacacatgatgcggccaagccctctgggtattgtgggcaaataccttaggagagaagctgatgaactttgtttcttgaaatgcacagattccttggacgtccctgagagctcagtcatgaaagtcagcttggttttctccccctcatttgggttcagaatttaaagtccacacacacgggcagtaagatgacatagataaggacatcatcactcagtttcggatgttaaaatgtctaggtgggttaggggtgatttgagatcacacaaccttgtgccacaaagaggaattcccaggccagagggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttttatgatcagaaacatgctgtgtgatttgattgctctcaaatatattgagatttgctggaacaaaataagtcaggttaatttttgtaaatgtaccatgcatgcttaaaatgaatgtatgtacatttgttcctgagatacaggttgatggacggatggctacatggatgtgatggagatggtttactatcgggaccttccgcatcctgctgatgttttgttgcttaggatatgaatggctgagcggaggctgtacaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaagtcaggtttgtgaaggttccagagaggacctggccttgggaggagcgtgggggactgagatgggggaggggtcattgggatgatgcgggcgctacttggaatgtccattgtgaggcaccaccggggtcatcagggattggtggagagagagtctaaagccccagggttgctaagggagggcccagaccgaagaaggtttggtggaaagcagaacctttgtctccctctaattgctcctaagcctcacgctcccttgccccgcctgtcctgttgcttccctgatcttctccgtgacctgtagctaaaccttccaccagcgcttgagaacttaatttgaaccggatcctttcccagacccctttcttcttctcctcctcctcctccccaacagcccccttctcctcctttcccttcccttacttccccccttcccctccccctcccctccccctcccctccccctccccaactcagatccggcccggtccccgtccccttccctcccccctgccctaagccacctccacctctgtcctggctgcctcagggcgccctgaaaggaccaggacatgcgggtgcggtggctgctcttttggctcctcttttggctcctgctgggatttatcagccatcagtccacctgtgtgagtagatgggtgctgtggctgctcttttggctcctgctgggatttatcagccatcagtccacctgtgtgagtagacgctggacccgcggggtttcttcctttttactgggctgtgtcacgcggcatgaaattacacagctcaggcctgtaatcccagcactttagggggctgaggtgggcagatcacttgagtccaggagttgaagactagccagggcatcatagcgaaaccccatctctacaaaaaattccaaaaaagattagtcgggcctggtggtgcgtacctgttatcccagttactggagaggctgaggtgggaggatcgcttgggcccaggagctggacgttgcagtgagccgagatggcgctgttgcactcttgtctccaacagacaaaacggaccaaaacaaagtgaaatgtcatttgatttgtgtcatctggtttgatgacttttttttgtttgtttgttttttagacagagtctcactctgttgcccaggctggagtgcagtggcaagatctcggctcactgcaacctccgcttccggggttcaagcaattgtcctgcctcagcctcctgagtagctcagattaccacgcctggctaatgtttgtatttttagtagaccaccacgcctggctactttttgtatttttagtagagactgggtttcaccatgttcgccaggatagtctccatgtcttgacctcgtgatctgcctgcctcggcctcccagtgctgggattacaggcgtgagccaccgcgcctggccaaaatatataaccttaagtgtaagtttactaactttggaaagtacatacaccagcataaaccaaccccctttcaagatctacattattttatttatttatttatttttttgagacagtttctcccttgttgctgaggctggagtgcaatggggcaatatcagctcaccgcaacctctgcttcccaggttcgagcgattctcctgcctcagcctcccgagtggctgggattacagacatgtgccaccactcccagctaattttgtatttttagtagagatagggtttctccatgttggtcaggctggttttgaactcccgacctcaggtgatccgcctgcctcggcctcccaaagtgttgggattacaggcgtgaaccaccgtgcccagccaagatctacactattatgtcaccccagaaagtgaactctcactcttcccagccagtctctttcttatcatagcttagcttgcttattctggaatttcgcgtatacagatgcatgccatgccataggtactcttttgtgtctgctttattctgctcaacaccatgtttctgaaatcattaccattgttgtacggttctctaactccatcatttccatttcagactcagcatatgctgagttcaacctgttgaagggctatctctgtttaattcaccatcttgaaagaaacatttaaaattgagatgttttcaagaatatatagttaaatcctgaggaatcgatgtagaaatgttatcagaagctgtctgaacttactcaggggaagtcttcgtcttcactcacataagagtctaatggaattaatatcaacaatcttagagaaatcccacgctattcatgccattttcatgatctccaccttggtaatttttttttttttttttttgagacagagtctcgctctgtcacccaggctgaagtgcagtggtgcgatcttggctcactgcaacctctacctcccaggttcaagtgattcttctgcctcagcctcccaagtagctggaactataggcgcgtgccaccatgccctgctaattttttgtatttttagtagagatgggtttcaccgtgttagctaggatggtctcaatctcctgatctcgcggtccacccacctcggcttcccaaagtgctgggattgcaggcgtgagccaccacgcccagcccaccttgttactttttaagaactaaaattcgatacttatttgtgaatgaagtaatctcttcattgtatttttttttttttacttatgctgagctttaaatgacaaagattcatataatccaagagagaagtattatttagagggattcttttaccatgtgatatataataaatgcatccaatgttatacatcaatttaaaaaacaagtaaataactaaagaaaagataactactggccaggtgcagtggctcacacctgtattgccagcactttgggaggccgaggcaggtggatcatgaggtcaggagttggagaccagcctggccaagatggtgaaaccctgtttctactaaaaagacaaaaattagccgagcgtggtggcaggcgcctgtaatcccagttactcagtagctgaggcaggagaatcgcttgaacccgggaggcggaggttgcagtgagctgagatcatgccactgcaatctagcctgggtgacagagcaagactttgtctcaaaacaaaaataaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcctgtaatcccagcactttgggaggctgaggcgggcagattacctgaggtcaggagttcgagaccaccctggccaacatggcaaaaccccatctccacaaaaaatacaaaaatttgctgagtgcactgtcaggcacctgtactcccagctactcaggaggctgaggcaggagaatcacttgaacctgagaggcagaggttgcagtgagccgagagcacaccactgcactccagcctgggtgacagagtgagaccccatctcaaaaacaaacaacaaacaaaaacaaaaaaaatggccgggcacggtggctcacacctgtaatcccagcactttgggaggccgaggcaggcagatcgcctgtcaggagttcaaggccagactggccaacatggtgaaacctcatctctactaaaaatacaaaaattagtcgggcatggtggcagagacctgtaatctcagctgctcgggaggctgaggcaggagaatggcttgagcccaggagctggaggttgcagtgagccgagattgcaccactgcactccagcctgggcgactgagtggagcggaactctgtctcaaaaaaaaaaaaaaaaatttttttttttagatcatcagctattgttagtgttagtgtatgttatgtgtggctcaagacaactttgcttcttttaatataggcagggaagtcaaaagattggatatccctgctttataccaagaaagacaacaccccacatttgcaatgcctaaaaacactaccagccatctgaaaaacatgagacttctctaacttctgttcttttttgtagcagtggaatcccacggtgatatctgagggatgtggttaccttttggaggaggttgacggtttctaaggatgattctttctgagtgaaatattgtcagtgtcattgaccttttcattatttcaactattattattccaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattcacgtttctggacttcattatgaatatgtggttttacccaaaaaatcagggaaatgatttattagcataagaattatgaaaatatctgccatttacattatgaaaattaaataggtcggtgtttaatagaatgtcaacagagcttttggtcaaaaataagtttttttaacctttgtgctatttgtcacaaatggagtatgagatttcgtcacttaaatgggaaagtctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggctggatggttgatgcttaaagagcaccctcttctgagggtagagggagatagatggagatgtaggccatttagaggggcagcaaatgatttttaggggaaatgaaagagcccaaggaacaaacagttggcctgagacaaagttcctctgaggtcatagggacgaggtgacaaactgccggaaggtgaagggcagaactgcactgcgtctcatgatgcagagaaagccccacagaatctcttagaactgccctccaagagaatcaatgaaaagtgtgtctgggcagggtaattttgaatgacatcattcaaagtgcatgttcccacttgcaactggaatgagatcagtatgtcaaaagtctatacttggtaagaatttggctgctaagttgtgccataatttgtcttttgagccttttatcctttgcgtaagttgagctctacattttgtcttgccattcatgacaataaaaatgtggttgtgtgggggctgaacctccttctgaacaatgatccaagataaaagtactaaaccacaatgcttttttatattcaagggaagaggaagtatgtttcagttttaccgcctagataattacacgtcatttggcactgcctttcaagatatgtagaaaacagaaaatatatgagttatgaagatatctaggcacatttaacattctctatgccacttagtcctgaacagagaattttcggtataaattggaggaagcttttttttttttcttttctcacccccaagaggagtctccctctgttgcccaggctggagtataatggtgtgatctcggctcactgcaacctccacctcctggcttcaagtgattcccctgcctcagcctctcaagtagctgggattacaggtgcccaccaccatgcccagctaatttgtgtatttttagtagagtcggggttttaccatgttggccaggctagtctcaaaacccgacctcaaatgatccacccgcctcagcctcccaaagtgctgggattacaagcgtgagtcaccacgtgagccaggggaagtttttaaatttaccactttttaacaattccatttaggaaagttcagttgagctgttggacttggacaactttgcacctctcatctttgtccttgtcatctagtcatctataccattacctcctaagcagggacatcatgggtgccatgaagcattcatgtgtgatggcatttctttgcttctcatttcttcatgtgtttgacatttctcctagctccaaactgggccagctacctttcctatgaaatctagcagtagctgtgggatagacgtggttgctcttttcatctttttagattacccattgcttctcttgaaatcctagtacatgatttttttttaatcctatgtgcagaaatcaggaaaaaacaagttctacaaagaatttgaaagatattatttcaggccaggtgtggtggctcatgcctgtaatcccagcactttgggaggctgaggcaggtggatcacttgaggtcaggagttcaagaccagatgggccaacatagtgaaaccccatctctactaaaaagacaaaaattagccaggcatggtagcaggcacctgtaatcccagctacttgggaggccgaggcacaagaatcgcttgaatctgggaggtggaggttgccgtgagccaaggtagtgccactgcacttcagcatggttgagtgacactccgtctcaagaaaaaagtcatttcaatgactacctcaggagattcataggtatctgacccacatctgagatgggatttgcattgcattttagctatgatgagaacaaatatttaatatcttcgaagattaaaagcatactgtgataatatggaaatcttggtgggaattcagtcattagtgagaatgttttgcgttaagttcaaaccagcctcaacgaagctgatgtgagggaagggaaagtgaactctgagtagagcagggacagaagaaagatgctccagtgcagatcaggaaggagcagggggtgaaatgttacaaattctagaactcagagagctgaaggtaattacttccttttcaagttgtgaaacatgttaacctgtggtaaaatacttacaagatgataattaccatctaaccgtgttgaagtgtacagttcagttgtgtgaagtatattcatgtcatttttttttttttttttttttgagacagagtctcactctgtcaccaggctggagtgcagtggtgggatcttggctcactgcaccctctgcctcctgggttcaagcagttctcctgcctcagcctcccgagtagctgggactacaggcgtgggccaccatgctcagctaatttttgtatttttagtagagacggggtttcaccatgttgcccaggatgatctccatctcttgaccttgtgattcacccgcctcggcctcccaaagtgctgggattacaggcgtgagctacagcacctggcctatttttttttttttttttgagacagagtttgaattttgttgcccaggttggagtgcaatggcacaatctcagctcaccacaaccttttcctgctggattcaagtgattctcctgcctcagcctcgcgactagctgggattacaggcatgcaccaccatgcctggctaattttgaatttttagcagagacagcgtttctccatgttggtgaggctggtctcaaactcccgacctcaggtgatccgcctgcctcggcctcccaaagtactgggattacaggagtgagccaccctgccagcctcatgtcattctttgtgtgtgtgtgtgtgtgtgtgtgtgtgtgtgtgtgacagagtctcattctgtcgctcaggctggagtgcagtggtgtgatctcggctcactgcaaactccgcctcccagcttcaaacggttctctgcctcagcctcccgagtagctcggattacaggcgcccactgccatgcccggctaatttttgtatttttagtagagacggggtttcaccatcttggccaggctggtcttgaactcctgaccccgtgatccacctgcctcggcctcccaaagtactgggattatacgcatgagccaccgtgcccagccgtcattcttatattattatttcctaggtgtctttcctgaagactatcttcccatctcaaaatggacatgatggatccacggatgtacagcagagagccaggaggtccaaccgccgtagacaggaaggtatggctctgttggagtccccatagtgtggaaatgagtttgccctggaaagggaaagaacagcttcttgccctcaggtttctcaccttctcctctcctcactctcaccaagggctgaagtccatttgtatgcacacaaagaaaagagtttcttcctttccaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacagtaagatgtgccttgacacaaatactgttgtatgaaccatgtgccaatcaaagtagacaactgtaaagtccttgagaatattttcgacaatatttgtggcaaattcagtgggttcaaaattgagtttgtcctttctgcttcattagtttaagctgtataattcctttcccttcctacattcttgtttgtcattttttcaggggaagaggagttgctagtactgcattggttttcctttctctctcttttttttttttttttttcctgagatggggctttgctcttgttgcccaggctgcagttcaatggcacaatctcaactcactgccttttgggttcaagcaattctcctgcctcagcctcccaagtagctgggattacaggtgcccaccaccatgcccagctaatttttgtatttttactagatatggggtttcaccatgttgtccaggctgatctcgaacttctgacctcaggtaatccacccgcctcagcctcccaaagtgctgggattagaggcgtgagccaccacacccagcacccagcctttttttttttttttttaattttgagatagagtctcgctctgtcgcccaggctggagtgctgtggtgcaatcttggctcactgcaacctctgcctcccagtttgaagcaattctgcctcagcttcccgagtagcttggattacaggtgtgtgccgccacattcggccaattttttttttttttttttttttttttgagacggagtctcactctgtcacccaggctagagtgcggtggcatgatcttggctcactgcaacttccgcctcccaggttcaaacgattcttatccctcagcctcttgagtagctgggactacaggcatatgccaccatgcccagataatttttgtatttttagtagaggcggggtttcaccatattggccaagctggtctagaactcctgacatcatgatccgcacacctcggcctcccagtgtgctgggattacaggcgtgagccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaattcaatgcttgggtcacctccagattcattttcacagtctttcatgttttggtcatactacattgtattttgctgccatatgactgatctttttttgttaaatgtgagatactttttaaaaaatatttaacaatgcattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctggaattcagcaatgaaactcagggaaatgggttccaaatgcgaggctgactttcgtcctgggtttccttcttctccatcttcacctcatgtctgtttactgccatgttagcaatttgatgtattcaatcatggtttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgatgtcctcactggcttctcatttgcattaaactgtgagcttctttagcgtggggacaggaccctgctcccattgcattgtcagcacctcaccacacactccttgtttgaggccactccagacagcatgtgctgaaggatgccctgtggtcagaaacaagttcattaactttctctttgaagtgttttcgtccctgtttcctagcgttctgggaattttacacatccttcctataaaaccaagtatcaggtgagatccttaggatcaggaccatgaatcaagtggtgtgagggcaacacagcaaacttacccttttgaggccgtttcctttttctgccctcaatctctgtgaattgaaccttgttaaagtcagtcaacaccagggtggatggtttgccgttgtcacctattttcaggacataacaccctgacttaggagccattccgatcatttctaattcaatagatgcgcccagcattcagattgccttttcaggatctttaaagtcgatgacaagagttccagtcctgaatcatggcaaagtgcagtagtgaactgcggggttaatgacaccatattctggaaggatctctctatggctgatggtctcagttccggcatcagcctctgactgagaatcaggtctcacacaggaggagtcagatgaggagcaatcctctgcttccgatggagttagttgtgatgaattggtgaggtctggtttttcacactgaactaaaatgagctttcgctgtgtcaagcacaagactgaccccagagacgcacatagtgcacctcatagaagcttttaatagtctttatatttactaaagaataggactaactatggaactatgaagatgagctggaaatgacaggtgacttgccagcaggccagagtgtgattttttttatccctcaatgggaggtgtccattctcccttcagttgtgagaatcagttggttcatttgtgggaaggttgcaggggggatctttgaatcacagccttcagatgccagaagggcagagggaatcccacacgggctggtggatcatgtgtgtgcatttctctcccttctagtctgaggaaactaagcatgaaagaacgtgagcacagagaagaggagaggcaggtgtcagaggcagaggaaaatgggaaattggatatgaaagaaatacacacctacatgtgagttcagaaactgaaccccaccctcttgggaaacgcccattggagtgttgtttttaacctttgtacaatgtttagacccagtaaatgcagaaatagaaacaaatggtcagaagacatatcgtgagagagagagagttcacaaaacagaaaacaaagtaccttaatatttaccagtgaccaaaagatgtgaagtagcaaaacggctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctgtttctgccctgtgaaacacggtaaagatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagactgtacagttttttttgtttttgtttttgtttttgtttttctgagatggagtctcgctgtgtcacccaggctggagtgcaatgacgtgatcttggctcactgcaacctccgcctcccaggttcaagtgattcccctgcctcagcctcccgagtagctgggattacaggtgcctgccaccacccccgcctaattttttgtatttttagtagagacggggtttcaccgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggatagttcagtgctgatgcagatgatgccacggcccttagactctctcaacattcaatttctcatgtgttggctttttcagatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtgtcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaatactgcagtccttatgttattgctttgtttcaatatctggtatgattgcctgagggacctgaggtttttaatcgtaggggtttttttaatctttagaagtggttggttatgtaaaatattattatttgttttttttttgagactggagtttgctctgtcacccaggctggagtgcagtggctcgatcacagctcactgcagcctcaacctcctgggcttcaagcaatcctcctgccccagcctcccaagtagctgggatcacagatgtgtgccaccacgcctggccaatgttaaaaaatcctttaacttttttgtagagatgcactcctggactcaagcaatcctcctacttgtcccgaccaccagcctctttctgataaacatttacactgtttattatctgatgccatttctatcttcttccttgtcatccagacatcaaagaattaggtttcttcagggttttctttttcaagtgctcagtgttaaagatcactcacattagggccagacaccacggctcatgcctgtaatcccagcactttgggaggccgaggcgggcagagcacttgaggtggggagtttgagaccagcccggccaacttggtgaaaccccacctctactgaaaaaatacaaaaattagctgggcgtgatggtgcatgcctgtagtcccagccacttgggaggctgaggcatgagaatcgcttgaacccaggaggcagaggttgtagtgagccgagatcacatcagcacactctagcctgggtgacagagcgagactgactcaaaaaataaataaaataaatatcacttacattagatatacccaaggggtggtctatagagacttggaagcagtggttattgcaacaggggcacggaagtcatctggctatgccagggtgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaagctctctcctggccctcctctcttgccaggactatgggtgactgaagacccccagggaggcacagcatcctcttatctaagattttttttttttttttttttaagagacagggtctttctctgtcgcccaggctggactgcagaggcacaatcatagctcacggcagccttgaactcctgggctcaagcgatcctcccacttcagcgtcccaagtagctgagactacaggcacacgccagcatgcccggctggttttttaatttgtatttcctttgagacagcgtatctctctgttgctcaggctggagtgcagtggctcaatcagctcactttagccttgaactcctgggctcaagtgatactgccacctcaacctcccaagtctgctactacaggaacacaaactccttttttaaattttttatggatatggggtcttactatgttgcctaggctggtctcgaactcccaggctcaagcagtcctcctacctcagcctccccaaatgctgggattacaggtgggagctactgtacacctggccttatctaagctgtttccctgaaaatccccgtcttgggtaatgattccattggccccaccatgccctctgccttcctggctgtgcccaagcttggtccctgcctgcctgcctgcctccctctctgggtcttgagctcctgtgacacatgactcctctctcttcctggagtgatccaagccctgccacttcctgactttgcccacactgtaccctctgcctggggcaacttcatgtctgcccattgtcccttaggcctcagcccaggcacaagcccctgcctccggaggtcatccaggcctcaccaggctacaccctctcgtaaaattggattccctcccttcagggcaggtttataatgaaatcctcctcagaggccaggtgcggtgacacccatctgtaatcccagcactttgggaggctgaggtgggaggatcacttgaggccagggggtcgagaccagcctgggcaacataagagagactcttgtctctataacaaatttaaaaattagtcaccaggccaggctcagtggctcatgcctgtaatcccaacactttgagaggccgaggcaggtggatcacgaggtcaggagttcgagagcagcctgaccaacatggcgaaaccctgtctctactaaaaatacaagattagccaggcatggtggcacgcacctgtaatcccagctactcgggaggctgaggtaggagaattgcttgaacccaggaggtggaggttgcggtgagccaggatcacgccattgctgtccagcctgagcaacagagcaagactctgtctcgagacaataaaaacacacaaaaaattaactcgccatgatggcacatgcctatagtcctagctacttgggaggctgaggtgggaggattcccttcagcccaggagtttgaggctgcagtgagccactatgattgtgccactgcactctaacctgggcaaaagcgagaccccaggctagagtgcatgattttgggtcactgcaacctccacctcccaggttcaagtgattctcctgcctcagcctcttgagtagctgggactacaggcatgtgccaccacgcctgggtaatttttgtatttttagtagagacagggtttagtagagaccatggtgaaaccccgtctctattaaacaaatctctactaaccccatctctacaaaaaacagctgggcgtggtagtgcacacctgtaattctagctacttgggaggctgaggcacgagaatcatttgcatcttggaggcagagtttgcagtgagctgacatcgcaccactgcgctccagccgggatgacagagcaagaccctgtctcaaaaaaaagaaaaaggaacaaacaacagcaacgacaacaaaaaaacctctgtgtcaatcacagcctacaagctaggggagaggcggccgaattctgccctctgctaactaactatagctttgtggaaatgggtgaatggcgtgcccttgtgagcctcagggccccatctgtaaaatgggcataactgtcatgcccgtctttaagaacagccttgggggtaaatgagtggaagtcatggaaagatctcagcccacaaccttccacagaacagacgcttctcacacagtaagtagcaggagtgcagaggctgcaggcatgaatccagccagactgcctgggttcaagtcccagctcccacgtcttggtaactatgtggcctcagacaagttacttaatatttctttttttttttttcagacggagttttgctctgtcacccaggttggagtgcagtggtgtgatctcggctcattgcaacctctgcctcccgggttcaagcaattctcctgcctcagcttcctgagtagctggaattacaggcacctgccaccacacacagctaatttttgtatttttagtagagacggggtttcaccatgttggccaggatggtctcgaactcctgacctcgtgatctgcctgcctcagcctcccaaagtactgggattacaggcgtgagccaccgcacctggacacgttactgaatatttctgtgcctaggtttcttcatgtgaaatgggattgttgtgagaacacaaagggattcccagggcagttcctagtgcatagtctggctgcctttgtatgtgtgtgtgtgtgtgtgtgtgtgcacgcgtgtgtgtgtgtgtgtttaatatagagacagggtttcactctgttgcctaggctcgtttcaaactcctgggctccagtgatcctcctgcctcgacccaaagtggtgggattacaggcatgagtcaacacacctggtcactttatattattattatttttttcttttgagacagggtttggcactgttgtccaggttggaatacagcggtgcaatctcaactcactgcaaactccgcctcccgggttcaagcaattctcctgcctcagtctcccgagtagctgagattacagacgcctgccaccacacacagctaatttttgcatttttagtagagatggggtttcaccatattggccaggctggtcttgaactcctgacctcaagtgatctgccggcctcggcctcccaaagtgctgggattacaggagtgagccaccgctcctggccaattttttaaggcaacgttttcagcccatggccagggtaaggcacagctagtaccaagatctggcttcactggccatgttatccaagaggcctctgcctgcctgcaaagtagtactgcacactgggatctccctggaccaaaccccagcttcagttttgggtacttcctcataagccttgactaccccagagtgtgagggattttgcagcctggtcccaggcatgcactcaccagtcaatggcatcgcggggctggccatggcctcccaagccacaaaagcaaccatatttcacataggcgatgggagttcagggaccaacacaacccacaattcctgccagttccaggatcccacgccggtgcacacataatatcctggaggctggggggtaaacaaaggtgacaggctgcaggtcagggcttcccagacccctgggaagggcatgagcctgagaggagcctaggtgttacagcctggctgtctgggtttgaatcctacttcctggctgtgtgaccttggacaaattcctaacctctctgggccttggtttcctcatctgtgaaatgggggataagctgacttcaactcatatgaatgaaatgagataatgagtataaagcccctggtgcatgaaaaggctattataatccggctgggctcagtggcttacacctgtaatcccaagattttgggaggcccaggcgggcagatcacctgaggtcagcagttcaagatcagcctggccaacatggtgaaaccccatctgtagtaaaaatacaaaaattagccgagcatagtggtgcacgcctgtaatcccagctactagggaggctgaggaaggagagtcacttgaacctgagaggcgaagattgcagtgagccaagattttgccactgcattccaacctgggcgacagagcaagagtctcaaaaaaagaaaaaaaaaaaaaggctaactattataatcaaggtcctcaaggtagccaaggagggaaaagagtcgtgcatgaaacctttgtccagttccctgtgttgggcactcggcatcatatgagcctacaggtgtctgtcaccaaggtgggctcctctgtggcagctcccaggccctggcactgccctgtgctcatgacttttcctccagactcaggctcagggcccttggtatctcctcttattttcactgccagataggaaggccccttggactgagcccagccatttatctagatcctggcacagcttggacatgtaatggtgcccaatgcatgtgactggaacccctgcattggacatgtaggaaacgaggccagccgggaaaggtaaccccacattcccacagccagcaggaactcaagcagaggcttcaacccaggcttctgacttgcaaaccagtgctccttcctccttacacagtaacaacaggggaaggtggccttccaggttgccagagccgagtggtaccagcaatagagtggaaactcacacacaggcttgcctgcttcctggtttaggtttagggtttatacggctccgggaggttgatgcattgtgtttgatcatccccttttttttttttttgagacagagtctcattcctgttgcccaggctggagcacagtggtgtcatcttgctcacaacagctccgggaggttgacgcattgtgtttgatcatcccttttttttttttttttttttttttgtttgagacagagtctcattcctgttgcccaggctggagcacagtggtgtcatcttgctcacagcaacttctgcctcccaggttcaagcaattgtccagcctcagtctcccgagtagctgggatcacaggcgtgccccaccacacccagctgatttttttatttctagtagaaacggggtttcaccatctaggctgggccggtctcaaactcctgacctcatgtgatccacctgctttggcctcccaaagtgctgggattataggcgtgagccactgcgctcatcctgatcatcttgtctctctttttttaaatagagacagggtctcactctgtcacccacactggagtgcagtggcacaatcatagctcactgcagcctccaaatcctgggctcaagcgatcctcctgcctcagcctccagatcctgggctcaagcgatcctcctgcctcagcctccagacatacgggcatgcaccaccatgcccagctaatttttaaatttttagtagatctgcggtctcactatgttgcccaggctggtcacaaactcctggcctcaagtgattctccttccttggcctcccaaggtgctgggattccaggcatgagccaccatgcccagtctcatttctgttttatctagaacatgttttcatcacactgacttttttgagaagtccaggccaattttaaattccattttgtctttttatcagtggaaaagtagcatatttatgttgcacgacaaagatgaatcaaataggaagaaaatgtaaaacacatttggggccgggcacagtggctcatgcctgtaatcccagcactttgggaggccaaggcgggtggatcacctgaagccaggagttccagaccagcctgaccaacacggagaaaccctgtttctactaaaaatataaaattagccacgcatggtggcacatgcctgtaatcccagctacttgggagggtgaggcaggagaatcgcttgaacccgggaggcagaggttgcagtgagccgagctcgtgctatcacactccagcctgggcaataagagtgaaactccgtctcaaaaaaaaaaaaaacacacgaaaataaaacggcatttagagttgaaagcttcaccttcctctctggatggtgagtcctcactctcccagcagcccacacctctgcctcaaacctccatggctcccatgagtctggttaaagctaaggagtctcactgcacctcaagtcctgggggtagtcagcccctctcacccctccctcatcctctcacacaagagtcatttactgtccctccagttatgcccggtcacgcagacactctgctgctcaaatgccctcaccccatcctcagcctgctcccaggccacctccctccagaatccaccctgcctgccaggtggtcatagggaccctcgccatactgtctgcttgtggcagtgccctccagcctggggggtcttccagagcagatctctggccaagcgcagtggctcatgactgtaatctcagcaccttcagaggccaaggcaggtggatcacctgaggtcaggagatcgagaccagccttgctcacatggtgaaaccccgtctctactaaaaatacaaaaattagccaggtgtggtggtggtgcatgcctgtagtcccagctactcaggaggctgaggcaggagaatctcttggacccgggaggtggaggttgcagtgagccaaaatggtgccactgcactccagcctgggcaacagtgagactctgtcttaaaaaaaaaaaagaaaaagaaaaagagcggagctctgatataagctgccctggcacacagtgagcttccagaaatggtcccttgacctctaaatccaccaagacccagggaacatgccctctctgagcactctgacaatgatttgcatttctctaatgaccagtgatgatgagcttttcttcacatgtttgttggccacataaatgtcttcttttgagaagtgtctgttcatatcctccggccacttttggatggggttgtttttttcttataaatatgtttaagttccttgtggattctggatattagcccgatggatagattgcaaaacttttctcccattctgtaagttgcctgttcactctgatgatagtttgttttgctgtgcagaagctctttagtttaattagatcccatttgtcaattttggcttttgttgccattgcttttggtgtttcagtcatgaagcctttgcccatgcctatgtcctgaatggtattgcctaggttttcttcttgggtttttatggttttaggtctaacatttaagactttaatcaatcttgagttaatttttgtatcaggtgtaaggaaggggcccagtttcagttttctgcatatggctagccagttttcccaacaccattttaaatagggaatcctttcccattcttgttttttattacaactttttacctaaacattcaataattttcactaactttttggcaatgaggcagctgagtctaagtaggttaaatcacttatctgaggtcacacggcaggacagtgcttgttctgcaaagttaagtgtgtttctttttgtggaccatgagaacatctccaactgccctttttgacttggccaccagggaactcagcgccatgttctcaaatccagtttagtaactggccttctggcctgtatatctttattctaccttccatcctgctctgttctgcttttacctcttattctagattatctttctttagtcctaattttaaatttatatctataatcttgttatatatatttcttggcatctactgtaagtgggtagtgaacgaataaacaaaatgtgatgaattttagaggactaagaggggcctaagtcacaccaagattcatgctggataatttgtcatcgacccagactgtggttctgcactcgccagtaaccagtttttttttttttttttttttgctttttgccaaccatacattttgctttcatggtatcgaagtggtttaagcttatggcttccagcctgcagtggctatgaggggtcagtctctcatcaggaggggttggcagactctgttctcagataggcagcaaggatggaggtggggcaggagcaatttcactacctgcctggcgtctgggtcttgcttagagaaataattccaggctctgctgctttcgactctgtctctcatggttccactgattcctgcagagatctagagagaaaatttccagcgaggagtttctggctcgtttgattttgaacacgttttgagtattccaccccttacccccccgcccccactcactactctgtagtttttttttttttaagaaaacagtttgaaagcacaaataaataaataattcaaaacagaggggccatttttatttactttggttgtttcaggagagggaagggagcttacactttttttgaactcttattctatgccagccgatgtgctgcattcttagcttaaaagcctgcttctctttgatttcagaataacttggaaataaatgatcagaccctgcatgctctgatcctggctgtctgctctaactaaatctcctcttccttgcttcctccagcgagttgttctcccttcacctcccagcacaagctttgcacgtgttgccgtctgtcctacaaaggtctgtcccttcccagtctccgtgtgactccctccttcacacccatggttctccactgaaatgtcctttgagcacgtctcagatgcctcagtctaaagtagatgattctgggctgggtgcagtggctcacgcctgtaatcccagcactttgggaggctgaggcaggcagatcacctgacatcaggagttcaagaccagcctggccaacatagtaaaaccccgtgtctactaaaaatacaaaaataagccaggcatggtggcgggtgcctgtaatcccagctacttgggaggctgaggcaggagaatcgcttgaacctgggaggtggaggttgcagtgagctgagatcacgccactgcactccagcctgggtgacagagcaaaactctgtctcaaaataaataaataaataaataaataaagtagatgattcacagaaacctctgttcttttagagcactcttcaacactttttatgctttttatgtttgatttctaataaatatgtttctttcactataccataagtatattccttcttctaagtttcattaaggtagaatcacgtatgtcttatttcctgttatatccctaagtacctagcatgtagtaggcattcaataaaaattgattgaatgattgaacactcaatcccatgatttgagtgttttttttgtttttgtttgtttgtttgttttgagacaaagtcttgctctatcacccaggctggagtgcagtggtactatcttggctcactgcaatctctgcatcctgggttcaagtgattttcttgcctcagcctctcaagaagctgagactaactacaggcatgtgccaccatgcccagtgatttgttttgcatgtgtgtgtatttttagcagagatggggtttcactgtgttggccatgctggtcttaaactcctgacctcaggccatccaccctccttggcctctgaaagtgttgggattacaggtgtgagccaccacgcctggccttttgtaattattctaacagctactacttattaggtgctgactatatgccaggcactgtgccaattgatttatttattttcagggattgggtcttgttctgtcaccatggctggagttcagtggcacaatcatagctcgctgaagcttcaaactcctggggtcaagcagtccccctgcttcagcttcccaagtagctgggattacagagatataccattacactcagctaattttaaaaaatggctaattttttttttcagagatggaaaaaaaacaaaaaacaaaaaacagctactacttattaggtgctgactgtatgccaggcactgtgctgatttttttttaatgttttttatttttttagagttggggtctagttctgtcaccatggctggagttcagtggcatgatcatagctcactacagctttgaactcctgggcttaagcaatcttcctgtctcagcttcccaagtagctgggattacaggcatgggctatcacacccagctaattaaaaagacattttattgtatagataggggtctggctgtgttgcccaggttagtctcaaactcctggcttcaagcgattctcctgcctccacctcccaatgtgctggtgttacaggtgtgagccatggcacctggccctgtgttgatgttttacatacagcatctcatttaatccccaccaggatcctgtggggatggattggattatcccccactccttggaagagcttaaggatacccaaccagttggtgattgagctgggatttgaactcaggcattctaatggcaaagctgtgccccttccactctaccatcgtgttcctctccaggggaggtgtccctgcagtgctgtgactttgtcgtcgaacatgtgctgaggtacgtgaatcctctggagaagaagggcaaaggaacaggctttccaggcaggaagcccctgcaggcgagggaggaaggctgcaagggacatggtaggaggtatcttgctccccatagctgggctgggaggatgagatggctgagagccaggagccgggctggggttaggctcatatcagcctgcagagggctttggggaacccaggctttggggccagacaaacatagcttctcacccacctgatcatttcctctctgttgtatcctatgtttctgggtctcagtttccttatctatgaaatggggataccatgacctgttctgcctgcttcatagagtgctaaggagcagatgacataacgtgtgcaaaagcagctgttcttatttctatcacttattttcattatcgctattctcaagcaggcagacggtaattttttacctctttcttttttttcacccttgagttgtttggaagttatttttaaaagtctttgaagtgtccttttccatatttggcaaaagcaaaatggaaattgatagcattgtcaccgtcggcatcccctcactccggccgcctggctgggggacagctctgggaaaatgtggagatgtctgttgtgggcgactggtttgttattgcgtgaacttttctggcgagacctgaccagctcccttttaaggcaattcctcgtgttcttgttcctcctcttttcttttcctgccaatgtcaggtcctttgtgccatctccaggctcagaaatccgtacagccagagtcggtccccagtttggccacttccagctgaaaagctttcccatgccttccctttaacttagaatagcatccaaatccttcattgtgaccaaggccctgtgcagtctgctcctgtcactttcctctccattactcagctccaaaagtgtcacctcccttgactcctccaatgccccacatggtttccagccccagggtctttgtggggtctttgccaggaatcctgttccccgtttttttgttatgggtagctctttctcatctttgacatctctgctccagagtcaacttcacacatggctcttccctaacccacactaaaaaataagcctccttaaagaaaaaaaagaggctggacgtggtggctcatgcctgtaattccagtgctttgggagactgaggtaggaggatcacttgagaccgggagtttgagatcagcctgggcaacacattgagaccccatctctacaaaaaaaaaaaaaaaaaaaaaaaaaatagcgaggcgtggtgctgtatacccatagttctagctactctggtggctgaggcaagaggattgcttgagcccaggagttcaaggctgcagtgagccgtgattgcaccactgaacaccagacgcagtgtcatgtacttgtagtcccggctgcttgggaggctgaggtgggaccatctcttaagcctgggagtttgaggctacagtgagccctgatcatccctgtgaatagccattgcactgcagcctgagttacacagatacgtctcttaaaaaataaatgaaaagaaaagccttttaaattcagtgtcttcgcatagttagtccaaccttaaggagtgttaccagatacaaacaggatgcccagttacatttttttttttttttttttttttgagacagagtctcactctatcccccaggctggagtgcagtggcatgatcttggctcactgcaacctctgcctcccaggttcaagtgatgctgatgcctcagcctcccgagtagctggaattacagacgtgcaccaccaggcctggctaatgtttgtatttttagtagagatgggtttttgccctgttggccaggttggtctcgaactcctgatctcaggtgatctgcccaccttggcctcccaaagtgctggggtgacaggcgtgagccaccatgcctggcaaaactttgtagcccagtttgttctatttttttttttttttttttgagacagagtctcgctctgtcgcccaggctgtagtgcagtggcatgatcttggctcactgcaatttctgcctcccgggttcaagtgatttccctgcctcagccttccaagtagctgggaatataagggcgtgccattgcacccaaatttgaaccttagataaacattgaataattttccagtattacatcagatacataacttgtatttaaaaaatcattccttatttcactggatttaaaattgaattgggtgtcgtatatttttacttgttaagtctggcaaccctaccctctagagagaggtgttgaatgaatgagtgtgaagtccttagcttagggcctggcactcagtaggtgctaagtaaatgtcacctgtcagcatcttcctcctcctcttcttcctcctctagttgcttctcggagctaaggtctccctgctccttttttcctctatggaaatggatgagaaaaggttttctaacaaggggccatcacctggatttttagaatagcataaaatattctctgctgcagcttcggaatccgactgtgctggtgtttggcaggaaaatgcagtgagttatcacagagcgttccctccagcactgggtcatgcaaatatttattgcgagcgttaaataataaatggagcagcctgcccaatggtaaatctgtcatgtttggtttcagccaggagttgtgatggctctggaatcgctgcccgtttcaccgcatccacctgccctctagaggagcaaggcaaacagccgagttctctggggtggcatcagtgggctggtgtggaagccagaggggcggtggggggagtcagccaggcatggaaactggcaggtaaggcagccctgtggcccaggaacctgagccgcagccacaccgagcaggcctggacctttgagtcccgctgccaccacagttctcaggggacacggtctcattgtccacatctggatttatctttccgtatttccctcattgctcttgtcagcttcactctggctgactggctggagctggcaagcttctgaaagtggagtcaaccttccgaccctttttctaggctgagtggtgggtggaggaatgagaccgtgtgttggactcaaactcgatgcaataacgtttcccagcccctgtggtgtgctggggctcctagcacacatcctcttgtttaacctcagcattgcaacctgaaacacagacacatgggttcttgagccagatgcctctgagttggaatcctatctctgcacttaacaagcggtatgaccttgagtgagccacagtttttcagagcccctgtttcctgatctgtaaggtgggggagatggtggcactcaccttatggggctgttatgtattagtccattgaggtgtcttagcctgttttgcgttgccataaaggaatacttgagggtgagtaatttataagaaaagaggtttgtttagctcacgttctgcagactgtacaagaagcatgatgccagcatctgcttctggtgagacctcaggaagcttttcttcactgtggaggatgaaaggggagcaggtgtgtcacatggtgagaagaggggtgagagagagacaggaagggtgccaaacacttttttaacaatcagacctcgccgtgaactaaaagagtgagaactcactcattactcagggagggcaccaagctattcatgagggatctgctcccaccacccaaatacctctcgccaagccccgcctccaacattggggatcacatttcaacatgaggtttggaggggacacacatccaaactatcttatgaggtagtaggataatgtaggtgaagacttgcacagtgcccgggacctggggacaaatgctagctctaatggttaataatggtccagagaagaaaataactgctcagatgcacagacatgactgcactagtcaaccatgcaggtatgagtccccatcctagagtatggggtgcatagagctctagcccaccattattgagttgtagaactaaggctccaatctggggctttatggatccctaaatcatgccctttcaccttccccatatctgctttattcctcatagggtggcagggagggtggagctcatgcctggccttaatcatcatggcctaagtttggtagtgtccaaacagtggtgaggggtgaagttgtagggttgccaggtaggttgtgtttggcttcaaatcactgagaacccaactggaagtggtgtagatgctaatggaagttattgtttctctgcagggggccatgtggttaattgattcagtggctccattgtggaatggtgggccttgtttccttccacttttccactattccattcttagcagctggctcttgccctcagccacaccccatcatggtctcaagataatatggacaagagagaagagagccttcttccacttgttccccgcttgtttttgagacagggtctcgctctgtcacccagactggagtgtagtggtgcaatcatagctcgctgcagccttgaacttctaggctcaagtgatcctccttcagtttcctgagtagctgggactataggtgcatgctaccatacccagctaacttcagagttttttctagagatgaggtctccctctgttgcccaggctggtctcgaactctgggcctcaagtgatcctcttgcctcaacctcccaaagcactagggttacagatgtgagccaccacgcccagcccatctgtccctttttatgatcattttctcattttctcagaagctgccagctgacttctccttcatcgcattggtcagaaatgtatcacgtgcccttttctaagccagttgctggcaagggaatggaattcccaaggttgccttagaccagtgcttcttaaagtgagatccccaggccagcagcatctgccatgtctaggcaattttaagaactgcaaattctcagaccccagttcagacctactaaatcagaaactctgggggtgggatctatgtttttatttatttatttactagaatcggggtctctgttgcccaggcaggagtacagtgacactatcatagcgcattgcagcctccaactcctgggctcgagcgatcctcctgcctcagcctcccatgtagccaggactagaggtgtgcacccccacacccagctaatttttttattttttgtagagacagggtcttgctatgttgtccagtctggtctcaaactcttggcttaaacaatgctctggtctcaaactctcagcctcccaaagtgttagaattacaggcgtgagccactgcgcccggcccatagtctatgtttaaacgtgccctccgggggtttctgatggacactgagtttgagaacctctggtttcctaagatcttttcctctgaagagccagagaataaatatttcaggcttgtggccacacagtttctgtagcaaccactctgttctgctgttgcagtgtgaaagcagctatagatgataataaataagtgaatgggtttatttatggagactgagatttgaatttcacctaatttttatgtgttaggagatattattacacttttgatcttttctaactacttaaaaatgtaaaagccatttccagctcctgagccgtacaaaagcaggtggtgggccgggtttaggcaatggtttgccagccctccatcagactgctcaagattcatcccctgaaactggggagagtctaatagtcttaaaacacagagagccccagattctttagaaaattggaatttgggctgggtgtggtggctcacatctgtaatcccagcactttgggaggctgaggtgggaggatggcttgagcccaggaatttgaggccagcctgggcaacataatgagaccccatctttacaaaaaataaaaataatagtcggacgtggtggcatgtacctgtagtcccagctactcaggaggctgaggcaggaggatctcttgagcccaggagtttgaggctgcagtgagctatgatcacgccactgattgcagcctgggtgacagagcaagacactgtctctgtctaaaaaaaaaaaatgaaatttgggccaggcgcggtggctcatgtctctaatcccagcactttgggaggccaaagtgggtggatcacctgaagtcaggagttcaagaccagcctggccaacatggtgaaaccccatctctactaaaaatgcaaaaattagctgggcgtggtgacacgtgcctgtactcccagctactcgagaggctgaggcaggagaattgcttgaacctgggaggtggaggttgcagtgagccaagattgcaccattgcactccagcctgggtgacagagcgagaccctgtttcaaaaaaaaaaaaaaaacaaaaagggctgggcgtggtggctcacgcctgtaatcccagcgctttgggaggccgaggcgggcggatcacaaggtcaggagtttgagaccagcctggccaatatggtgaaaccctgtctctactaaaaatacaaaaattagccgggcgtggtggcaggcgcctgtactcccagctacttgggatgctgaggcaggagaattgcttgaacctgggaggcggaggttgcagtgagccgagagtgcaccactgtactccagcctgagtgacagagcgagactccgtcaaaaaaaaaaaaatactgataatgacagtgctaacagcaataatagatagctaacaagtgtggagtgcttatccatcttctagtccccaccttcctttagcccaggagttcgaggctgcagtgagctatgattgtggcactgtactctagcctgggcaacagagcaaggtcctgtctctaaaaaaataaaagcataaaaataaaataaccaaactttttattaaccttctacccccagagggccccctccctcaaatagctcattaactagacctggtttgcatgcccaccccctctagggactgagcccaacttctgagatagggacccttgaaagaactggggttctgttagcaagaagaattaagacaagaggatgacttttggtgttgacagtgtctgcccctgttttttgtttgtttttttgagatggtgtctcgctctgtcacccaggctggagtgcagtggcgtgatctcagctcactgcaacctctgcctcctgagttcaagcgattctcctgcctcagcctcccgggtagctgggattacaggcgtgtggcaccacacctggctgatttttgtatttttagtagagacaggatttcaccatgttggccaggctggtctcgaactcctgacctcaggtgatccacccgccttggcctcctaaagtgctgggattacacgtgtgagccaccgtgcccagcctgccacagttctttacacatttgatctttagctcacccaacaaccttgtaaaaatatgattgctacccataattttcaaataatctacgtatgcgtaagagagagaagtgattccccaaagatcacgcagctaataaagtggaagggagaacccaggcccacctggctccgaagctcacactctttccactaagctgcctgcttctttcattggaatagaggttctcaatcgtgaatggtaggagtggggtgcggtgaattttgaccctcgggtgaaatttgaaaatgcttggagacatttttggttgtcataattgggagaaagggtgtgatattggaatctagtggatagaggccatggatgctgctaaagtttttatagtgggccgggcgtggtggctcatgcccataatcccaatattttgggaggccgaggtgggtggatcacctgaggtcaggagttcgagacgaccctggccaacacggtgaaaccgcgtttctactaaaaatacaaaaattagccaggcgtggtggttggtgcctgtaatctcagctacccgggaggctgaggcaggagaatcacttgaacccaggagacagaggttgcagtgagctgagatagcgccactgcactccagcctgggcgacagagcgagactctgtctcaaaaaaaaaaaaaattatagtacataggacagccccacaacaaagaattattcagcccacaatggtgccaaagttgagaaaccctatatactaaaacaagctctttgagggcagggatcatactaccttgactaccttgttcaattctcaatcctttataccctgcctgtcctggcacattgtaagtgctcagtaagtaatgactgagcaactgagcagatgtgctacaccagattccagagtcaaataatcatagacttggagaagtgcagggttatgggggctgcagtataacactctacctcacagtgggtgcatccaagccaccagcttcccctggttccagaaggcctgttagagacatgtcttgcatttgcacttggtccagcacagcccatgcctcccacttgtgaaaagaggctgactgatgggtggtgatcagggttggctgccttttcatttttgagatcatgggaacagagggaccggatgaagaaacacttctctgaatctacccatttctaaatggatgaatcaccaaggaggaaactcaaagattaatttctcactgcccttcttcccttgctctgctctttgtagacagttactggtgctccagggcaaaagataatgaaagttcttccttgcatcaaactattttcttcaggagatagagccagcattagccaaagagatggtctgggctctgggagcttggcttggaggcccaggacattcaaacagtccttcccggagaacaggctggacctgcagtgatgaataattattttgcaattgacagttcaatacccaccagattcttcattgtatgtttctgtatcgtgtcaagttatgagaaaacgcaatattctttaacagctaggcaagaacaatggtttttgctcatttgtttgtttgtttccaccccgcagaggtcagtttttgcagtaagaagagtctcattctttttttattttattttatttgtattttgagacagtctctctctgtcatccaggctggctggactgcagcggctgcaacctccatctctcaggttcaagggattgtcctgcctcaaacttctgagtagctgggactacaggcatgcctacgccctgctaatttattgtatttttagtagagacaaggtttcaacatgttgtccaggctggtcttgagctcctgacctcaagtgatccacccgcctcaccctcccaaagtgctgggattactgccatgggccactgtgctcgtgactcttcaagaagagtcttgaatttactctgaatgtgtccttggttggcacaaccacgagcagaatatgcatcctatctatcctcacaaacactgcgtttattatccccaatttgcctttgaggaaatggaggctcagagaggttaaataacttgctcaaggtcacgtgggcaatgagtggtggagtggagatttgaactcaggactgtctgtgaccctcccagccctgcagtctccaagtctccagtactatctggctctaaaatccgtactattccctctgctatgtttttgtggcgacttgaactcttccttcaaagtcttggctgctgctatgaactgaacgtgtaccttgtgaagttgtattttttccatattgtaattccatccttcaaaagtaagtcttgttactgaaagactgtttcaaccgtcctggggtaggagtggctaacaggttggcttgggtcccacagtgaaatctgttctgagccagaccctcccgaggggacaggggacgagcaggagagattgtagctgaagtagacatctcctgggttcccagaaatgtggaagaaccttgtgcaaaaacagcttcctgcagagctgcaagatgggatccaggttattggtatttgagcactgtgtttaggggctatgagagaaacctaacatgaaccggctgaaggaaaaaagtggaggattacatgaaaatgaattcagggagcttgcaggtgtactgaagggaagtgtgagctctaaaagctggaaaaggtctaaacgtgtagattacaaaaatatctgcagcttagcatggcaatgacggataaagcgtcagatatgtgtttgtcatccagttgtctatggctgtgcaacaaaccacccaacatgtagtagcttaaaacatgacagtcatttattttgctcacacatccacaatttgggcaggatgttgaggggacagttcgttcctgctccacgtggcatcagctggagctcaccagggggctgcagaattcatttctgagatggctcctctagcggttgctaagttggcgctttctggttggctgggagctcagctaggctgtggtccaggggacttggttcctttgtttgggcctctcctctcttcagctacttgggcttcctcatcgtatggtggctgggctctaagacaaggagaacccagtggaagctctgtcacattttatgatgtagccttggatgtcgcataacgtttcttctatattctattggtcaagcaatcgcacagtctggattcaacggtagatgacataggttctaccttttgatgaatcaaaaaattctgggatcatggtttgaaactaccaaaaagtagcggctgtattgtttgttattattacaaagtaggccgtgtgcagtggctcacacctgtaatcctagcactttgggaggccagcctgggcaacataatgagacccggtctctaaaaaaaaaaaaaaaaaaaaaaaggagagagattagccaagtgtggtggtgtgtgcctgtagtcccagctacttgggaggctgaggtgggaggatcacttaagcccaggagatcgaggtggcagtgaactatgatcacactaggctgggagacagagtgagaccttatctcaaaaaaaagttaatgataattactacaaagcaaggccaatagtacaaaaacagtgatctttcacagtctatgatatagcaggacagtgctagatgttccccatctgctatgccatttattcctccccaaaatttgggaagctcagggaggcatataaactgcctaaacagggccgtgaagctaggaagtgctaaagccaggatttaaacccagaagtcaaatgctaaagactctgctagactgactacctgattctagaggctggggtgtgtgctaggtatctgaaagattggagagatgcagacagaaatgtgtgaatgtgagtgtgcaaatttgcacaaggccagtagcacctaagggggcccatgtgggagatgggagggtccctgccatctgcttccttctcctcatccatttcaccctggtcttctcagccctcccctctcctccatgcccctccttggtctcttcccatggaccctgtgagagcccctctccagctgtttatgggagatgttgaaggagaagcaagggctcctcacgaccctgtctctgcctctttcctgtgctctgggacatctgaactgtcacatagtcagctggcagggaagcccaattttcctttggctctccaaagggcctgattcatgggttaggctgagatcagatagagcccttgggtcaggtgggtgggattctggctcccagggctgctggcaggtgccatctggttgttctggagggagttgaggggaatggttcccacctggacagtgtctgaggggtgagctggtgaagcactgggcgggtggggagctggcagggacgggacagatacagagagtgccaggaggtgtggacagctgctcgcagggctcttggtgactttgccaggaaactgtgtctagacagcctctgtctgatctctcttctcatcccacatcatctccccggttcctccctggcctgaggccgtcctgccaggttggtgcagggatatgttgaacaaagttcagatgtgctgtgtgcacagtaccaggctcagcatagtctgagaatgaaaagcagcttctgaaactcagccctgcctcaggtgcagggagctgctggtcttgccaggaggcttaatgcctggatcaaatatgagggggctggctgggcatgatggctcacactcgtgatcccagcactttgggaggctgaggtggtgggaggattgcttggggtcaggagttcgagatcagcctgggcaacatggtgagactctgtctctacaaaaaaactaaaataaaaaaatagtcggatgtggtagtgcacatctgtggtcctagctactggggaggctgagataggaggatcacttgagcccaggagttcaaagctgcagtgagctgtgattgtgccattgcactccagcctgaatgacagaggcagaacttgcctccaaaaaaaaaaaaaaaaaaaaaaagacaaatatttgggggcttccccagatagacgtctggtgctatggtctgaatgtcattgttccccttgaattcatatgttggaacttaatacccaatgtgatagtagtaagaggggccccttaggaagtgactaattcatgaggaatccaccttcatgaatgggattagtgcccccttttataaaaggggcttgagcaagcgcctttgcctcttttgccatataaggacacggcaacaaggtaccacctatgatgcagagtgagccctcctcaccaggcactgaatctgcaggtgccttgatctgggacatcccagcctccagaactgtgagcaacacacttctgtcatttataaattacccagtctaaggtattttgtgataatagccccaaaatatgacacccagagagtgtgggccctctagaggtcatttcttccaggcccctgccagatgctgagctcagcctgcaaccccaggctgttgaaaatccgaggaggctgaggtcagggagggaggcaggaggccagcaggccatcagggaagggaccccagtgggctcttgaggaatggggaaggggcattaaagggcccaggtagaggcctggagtggtggtggtggccgtgggggtgtgagaagctggtttgggtgaagatgcagggagacaaacagagacccattgggcacggacaggtgctcacatgtttccttgcacctggcatgcttcccctggtgaacactgccaatgtccacccacctgttcttcacccaggtgggcctcgggtctgcagggacacagcaaaggaatgaaagccaggggcaggggtttaaatcctggctctgtctcttttcctccgtgtgacctggggcaaggaaatggtctttatagctcatgcggtctttatgcagttgtcttaggtgatgggggatgagaaagtgccttgtaatcaataaagacagatttattacgataatacaaatttattgatttgtaatcagtaaaggcagattaaccataccatttttttttttttaaatagggtcttgctgcgtctcccaggctggagtgtagtgtcatgatcgtagctcactgcagcctcgaactcctggctcagactatccttccacctcagtctcccgagtagctggagctacaggcgcacaccatcatgctcagctaatttttatttttatagagatggggatctcactatgttgcccaggctggtcttgaactcctggcctccagcaatcctcccatcccagcctcgcaaagtgctgggtttacaggcgtgagccactgcacccagacaggatcaaccgtatcttttgagcatccgttctgtgcctggcaccaggaccagttgctgtgggtcaacagaacagtttcaggtgggtggtggatggaatggctggtgggctcagagctagagcttaggcccctcagctactcctctgggcaggagtgagcagtgctcaccctaccccaggcttaggccacttgcgatgtggggttcctcttcgcgcacatctactgaccctggaactattgaagctattttgtgagtgctgtgccctctctgctgagacacaatccctgtctggcacacccccaacacatcatttgcccctggagtttaactgtactttggtgaagagtggcagaggccagagggaccccaggggtggacatgtgattagcttgatgggcaaccccaggacagagaacagggatggggaaggagatgcttcccactgaagaccccatgcactctgcagcttacaatgctcctaaaaccccgatgctggtttataaactctcttgtccaattgctggggttcaactgggagccttggtgtgtcccgcccctcccccaggctgtcccgttgtcaggcgagaatgaggcttatttctgctcatccaccaagcttgtctgtttccaactgtccattttttttccatccatctatctgcccgtccatccatctttccatcacctcctgtccttaggcttaggggatttcctcttgggaggggaactctttttgcagaaaaggacgctgagccccaaaagctgagtatttcccagcataaatgtctgagccctgttccctgggcaggtcctgtattggggattcagagttgaattggagttgtctcagcctgtgaaggaaagagacctgtcaacagggggtgacaaggagagtttgtagccaggtgtggtggtgcacacctgtagttctagctaattgggaagctgagcagggaggaatgcttgagcccaggagtttgagaccagcctgggcaacatagtgagatggccccatttctacaaacattgtgaaaactagccacgcatggtgacagatgcctgtagtttgagctaatcggtagtctgaggcaggaggatctttggagcctaggggttcgaggctgcagtgagctaggattgtgccactgccttacagcctgggagacagagttgcaagactcccagttgcgatcatttaaaaactgggagactgacatagcatctggcttttagcttctcttaatttattagaagctctgacagcattgggcccatgttcccacgtggagacagttggtggatacaagataggcagctacctccgtctttcaatggggcatgcactccaattcaccacagaccccaccattccctactgcttctcattcctccctttcttcacttatgttatctgcctggactctctacaaggattttcatttgtggttcctgtttcaggaacaggccatggtgtggcctttcctgaccttgtcaagcctcaggttcccagaggggaccaaaatagatactgcacattgtagagggatcagctgaggtaatataggtgaaagctctcaggaagcctaaagctctctgcaatcacaaagctacacaaatagaaattattatcatcattatttataaccattgaaaggacaggagacaaagaagtcagtccccaccatacccctcccaaccccaagcccacaagggtatttgtgccattatgatggcattgatcattgacattgacagttattattaaacgatgtcaacttccaaatgcaaaatgtttaccagatgaactcaaatgggctggcagaaataatgtccaggtgccatctaccttcaactcctcttctcatgaatttctgtggcatttctccagggcccagagtcaataagggagagagaaatgactcctctggtttactgaaggtgtgacttgtgattccagccaatgtcctgttggtcccattgtctcccctgccactacccatgtggagtcttagatcttggagactgtactatgtgggccaactctctcctcaagacacatttattaaaaggtgggtgaagtatcttctcctttgcctgtgtcttttgcccaaagggaagttgattgatgacaatgctcctttttcaagctctgattgccggtggaggttggataaagcatcttgctgtgatctctaagtgggctgtgccttgaaaacatgattgttgtgtctaatcatgtgtgtctgtggctcccttgccactcctggttgccgtgtcactgtgactctatttaacatactttcaggacccactgtatctgtcccgcctctctctggatcttcccaactctgtggttgcctccctgctatattcatggcccctaggggatgccacgtgtgttcggttcttcatgctgttcctctgtctaaaatgttctcttctgtggcagcttcctgcaaacatcttcttctctttccagactttctttgatgattaagaagcttgcacgacctaagtcttataattctgaaaatcatctcctagtttccaggaccccagatgcaccagcatggcttagggaaaggaaaatgacctttggagagagaatctttggagggatttgagcctcggcattgccacttactagctacaccatttgggacatgttacaagcccccctgaacctcagtttcctcatctgtgaaatgggcataatgataggccctaaatcttgtggtgaggcttacatgtgccaatggatataaagtatacatcatcacaatgcctggcacatgatgaaagattaataggggcaattaatatagtgtttgtgatagacccaaagatagactgacccgaggccgaccctgggcaccttttcaactgaaatcccaccaccttatattttgacttctaggtttcctttccctaaaagagaagtttggagaaggatctagaattgttggttaatcaagggcttgctaccttctaatcacttcatgttgatactaggataaagagcaaacatccttcatggggtttacaaggccctccatggccaggaccgtgtttatgtccccagcctcatagtccacttctcctctctccctgggtggtgacacattacacagtaccctcgcacatgctcttttgcccacttaatgcctgctcattcttcaaagcccaggcacttcctctggaagccttccgcagctccctgtgttccttctcgacagagtgtaaccgcccattgggtccaccttgcccgctgcctagacagagctgatttatcaagacagggggattggaatacagagagagtaattcatgcagaggggcattgtgggagactggagtttgattatcactcaaatcagtctccacaagcatttggggagcagagtttttaagaacagcctggtaggggtggttagttgaagccagtgagccaggagtgcagattggtcagggaagaaatcatagggagtcgaagctgtcctcttgcgctgagtcagttcctgggttggggccacaagatcagatgagccagttgatcgatctgggtggtgccacctgacccgtcacgtgcagggtctgcaaattatctcaagcactgatcttaggaacagtttagggagggtcagaatcttgtaacctccagccgcctgactcctaaaccatagtttctaatcttgtggctgattttagtcctaacaaaggcaatctagtccccaggcaagaaggaggtctgctttgggaaagggctgttatcatctttgctttaaactacaaactatgaaccatgaactcagtttctcccaaagttaggtcagcctacacccaagaatgaataaggacagcttggaggttagaagcaagatggaattgatcaagttaaatctctttcactgtctcagtcataattttgctaaggcagtttcaagagcacttactctagtttctggttttacattcatgactgtgttttatttggttcatgtctaattcctccactggaccgagagctccatgatggcaggaaccaagtccgtgggtggccccctgtggtgtccccagcattgaacacagcagcacgtccctcatgggtgttcactacataataatttgttggatgcacaggtggatacatgacttactactttaagaatgtgtgcatttgagatgtttacttggaacaacgaaggcttattcttgaagaaacaacaagtgataagtcaccagaagacagaaaacagcatgttggagctgggtggctcctggtgcctgggaaatgaacccttggggtggttcttggaaggaagtgagcaggtttagtcccatctgatgaactctttcctctccatggttaagttggcttctaactcagggactaagttttatttgagactgaggccactgctggtgggttggttggtctcctccacctttcccttcacccgtaaatgggatattagtgaacgggtggcataacccacctgagggttcttatagggtttcaggagaacagccctcatctcccaatttcctgaactgccatcaagataactgtgtgtgtgtgtgtgtgtttgtgtgtttaatcgagacagagtctcgctctgttgctcaggctggagtgcagtggcatgatcttggctcactgcaacctccgccactcaggttcaaacaattctcatgtctcagcctcctgagtagctgggattacaggcacgtgccaccacacctagctaatttttttttttaagatagactgatttttgtatttttaatagagatggggtttcaccatgttggccaggctggtctggaactcctgacctcaggtgatctgctcaccttggcatcccaaagttctgggattacaagtgtgagccaccacacctggctatcatcaagataactctttaaataagccaaacatttattggccaaaagcaatgcacatgtgctgtcaacaagcaaatttggggaaacacaaagagaatagaaacagaaaataaatattaaccacccagatgtaatcatattagcattttggggcatatgtttctgattctttttaaaaaatatttatgtctctctgtgttttctatttatatatgtattgcaacctgatttttttcattgagcaaatgtaaaatgaacagaaaatgtccaggaaagcaaatgtctcccttctgctggcctggtgtattacacagggttctgtggagggacagaactaataggatagatgtatatacaaaggggagtttattaaggggtactgactcacacggtcacaaggtgaagtcccacaataggccatctgcaagctgaggagcaaggaaaccagtctgagtcccaaaacctcaaaagtagggaagccagcagtgcagccttcattctgtggccaaaggcttgagagcccctggcaaaccactggtgtaagtccaagagtccaaaagctgaagaacttggagtccaatgttccagggcaggaagcatccagcacaggagaaagatgaaggccggaagactcagtaagtctgttctttccaacttctgcctgctttattctagccacgctggcagctgattagatggtacccacccagattgagggtgggtctgcctctcccagtccactgactcaagtgtaaatctcctttagcaacatcctcacagacgcacccaggatcaatactttgcctccttcgatccaatcaagttgacactcaatattaaccatcacacctggtatgacagtactagccttgtcccaagaggcaggagccccagaactgcagagcatctgatagagatgtgaatagtggctttggaaggaatgactgtggccaggtaaggtgacaggtaatggcgaaaacaggcatgaaatcgtggggcagttcaggtgagccattccccaatattcaccaagagataatagggaagggagagagagtaggggtctcaaaagcagggtcacggtgctgataatctgaaaggtagggtctcagagccattgaatgtttcatttattcactcaacgagaatttcttgagtggctaatatgtgccaggtgctgcagcagccagtggggattgtaggtcacaaaaacatgacttcattcaaagcatgcaccattatttacatatgtaaagtgccttggcatgaaatagaagcccaataatctcttgcaaccatagagatgagcattaatgacttttccagaattgcatctatggttggtgattattcctatgtggccaaatgaccagaaggagcagaaagctacatttttgtggcatcttgtatacatagaaatgattgctgtaaatatatgttgactccctttaatacatatgcaactaattgaaagcgggcagtttatggtgtagtatcagtgaaacgtgctctgttgccattaagtatagctttgttacattattgagacaacttgccttgggggcactggggtaagttattgcttcttcaaccatattttggtccttagaggaccaaccgctagtccagcttttattacctgctgtttctttaatcacaacagggaaatgttggctaggcatcggacgggagacttttcttataagatgaaatgagccaagattggaagacgacatttttatttgccttacaaatggactggatacagtgtgaatggcttcgtgaatgagatgaagggctctgctgcgcagcaatcccaaaccattcacccttatgcagaggcagagagcctcctaaatgaattgggttctgttggagttagctgctcttattttcctgtgctgaggagtctggagtgggagggtatccatttcccaaccaataataattagctttgattccaggcaacatgtgcatttttaatccgttaggcatagggtcttcccgggacctatacgtttttcaagatctacagaaatgtttgagaccaaaaacaaacaaacaaacaaacaaacaaaaaacaccacacaaacacacatacacacacacacattggcttaaaaatgcaaaagagaaaatgacaaaattgaaattaatgaatatcttaaaaattacctacgctgggcatggtggctcacgactgtaatcccagcactttgggaggctgaggcaggcagatcacctgaggtcaggagttcgagaccaggctgaccaacatggtgaaaccctgtctctactaaaaatatgaaaatgagcttggtatggtggtgcatgcctgtaaacctgtaatcccagctactcaggaggctgagacaggagaattgcttgaacctgggaggtggaggtggcagtgagccgagatcatgccattgcactccagcctgggcaacaagagtgaaactccttctaaaaaaaaaaaaaaaattacctacaaattgtgctgctttgtcaatatcactaattgttaaatttaacattcctagggatttcattacatctgaaaaatgtggatagttagaatttcccactttctagacctcctgaatatgcacaattaccaagaaatcacatccaatctaaatttaaataaatcacctattgccagataatttcaggagcagaattttaaaattttctcaaaaaatgtttagagccaaaaatccatttaatgtaggatacaggcaaatttgtagcatgtttcaaatgctttctggtgagacctccaaaagtgaatgtgtctagggtatataaaattcttaaaggggctttgtcatccttcttccccactcacccataaaatagatgagataaaagctatttctaagggtggctcttttgtgaagtatttgagctttacggtagatgagactattgtttagtaaatatttgttccctctcctattacatcattgatgttcagctaggctatgtgacttccttttccctgagagatggcatagtgtacttccctacccttcgactgttgagttgagcttaactttctttggctaatgggatgtgagaggacataacccttatgaaaggcttgaaatgctctcgtgtgatgagtttgccttcttgtgcttttgccttctctatgagaaaaacatgacttagttggttgctggtcctagaaaaatgagatgcatctagagcagagccgccccagcatgtcttcagacctgcaacctccagcagagctgctccagccaagctatacgggcatggcagagaaataagctctttctgggatttggggttgtttgtcttacagcatctagctgactgctgcaagttcctgcacacagtggtgcttactcatgtttctgaaggaatagcagtttgtttatttcaaccatattgctagttatttgttattttccaccatattgctagggttataactctgaaaacaagttcagctacttctcacatgttccttctgcctgaaaactttgtctccttgctcttcacgtggatggctttctatctttggctctggatttaaatattactcccttgggatgacctcttctgatacattatttaaataccatctgtggtggagcctactatttacatattgaaacatctacattcccttttcttctctgaaataacaccttattttcgggggaaaaatttcaaactgagacaatagttggaagaacagtacaattaagttttccctctcctcgaatcgtttcccaatactttactgtgtgtgtcttgcaataaggaccttctcctatatgcccataatacgaccattaaagtcaggaaattattataacattgatacattaccaccatctaatccaaaggccccattcaggtttcactgaccatcccaataatgtcctttataatcttgcagggcaagattatcatagcatttaattgtcacgtcttattccggcagattcatcagtctctttgttactttcttgaccttgatacttttgaagatacaggccatttatgttgtataagagctctcaattggggattgtctgatgctttttcgtgactagaactaggtcgtgcaccaattctaggcttcaacaccccatgccagatctctgtcctatcccctctcgttgatgcttactttggttggtgccctttagtgactttaacactgaatatttgaggaagaataaaagatgaaacactgattttaattagggtgacatagactctgctttaaacaacaacaacaaaaccaaaaccctctaatttcccaatctctcatgaagctacccaagccatgtgatttagctttggccaaggaatgcaaagagaagagtaatatggacattttctcagaatgaggaccatatatttctttgcccatttttcctgttgttggtcttgaattaggatgcaatggctagatctctggatgccatatttgaccatgaagtcaagtccaaatgagaaacgatcattcccaaattaaggccgtgacttaaggaggtatataaaagagaaggtggcaattggttgaatgtagggtgtgatggagaaggactcaaagatgttgttcaggctcttggtttgggtaactgggtgaatggtgatgatattcatggagaaagtgagctaaaaattaggagtaaaattatttggaaggcaagttaaattcgtttttggaaagaaatgaatctgagatatacaatggacatctgacggtgttctctaaggtaacgggaattggaaacagatttcaatattgaggtggtagaagaaggggtcaaatcatcaaatcatgattctgttacttggaaggaaggctgaaggggagaccttgagcatcttgtttcttcttagttccatttatgctttatgcttttgagcactaatcacaacagatactgtggaggctgagctccagccattgtcaagcctgtgctccagcactggtataaattactggagtcctcattctagaggaaagcacggggacgaatcttttctagggctctttaccttgtctactcttcctgcagggagtagttcagactttcttcttctacctcctcttcttctttttttctttatagagacaagatctcagtctgtcacccatactggagtgtagtggcacaattataactcactgcagcctcaagttcctgagctcaggtgatcctcctgccttagccttctgagtagcttggactgcagggttcatgccaccatgcctggcttatttatttatttatttagtagaaacagggtctcactatgttgcctagtctggtctagaacttctgtcctcaattcatcctcctgcctcagcctcccaaagtgctgggattacaggtgtgagccactacacccagcctaggtttttctttcttttcaatgaatcataacccttctctcttcatttctagtgaacatgcatcaccttatcctatcacaaaccaactctgtgacaaatgtactattactatgcccattttacaaatggaaaaactgagacttaaagaatttaaattggctgggcgcagtgactcacacctataatcccagctcttttggaggccaagatgggaggattgcttgaggtcaggagttcgagacaagctgaggcaagaaagcaagaccctgtctccacaaaaattaaataaattagccaggtgcggtggtgcacacctgtagtcccagctactccacaggctgaggcaggaggatagcttaagcccaggagttcaaggctgcagtgaactatgatcatgcccattgcactccagcctgggcaacagagcaagaccctgtttctaaaaattagacaaaataccaagcaacaacaccaacaaaacaacaacaccataaaacaaagttaagtatcctggggttatactggaatccaaataatctggtttaagagcttaacctcctaaccaccatgctatactgccttgtggcaactcatgccttgtgaatctttactcctggtagtgtttcacagttgacagagagcttttgcattcttgatctcatttggtcctcacaacagccctgtggggcaggtaggaaagaccttgttattagacatgagggtcctaagaaccagaaagctaatggacatgccgaaggtggcccagccaatgaatagcagagttagataagaattgtgatcttcaggccgggcacggtggctcacacctataatcccagcactttgggaggccaaggcgggtggatcacttgatgtcaggagttcaagacctgacctcaagtctggccaacatgatgaaattctgtttctactaaaaaatacaaaaattagccaggtgtggtggcgcacacctgttatcccagcttcttgggaggctgaggtaggagaatcgtttgaacctgggaggcggaggttgcagtaagccgagattgcaccactgcactccagcctgggacacagagccagactgtctcaaaaaaaaaaaaattgtgatcttcagcagccttatagagcacttcttctactgtataatcctcgctttcctcatttacatctgtgaaaaagatattccttttgttcagatgctcttaggtgctctgaagcaagcaatagcccaagctggcattttgagagccatttcatggatggaaagcggaggctcaatggctaagggaattagccttggttctccagtgtgtctgcagtcttcatggcattggtgctgctgatccacagtcatgccagaggttgggtccgcagtgaaccgcttcacagctggatggttgggggaaaagagaggtctaatgatagaaaccttccccaaagcaaaggatgtaagcccacaccgagaattattagaaagaataatattctcccacactgagaattattagaaagaaagaaagaaaaactagaaagaaggacaaaggcattccagcatgcttcctgtgacagattgagccagtctttgtaacctcagattcacaaggacattgcaaagaatttcctgttgcgctcaccaaaattggctggcccttgtgccagagtcccactgacatccagaaaactattgcccatcttctctgggctgtgcaaggattagtgtcataatagatcatcacagccaaatgttattatgcaaagcagaaagctgcaagaaatggatcttcattcattgaatttgcatgtttggtggggactgcttcagacttcctttatctcgtgatcagtcgtgtgtgttgatcctctttgcaagttgttgtgagaactgggtgcagcaaaagctgccacttcaagagaccaaagggatttctgagatgaaaaagtgcatcaatttgcataaagaactcagataatttctaggtagaaagcaggtcagagaggctctagacctaggactctcgtgttggattgcttagtttcaaatcatgcttatgtcacttacatgcatgcaatctggataagacatttaatatctccccaagcctcagtgttctcatctgtaaaattagatgatgtggtgatgatgaaagaacatatataggctggatgcagtggctcatgcctgtaatcccggcattttaggaggatggggtgggcggggcacttggggtcaggagttgagaaccagtccggccaacatggtgaaactttgcctctaaagaaagtacaaaaatgagccaggcctggttgtgggcacctgtagtcccagctacttgggaggctgagacaggagaattgcttgaacccgggagacggaggttgcagtgagccaagatcataccactgcactgcagcctggacaatagagcaagactctgtctcaagaaaacccccaaaaaacaaaaaaaacaaaaataatatatataaaacatatatattatataatatataaaaaacatatataatataatatataaaacatatattatttaatatattatgtaatatctattttaataacatatattgtatattacataacttgttatattatataacatgttatataatatataatttgttatatatgttatataacatataaaccatgtattatatataatataatacatgttttatataatatataataattataatttatataatatatgacattatatattatatataacttatatatttatgtatgataaaatatatggtatatgaaatatacataattatatattatatgatataattatatatcatatatgtattatgtatatttcatatacattatattttattatataaacataagtatatattatactatgtaatagtataatatataattatacaatgtataattatatatgtaatagtataatatataatatacaatgtataattatatattatgatatgtatgacatacatatctaacatatattataacatgtatgttatatataacacatatagcatctagataccatgtatagcatgtgtacatgcatatatatttatgttattcaacatgggtccaggaatggagtaagagatcaacaaatacagtcattaaaatcagtgattcctcattcttctcccagctccttctttatgagattttgaaatccatatggatggataaaaatatccccaaatggtgcctaatgttgcagtgaaggaaaatgaaactctggaaataaaattagttcaaggagaaggagcatctccgctgttgacccggcttaacactagactaagaatagattgcaatggccccaacctcaggtatgccggataagtccctgaaggccctagaggggaacctgagaagggtttgaatgtttgcatgtgtgttcgacaagctggtacctggtagctgagatgtagaggagaatcattgtgccctatgtagagactggactatgtggactttttcatagctgtagacaaagacacgctgacagtaccagactggttttcaacctaatggcagcctcggggacaagggaaggtgaaaatggggctgcctatgaatggatgcgactcctcaggtttccatcagcctgaagtttggaagtgatctttggattaactgagtcggcagagtgttggaccacgagaaggcagatgtggagtgagatactggacttcttggctcctgtgagcaaagaggatgggcatgagattaaatggaaaagtaagagacgtgacagtttcccaggttaataacatgagtaatgccagttacatgcatgggagctcatttaacaactcttcagggttgtgttactacccaaaccctttatgatgctgagcacgcactgcagacactgattcctgcctgcccctccactctgtttcctggttaccttctgcctgattcattttgatctagacacactggcttccattcttttccatgaacaagccaagctccttcccacctctgggcctttgcacacgcagtttcctccacctggaatgctgctcccagatctttttacaacacatttcctctcatctgttgagcctcaccttacacgttaccctttcagaaagattttcccgttcatgtcctctccgctacattattctccctcccatcaccctctctaacatcatagtcctcaccattcctgaaatgatctttgttacttactgggtggcatgtttagaggctgctttccccactggctctgtgacagtgactttgtcatggtaactcaacattctgtttcctgtggcctgaagattgccgggtatatactaagtgctccatgaatatttgttggaagattcaatgaatcatatcttaccaatgcaatattggaagcctagagaaatgaaataacgttttcacaattgcacagagtaacagatgctttcagtgcttcccttgtatcttctaaccctttacctcttaagcatccactgacccatccaaatgtagttgcattctctttctgaggactttttctttttcttttctttttttttttttttgagatggagtctcactctgtcgcccaggctgaagtgcagtggcgtgatctcagctcacagcaatctccgcctcccaggttcaagcaattctcctgcctcagcctcctgagtagctggaattacaggcatgcaccaccatgcccagctattttttttttttttagtagatgtggggctttgccatgctggccaggctgtctcgaactcctgacctcaggtgatccacctgtcttggcctcccaaagtgctgggattacaggcatgagccaccatgcctggccctctttctgaggtctttttctggttgtactgtctttgcccacccgtatgatggcttggaagtcttggaggaatcaacacctgccctgggagcatccctccaccaggaactgatgagagttggtgtatgtggataactaccccatctccctcaccccttaggtcagataactatgaagcaagagctggtatgtgcatctttccccaagtccttgttcagggacaaggtagtgtgaaatcagccatggtgggaggatttacaccatggatatgggcagacactacaaatctgggcttttaatatttttctgcagtgttggttgttaaacatctaccagcacattgctagagatgttctacagtgtatcctagagttttccagcaagtttaagctccagttattgtcccaagtggtaacttgttttataatatgccctttactggctgcctccctgacctatttcatttcctgtgtcatgtttcatttacctcccacatagatgacttactcttggagtcttgtctcagggtctgattcttgggaaaccccgatgaaggcatacaactagtatgcgataaaaccagcatttaaacctaggaaggtctgactccaaatccacgtgtattttactaatactccactgcctcttgtgtctgaccagttctttgccaatacactgtgacaggagtcctttaaggagtgagacaaatgcattatattgatgaaagtagcttgcaattaagaagttagccttctaggccaggcacaggggctcaagcctataatcccaccatgattgggaggctggggcagggggatcacttgaggtcaggagttcaagaccagcctggtcaatatggtgaaaccccatctctactaaaattataaaaattagctgggcatggtgacgcacacctgtaatcccagctacttgagaggctgaggcaggagcatcacttgaattcaggaggcagaggttgcagtgagtcgggatcacaccactgcactccagcctgggtgatagagtgagactccatcgcaaaaaaaaaaaaaaaaaaaaaaaaaaaaaagaagttacgtttcttatgataagggatgggttaactagataaaacatgtggaaatctaatttagttagtaaattattttttatttcaaaaacacttttaaaacatagacatgttttccataaaacatgtaggcaccaagacagatttgattgctctcttgcgaatgatcagcagcaggcttccacttcatgcttgttataatttactgtttatagttcctaactctctgcttacacgctggtttgaatattcaagggtctcaccaagtggtgaggcactggacacaatgatgatgttgggtgcaaatgaatagggcttcagctggaaaggggcaaggggcagactggaaagagcttaggctttagacctctgtactggtcaggacactttggttcacaagggagagaaactcagtgcaagctagcctaggcagaaaagaaaaaagaacttaatgcctggggaaattggaaggttgaaggatgtgtagttagcttcaggtatggctcgatcaaggattactcgctaataaagcctctctccttcactagaatagaagctctgtaaagacaggcaccttgtctgccctattcatagctgcatcctccatcatatagaataatgcctggcacacagtgataataaaaattatagagcatgtcatatgggcatgccactgttcttagtttatccacttaacccaatgaggtaggcaattattaattataatccccatttttctgggtggagaaaccaaggcactgagaagtcatttagctgataagcagggtaactgggatttgaacctaggacctcttgctccagagtctgtgctcataaccatgctgctatattaactcagtaagtagttgttgattgagtgaatgaataactgactaatgatgaaacttgccagacacagagtattcagtaactaggagtgctgacatttatttgagtggcctctgttttctgtgtcccattagctttgggtgctggtgtcttcatctgcaggattccatatatttagcccagatcaatggagtgctggagggtcaggatgagtcgtgttcaagaaaataaggttggagttatttctagaattttttttttttttttgagacagagtctcgctctgtcgcccaggctggagtgcaatggtgtgatctcggctcactgcaacctctgcctcccaggttcaagtgattctcatgcctcagcctcccaagtagctgggattacaggtacccaccaccatgcttggctaatttttgtatttttagtagagatggggtttctccatgttgaccaggctggtgtcgaactcctgacctcaagtgatccactggccttggcctcccaatgtgctgggattacaggtgtgagacaccacacccagcctgaaattttgttttaagttcctgagatccaggggttgtttgttactgcagcatagtctaacccatcctgtgtagaagcccttacttacttaggatgtgtcattgagttcagagagaggcagtagaggaaagggcccagactttaaaatcagagagatgaaattccaactctccactcactagctgtgtgaccttgggtaagttccttaacctctctgagcctcactctgcattctcactagtgaaattacaactgtaattgctactccatgaaattgctttgactactaaaataggaaaccctgtcaagggtataacatagtaggtgttgatgtatgttggctattacttttgctattatgtagcaaagcatagattactttggctattttgaaaaaacctgttgctatcaattaaggatagagtggctaaattaagtaaattctgtaagcaaacaaggatgggtctttaattctcctccacttttgatttatggctgaagatttgacagttatctgaagtctgactagcttgaaaaccaagacatctgtgattagacttaccttttgttcttcccattagtgtaatacattgttttaggacatctctgccaacccactcccccaatatccatctagcttggagcctttatggccttcataaggacccggcttcccccttggtctttaaaattagacaacagatgttcataatcgaacctgtcttggttccagaaagtctgagatgttcagaaataatcagaacgtctctataaatatcataaaggatatatcattttggcagaaccagatccagtttttgtggggactgaagcttatataatatggggatctctgtttaagaaaaagaatacaaaattatgaatttaaaattaggcacaaaagagaatgttattttggaatgagaaattaagtataatattcctgtagctgcctggacatggtagctcatgcctgtaatcccagctttttgagacgccaaggtaggaggatttcttgagcccaggagttcaagaccagcctaagcaacatggcaagacccccatctctacaaaaaaaaaaattcaaaaaattagccaggtgtggtggtgtgtgcctgtagtcccagctactcaggaggccgaggtgggaggatcgcttgagccagggagttggaggctgcagtgagcgatgatcttgccaccacactccagcctccagcctgggggtaacagagtgagatgttgtctcaaaaaaataaaaagagaaaattctggagcctttagctatttccattccattcttctgggatctgtgtaggcaattaatcagaaatgtgaacatagaggtgcttcattattgaaacccagctttcccttctcacctaaagccttccccaagtccagcatttaaagagacaggtacaaggaaaagaccctgaagcccaagcctcattagcttcaggtaaattcacctccgctctctggagaagcagacaacagaggcctcttgtgaatattgaggagaaggttgtatgtgtgttcatgtgcgtgagatccaagtggagagcatgggaacctagctcaattttcccttgaggtgagcttgaagctttgggtatcttcctctcagagaacgtaaacccatttttccaacattgttgtaaaatattctgttcccacctttcccacaatcagcttgcctgaccccaccacagggtgtgtcatcttgtgcttctggcacacacacacacacacacacacacacacacacacacacacacactctcagagccctgccatctgaaggcagccagctccagaaaggccaacccttagctgtaactcagcatagcactgttcatgatctttggtttccatttctaggctggtttccttttttgttttgttttttcctttgccaagactgtagttgaaataggataaaggatttatttttccataacaaggtaggagaaagggtgctaggttacaagcaccctgtcaatatcagagttggaagcttcttcctaccatcaggtgtgtgttgtgaaaggaacgaggggttcaggcaagtatttcccagcaggtgggaaggggtcttgatgggatggaaactaggaaaacaaaccagattccctgagggaaaatcaactgttcctgaactgttatcagtgtgggagtagggttcacagatttcatattctaaacatgtttgtgtgtggtgtgtgcacacacacctactatgtggcagagcctgtcataagtggtgatggattcctgtagatatagtttgctggagctgccataacaaagtactacagactgggtggcttaaatgacagagattaattttctcacaattctggaggctggaagtctgagatcagggtgtcagcagggttggttcctccgaagacctcctcttggcttgcagatggtcgattctggtgtgtcctcagatggtctttcctctgtgcctgtccatccctggtgtctctctgtgtgtcctaatctcctcttcctataagaacacgagtctgattggattagagctcaccctaaatgagctaaataggtttaaacttaatcacctatttaaagcccctatctccaaatacaatgacagtctgaggtgctagggggttaggacttcaacatatgatccatatggttgaagggcttcaaattcatatatatatatatatatatatatatatatatatatatatatagagagagagagagagagagagagagagagagagagagagagagagacagagagacagagagagagagacagagtctcgttctgtcgcctaggctggagtgcagtggtgcgatcttggctcactgccacttccacctcccaggttcaagtgattctcctatcctggcctcccaagtagctgggatgataggcatgcgtcaccacacctggctaatttttgtatttttagtagagatggggtttcgccatgttggccaggctggtctcaaactgctgacctaagatgatctgcccacctcggcctcccagagtactgggattacaggcatgagccactgtgcctggcctcaaattcatatttgaacatttattcaaatttgaattttagggggacataattcagcctgtagcactgtcaacctaaaaggaagaagctgaggcaaaattaatgtaagtaaagactctgtttgggccaagcttgaggactgtagccagggagcgtagattcaagtttccctgaatatacactccaattagcagcagttacaagtggatttataaaggcaaaaaagggggacatggagtgggctggtacacagttggttgtcaggaattctcactggttttcagaaataacattgacgagtgattggctatacattgttaagctatgaggtgtgggttatagcatccagtggggcattattagattaatttatagctacttgtggcaatggcaagcagttttaagaaatgaataccgagctcaaagggggtatgtaggacatgattgctatctcattctattgcctctctgggcctaataatttaaaaggcttgtattcctcagatgaaagttctgttcttttctcagcaccttgaatggctggagagagcaccaccccatccttgaccatgctgagtgctggctggacttcaactgggccagtactcccttttcccttgtggaaggtcccctgattaatgcttacctgaacgcctgctcttccttcagtccccagttctctgcattccccagcactgggaacagagacagcatgtctgtgttatacaatagggaagagtatgggctctgggtttaaactttgactctgcccccttgttagcccagcgactgtgagcaagtcatttcacttcacccaacttgttttcctttttgtacattggaggttactaaaagcaccttacctgtccaattgtagagaggattaggtgtattaatgggcatggcacagtaaacactcacaaaatgctagctactattaattgtcaagattatgttggttgcaaggagcagaaactcatatggaagtcatttaggcaataaaaggggataatttattgactctcataaccaaatccaggaaggtaggagagcagttgagtggcaggggcaactggaaagagaccattccccatgtctgtctgtctgtcatatcttttttatttttatatatgtatttttttaccatggtgggtttttttttgtttcttttctttttttggttgttttttccatccttggctagaaccatggctgccaacaagcttctctgtttcataatgggagaccttctcatgtggttatgatgtgaaaaaaatcccagggaaggactctgattggttcagctcaggtcacatagccacccacgtggccaggtcaggggctggggtgcttaggtggggcagggggttctgggtagataaaaataattaatgccttctgccttatctaaatgttctttgtactatgcctggcacttggtagaaattaaacaaattcccctttttccctttctgtttgaccctcatgtctactttttattacataaaagagtaatccagaaaagaaagtcagctcattggagacactgggtagggagaaaaagctttttatagaatattaggtaggagtagtggcttaggatggtaagagctctgcacgaaaggaagacattacggtctaaggccacctgggagatctgagtcaagcagctctatcccttcctgaggacaaaagagatttcaggcaatgactcatttgtttggagagctaattgacaagacatattaagagttttagcaattgttcatgctttttgatccaacaaattcacttctagagtgtcaagaactgtgctggtctaagatattatcctacatggaggctagtgagttttatggatgtgggcagaagacatgagactctggattgagagataaaggactttatttttcatggcacaacaggaagcttgagcttcatgtctgcaccagttccctttgacccccaagtccctcaagggtgacacaggttgacatggtttggctgtgtccccacccaaatctcatcttgaattgtagttcccacaatccccatgtgtcatggaagggacccagtgggaggtaatttaatcatgggggcagttatcttcatgctgttcttatgatagtgaatgagttctcacaaaatctgatggttttataaggggctttttcttcttttgctcattcttcccctttctgccgccatgtgaagaaggacatgtttgctttcccttctgccatgattgtaagtttcccgaggcctccctgagtcaattaaatctctttcctttatgaattactcagtctagggtatgtttttcatttgtttgtttttttgttttttttgagacagagtttcactcttgtcgcccaggctggagtgcaatggcaggatctcagctcaccccaacctctgcctcccaggttcaagcaattgtcctgcctcagcctcctgagtagctgggattacagccatgtaccaccacacccagctaattttgtgtatctagtagagatggggtttctccatgttggtcaggctggtcttgaactcctgacctcaggtgatctgcccacctcagcatcccaaagtgctgagattacagccatgcctagccttttttttttctttttttgagacagagtctcactctgtcgcccaggctggagtgcagtggcgcattcttggctcactgcaacctccacctcccgggttcaagcgattctcccacctcagcctcctgagtagctaggattataggtgtgcaccacaatacctggctaattttttgtattttagtagagatgaggtttcaccatgttgcccaggctggtctcaaactcctgagctcaggcaatctgcccacctcggcctcccaaggtgttaggattacaggtgtgagacaccacacccagccttgggtatgtttttattagcagtgtgagaaatgagtaatacatggatggatccaggtagaatctgtgcctgcagtggatttgcatcacacctgaggaaccccaagtttaggaatcttggtcttttcaacctttaccctggatggagggagacattgtcattataatcctttctttttctttttcttcttctttttttgttttttgtttttttgaggtagagtcttgctctgtcacaccaatgttggagtgcagtggaatgatcttagctcattgcaacccctgcctcttgggttcaagcaattctcccacctgtctcccaagtagctgggattacaggcgcccaccaccacacccagctaattttttaagtgtttgtagtagagatggcagtttcaccatattggccaggctggtctcgaactcccaacctcaggtcatctgcctgcctcagcctcacaaattggtgggattacaggcatgagccactgcgcctggtccggagatattattattataatcctaatcagcaaataaatctgtcttctactatactagccctatcttctaatgctattagctatacaaacatccttataaagacggtctagaacaaaagctgacacaagatgtgcagaaatgtaagagacacatggggaattgttgcacagcatagagaatctttcctaaggaaactacatctgaaacacacacagaaaatgtattcttaaagcaacaatagttcagcattaggggaagaggttaaacagactgttgttgggatactcttctgtttctaaacatgtttctgaagatcttggaatgggaagtgtaaacgttcaacttaaaatgtaaagtggaacaaaaagctgcaaaacttgaatatatgtttttattaactatgtacagacatctattctaggaaacctgggagggagacgtgctaaaatgttcatagtctttctctgggcgatgagtctaggatccactgtttttcttcatttggaatgttcatagtcctcctctgggcaatgagtctaggatcaactgtttttcttcatgtggaatgttcatagtcttcctctgggcaatgagtctaggagccactgtttttcttcatttggaatgttcatagtcctcctctgggcaatgagtctaggatcaactgtttttcttcatgtggaatgttcatagtcttcctctgggcaatgagtctaggagccactgtttttcttcatgtggaatgttcatagtcttcctctgggcaatgagtctaggatcaactgtttttcttcatttggaatttttttttttcagtttttctataatgaacatgtattacatttataatagaaaataacaagataaattatttctgaaagcagtgcccagcatccagaatttggcaaaaacaggagaagaaagcataaaacaagcagggaaaaaggttttcagttaaattagatgtccaatgaagagatcagcttggctgcaaaatctctttttgacagacaattagttctgggcaagtcaaatgtttcaacagtgcgttcttctggggcaattaaagtaattcatacttgatgtgcggaaatgtggtaattgggaaagttccccaaatggcagttgaaactgggctggttgtgtttggagaagttaagtcatgcccttgacaagccatctatctgagtctactgaagagggcttgggctgggtgattttaagatggaattttccactgggcataggaagtgatgttgggaatggactagaagggtcaacagtgacaacattaacagcatttattgtaatataaatacagttggcccttgaacaacatggatttgaaccgcatgggtccacttatacatggatttttttctgtttttgccacctctgagacggcgaaaccaattcctcctcttcctcctcttcctcagtctcctcaatgtgaagacaatgaggatgaagacatttatgatgatccacttccacttaatgaataataaatacattttctcttccttatgattttcttaatcatatattgttttctctagcttattttattgtaaaaatacagtgtataatcatataaaatacaacatatgtgtatattgtttgtgttattggtaagacttctggtcaacaataggttattagtagctacgttttgggggagtcaaaagttataggtggatttccaactgtgagggggttggcatcacagtcattcatgggtcaaccattgtgtcaataacaatcataccacacatattttgagtgccacatgttgcactaagcacttatgtatctattaatttctacaactatcccgtgcaatagatacgattggagtttccgtcttactgataaggaaactgagggccagagaggtcaattgagttgtccaaggtcacacagccagttagtaatggagctggaatctgaatccatgcaatctgacccttgttcaatgctcctagacttatgtgctggatttttttttttttgaaataacaatgttttatacctctatctttactttcctagataagggcatctgatttccctccatggcaagcaagttatgttgtatttgctacatttgagagggaaaaaagctgaagttcagaacggattagaaatttcccaaggccacacagtgaaagaatagaaagtttccttttttaaatggcggagcttttatatcaatgctgtttgtaaattttagttggcaatgtctgttatattccatgaaactgaatgagaggtgaggtggtatattagccaaaactctctcagctacatcttgctattgttccatgcaacttcaaagcccacagatagactggacttcaagtatggctggatccagatgcttaaatgatatgctttgaaatctgtctgatctctacttctcagctctcttttcatccatgttggcttcattatcaggcccttttcttatgccatcagcagctgctgacttacctcctaccagcttagtaatcccaggggaaaatgaacttacctttgccaaaagcactggcataagaagctgactctcattgcattgtaagagtcaggtgcccatctctgaacgaattattgtggctaaggaagtagaagagggtgattagtcagtcctgatcatgtgctcagctctagctttagaagatggtgctatccaaactccatgaatgaacagtgaaggaaggaccattgttcaaaagtaagtggaaatgctgtttccaggaaagcagaatgggaggaggaagtggggggaggggggaagggattcaaggggtgggagctggaatggaattagccctaaatagttggagtttggagggtgtaagtaagtgtgagctgaatgccgaaagcagagttgcaagatggtgtgtcagcccagttctgagaaacaaactcccatacaggattacacatatgtgatttttattaagggaaatgcccttgagagaaagcaaagaaggtgccacataaagctgggagaacctgagacagtaatgcaagtctgactctgagtaaaagagagaggagaaaaaagttagggtgcgaacaccatagggaagtccctaagccaaagccggggacaggggaatcctgtgtctcccggggaggggtctgctttagtgtccctgccatgctcagtcattagccaggagcacctcatggaaggaagcatatggattccccagcgcagcagctggggccctggttaattacactcccagtagagggaggtcgatgaggcccattctcagggccaccacatggtgagccatgcagcagtggcctggcagaacatttgtctgggttcatacagtatttacattaaaaaaaatcagggctgggtgctgtggctcacacctgtaactccagcattctgggaggccaaggcaggcagatcacttgagattaggagctggagaccagcgtggccaacaagggggaaacctcatctctactaaaaatacaaaaattagctgggtatggtggtgcacccctgtaatcccagctacttaggaggctgaggcaggagaatttcttgaatgtgggaggaggaggctgcagtgagctgcgatcatgccactgcactccagcctgggcaacagagtgagactcttgtctcaaaaaaaaaaaaaaaaatcagttgccagcattcaacaaactgtgtattttacatctttaaaaacccctggatttcctgcttctctttaaaaaatagtggcagtttggcaacattgggagtccattccacaaatcttgcaaaattgagtcctcgctgcctccttagataaggtgtgtgctctctagtttgccacagtctccaccagacccagttgccctaatctgtactcttcactcatttgtgttacttgtctgcccatgtgtgcatttaagtttgcaacccttgccttaaattcatctgagaaacaaactatggcagtcaggttcagccatagaatctaatgggaaggagcaaagctggagattgagcgactaagctagaggttgataaagcaggaatagagcaggtagctggagtctgagcagacagacttcagggcttgtctgccttcctaagagctcctttgctggctgggtgaagtcactgagaacctaagcagagggtgtcagttctagccttcctggagaaatcttagttgagatggatgtttagagctggtggacactgcctttgtgtcaagccagtctaggagtcacagcaatatttggacactggttgaaagttgttccattccatcccacttgctcagcaatttggacaagtgtgggtttaggttattttaattggttaatacccttttgtttaggtgctctcctttcctcttccacatggttcagtaaggctgccaattctagagctctttcttctcctatgaaagtcatggatgtcttaggctgggttttcccagaggcagatcctgtgatgaggatttccatgtaatggtttatttgtagggtgactctgggaagcaccagtaggagaatgggagtgtattagtcagggttctttagagaagtagaaccaatagaatagcacacacacatacacacacacatatgcatatacatacacacacacacacacacacacatatataagcatatggggaatccatatgcttccttccatgaggtgctcctggctaatgactgagcatggcagggacactaaagcagacctctccccaggagacacaggattcccctgtccccagctttggcttagagacttctctatggtccatatatatatatatatatatatatatatgtgtgtgtgtgtgtgtgtgtgtgtgtgtatacacacatatacatgtgtgtatatatacacacatatacatgtgtgtatatatacacacatgtatatgtacacacacatatgtgtgtgtatgtgtgtatatatatatatacacatacatatatgtatctatatgcacttttatatacatacattcacatacatatatgtatctatatgcacttttatatatatgtgtgtgtgtgtgtgtatgcaattatggaggctgacaagtcctaagatctgcaggatgagtcagtaagctggagacccaggagacccagtggtgtagttccagtctgaaaaccagcaggcttgagatccagaaagagccgtgtttcagtttgagtctaaaggcaggaaaattttgacgtttcagcttgaaggccctcaggcaggaggagatctctctgactcaggcaagggttggccttttgttctatttagaccttcaactgattggatgaggaccatgcacatctggagtgcaacctgctttcctccgtctacccatttaaatgttaatctcgtctgaaaacaccttcacgggaacacccagaataatgttttaccaattatctgggcactcagcgtcccagtcaggttgacacataaaattaaccatcacagggcaaaatgagacaaggaaatctaaaccagaatagagcaaggtaatgagtaagttacttctatgggcagccggggcttggtccttttgatgggctttggttgatggcatggaacacacctcaaattgtcccacctgagtgttgagaaaactgagatatttatctttcatcactcatctgacattgaccaagggatgctctcagggactttgacatccttgaacttctggcctgtcttgccgaggccaagaaaaggccttcaggtggggagttgcaggtgcttgcagagggatgccttcagcttgtatgggatggggagggtccaagggacatgggtggccattgccagtgtctgctatggttggtaagtggcacatatctggtcaaacatcaggatctatccacccagcagtgttggaccttggagtggcacaggcatcagaatcttccctggggattaacttattgtggttcttgaacagagaggatatatatctggaggtgccagcctctacttgccctcccacatggagagagatggagaataaggctgagcaaagacaaacagtgaagagaaatggagacagagagagggagagagagagtgagagagagagagagagacagagagagagagagagagagagacagagacagagagagagagagagagagagagagagagagagagtatacatgtactttgaggcagtgagtcctgtttctagtccctggggctctggttcttttctcttcctgtcttagtctgtttttgctgctgtaacaaaatacccaagactagataacttataaaggacagaaacttatttctcaccgttctggaggctgaggagtccagggtcaaggcacaggcacattttgtgtctggtaaggggctctgttccttgcttctaaggtggtaccttgtgtcctctggagggcatgaatgctgtatcctcatatgtggaagttggaagggcaaaagggcctaagttagttccctctacccctttataaggcatgaattcattccttaagggccaagccctcctgactgaatcacttcctaaaaggcctcacctcttaataccactgcaatgaggattaagtttcaacatgaattttggaggagacacgttcaaaccttagcattccctttccgtaaatgacctcagctggataaaccagtatattcgtttcttgattaatttagccagagttagatttctgggcatgcaaccaaaagctcttactaacagttattgtggtgggatagggatgaggggaagggagattgggattgagagagagattgccctgggcctaagagctttctctccttattacatcccagtgcctgagatttaagttgctagaaggaagatgagtttatggtggaaatttgtaaccgaccattaactagaatggcgcagctaagcccctgtgcctgaccaattgttaggacttaaagaaatagcaataaagaaagagcttttagtttcagagcttaattagccattcttttccttcctgacttttagttttatgactctagcttccaggatagaattttattgtagtcagatacaaattaaacccaaacaaggactctcccgtgtttctgtttcttcaatttaaatttattctttgtagggtgacactaagtaccacagtatatgtcacatgtaagaacagtaaatttttaaaaaagagagacagggcaagcatttatcattgtgatctcttctctaaacataatgggaacttaggttaattaaaaaaaaaagttaatgccgttgttttttgccttaagaaaggtagggtttttatctgaagtgctctgagaattggcactcttaaatctgcaatgatgagaaataacagtagctaccatttgttgaaaatctattagtagtatgctaggtccttaaccttcagtatctctaattaccccaagacacttgaaggatggatggtctaaagtttccatgtgtgcaaaatgatagctctgagaagacttaaccaatgtttcaaagatttaaaaaaaaaaaaaaaggaattggagccagtttgcattaagaccttttgaactccaaaaaatctatctatgtgcttccgacttgaaaagggtatgttttgcatgctggatatgggtttggtggaggtgctggtgtatacactgtatgtttcaatgctagacatcgtgctgggtactggacttagtaggcacctgatcgcatttctgttcggcaaattcagaaaatgtgagtgactgaaacttcattaggttgaaggggaatttaccttttcactacgtctgagcaaagggtttattcggtaaggtatatttatattatattatattatattatattatattatattatattatattagtgccccatggaaattatatttgtttctctacagataacaaagattcttatttctctcttaaaattcaaaataaagagccttactgacatctaccataaatcctctgctgtaaccaggtagagtataaataactccataaaaagagagtaatgctgtcttgcgtttgcacagcactttacagtttagaaagtatttgcttgccatgtccctttcgatcctcctgataggcttgcggggtaggaaggagaggtactgtcatttccatcttcctggtgggaaacaaacatttggagaagttgggtgacttgccccaaggtgacacaatagtgaagggttcaaaccaggacttagttagtttgggtgtcagaatgggtcagagtgggtttgtcttagttagtttgggctgtgtattagtctcttcttgcattgttataaagaaatacctgagactgggtaatttataaagaaaagaggtttaattggctcacagttttgcaggctgtacaggaagcatagctgaggaagcctcaggaaacttacaatcatggcagaaggtgaaagggaagctggcatgtcctacatagctggagtaggaggaagagagcaaaggggaaagtgctacacacttttaaacaaccagatcttgtgagaactcactcactgtcatgagaacagcaaggggcaagtctgtccccgtgatccaatccccttcccccaggcccctcctccaacactggggattacgattcaacacgagatttgggcggggacacaaatccgaaccatatcaggctgcaataacaaaatagtataaactggatggcttaagcaacagaaatctatttctcacagttttggaggctgagaagtgccacaatctggctgatgtagctcccagcggaccctcctcctggcttgcagaaagctgctttctctctgcattctcacatgacggaggaagtggggggtggggggagcggaggtagagagggagagagagagggagggagggaagaggagagacagagcaagagagcaagccgtctggtgtcttttcttgtaaggatgctaattccatcacgaagacctcatcctcatgatctcatctaaactaatagtcttccaaaaaagcccacctcctaataccaacataatggaagttaaggcttcaacatatcaattttgaggggacacagttcagtccattggacttagagttcacacttcctggacaagattttggaacgttgtaaagctttcttcagaaaaacaactagtttattttcccccaagcatttatagcccactttagcagcactcaactgcatgcctctgatctatatgctaattttggatccgccttatctcttaagtaatccaagagtttgtgtgtgtgtggatgctccttgatttgaaatccttatgtgcttagaactaatggcgttgtaaaacacactccacaatgtacccttctctaattcagcctgattttctcccatccctccacgttagccgggctcccatgcccctgtttttgatcacgattgattgtccagctccaaagcatcatctgaacgacttatggtctttctcccgagtgttggagcccagggtaggcagatgggagagggtaggggatttgaaccggagaaagacatttaaatttcctcctgttcatcttagcttaggaagttacctgctgtctgaagggtgtatccctattttattatttatttatttttacaaaaccaagggaaaccagcaacgaaacgcaagaggagctcctctgcctctgattccagtagctgtgctctcaggttggagcagccaacccagaaattggtggccagtggctagggtcaggatgagcagagtgaacgcgagttctatgtctgattataaaaactgtacttgctccttatggagaatttgaaatctagggaaattataaaaatgtaaagtgttatcagtcctttgtcagccattgggctggttggttggtcagaagtcatcactgttatagaccctcattgcttaatgaaaattaatttgtcaagcgatttccttgatgatgctaatatttattgaaaggttaccctaggctgagttctggctaacagctatatatatgtatacttttattttccaagtgaagaaacaggctcagagagggtaagaacttactcacagtcacacagcaactgagtggggcggctagaatttgggttcagatagtcagacgttagagttcaggtttttcatcccttcaacatctacacatttttcaagaaataacaagattcacttttggtttgaagaggagtgcatgggagagaaagaaaagtaccaaatgggaaaaagagagagcaaggaaaccaaactccgtttgtggtcgtgagctacattaaaaaaaaaaaaaaaaaaaaaaagccaggccagggacaatggctggattatgcctgtaatcctgccactttgggaggccaaggcaggaggatcacttgaggtcagaagtttgagaccagcctgggtaatatagcgagaccccatctctacaattcttttctttttcttttttttctttttttgaattagcaaggcgtgctggtgtgcacctgtagccacagctactggggaggctgaagcaggaggatcgcttgagcccaggagttcaaggctgcagtgagctatgatcccaccactgcactccagcctgagcaacagagtgagactctctctgaaaaaacaacaacaacaaaaacaaaaacaaagcaaagctggtggtttcacatgagtgttgctccttctggaaaggcatcactggagtgggtgccatattttgatgctgctgctgccaatgatgagaacatgggcaacctcttttgcctgtaattttttttttttttttgagacagtctcactctgtcacccaggctggagtgcagtagtgcattctcagctcactgcaacctccgcctcctgggttcaagcgattctcctgcctcagcctcccgagtagctgggattacagccgcctgcatccacacccagctaatttttgtatttttagtagagatgggattttgccatgttggtgaggctggtctcgaactcctgacctcgtgatccgcccgcctcggccttccaaagtgctgggattacaggcgtgagccaccgtgcccggccaagagagacttttctacactttgtaattatgttatttttaaactgaaaactatatttcctatttcttagtgttagaaagaaagagaaatccctgagaacaatcagcagcctggagcatagtttgagactcccactaacagagccaagagtctcaaactaggccaacagatacccttggggaaccctgctgtatccctgggacataaaaaactacagtacaaacatcatcatcttcctggaggatgaataaactttagtagagtaatagtaacttaaaacacatgtggcacaaaatagaacgcagagttcacaaatacctaaggtaaaataagacttcaaagaaaatttcacccttgcagaggttattttgggctacactccacagagtatgaattcattctcttttcctctcagggatagtttgttaagagtctgaaaaccactgctctgggcaaactgccctccggagtcacacacaaaaaatcaatctcgttactaaagataaattttatttcaataaaaattgtaatgagcttgatcacctacccttttcacctgacttggctacaaatgactgccaactgtttaaaaaaaaaaatccaaccgaccctcagagctaatatgctattacttttaaagattacagacaggccaggcgtggtggctcacgcctgtaatcccagcactctgggaggccaagttcctatttcttagtgttagaaagaaagagagagaaatccctcagaacaatcagcagcctggagcatagtttgagactcccactaacagagccaagagtctcaaactaggccaacaggcacccttggggaactctgctgaggctgaggcaggagaattcccggaacccgggaggcggaggttgcagtgagctgagatcgcgccattgcacttcagcctgggcagcgagagcgagactcggtctcaaaaaaataaaaaaataaaaaagcctctcttgtgtccttgtccccagccttccagctctcctctgagggaaccagttttcaagatggcccgcaacaatccctgcctgctgccattcacaccttgtttagtcccctcccacgctggaaagatccatgttggggctcgtgtgtgaccaatgccgcagaagtgatgttatgtcacttccgcgattacgtcatgaaagactgcagcttccattgttggctctttctttctctttcttggatcagtcgctttggaggaagccagctgccatgttttgaggacactaaggcactttacggagaggcccacgtggtgaggaattgaggtttctaagagccagtaaggaatagagacaaccacacagtgagcctggaagcctagtcttcagccccagaaacgctcagatgactgcagtcctggctgacatcttacctgcagcctcattggagaccctaagccagagcacttagctgagttggcttgtgggttccaaatccagacaattagatgataaatgcttgttgttttatatttagttttagtttttgtgactacatcgtaggtgtatatatttatgggttacgtgagatattataggcatgcaatgtgtaattatcacatcaggctaaatggggtatccatcatctcaagcgttttcctttgtgttacaatctaattattctcttttagttattctaaaatgtacgattaaattgtttttgattatagtcaccccattgtgctagcaaatagtaggtcttattcattctttttttttttttttttgagatggagtcttgctctgtcgcccaggctggagtgcagtggtgcgatcttggctcactgcaacctctgcctcccaggttccaggaattctcctgcctcagcctcctgggtagctgggactacaggcgcctgtcaccacgcccggctaacttttgtattttttagtagagacggggtttcaccatattgaccgggctggtctcgaagtcctgacctcgtgatccacccaccttggcctcccaaagtgttgggattacaggagtaagccaccgcgcccggccttattcattctttctaactatttttttgtactatcatggttcactgcagcctcattttgacctcctgggctcaaattgatcctcccaccccagcctcctgagtagctgggactgtatgcacatgccaccatacctaggtaatttttaaagattcttttatagagatggggtcttcttatgttgcccaggctcgtctcaaactcctgggctcaagtgatcctcccgcctctgcttcccaaagtgctgggataacaggcgtgagccactgcacccagtcgatggcgtgtattaaaaggaatgatgatataaatactgatgactaacatttattgagtgttttttccatgtcaggcattatatcaagcactttacatgcatatctcatcagtaaaacatttgcatttttatttcttatcactagtaaatccttctcctcccagaagcatttaaaaatccacaaaccatggctaacttcctgtgaaatggcttagtgggcaaaaattcagaataaggggagtgtgagtccatgtctcctttccagagatgaagaagtttctcttttctgtgcatgaagaagacaatgggatatggatgacactaaacctttgaaagttcctgctaacctccaggtggaaggaaagggcccacggtgatcaataaatgtgtttgctattttttgggtgaaaggaagagagcctgcacctctgttggggtaggttatccacgctgtctgcctggggtccagattcctggcattgatatgacttcttggctctcttgagccctgaatctgcttcaaattcagaaagccccaagacttctgggctctataattactctgggctttggagaatggtttctcttatgagcaaaacaatggtggaaacttgtaccaatgaaggaaacacacaagcgtgtagaggaacattgctgtttgctgatgatgctggtggctgcttgggtgagagataaactctccaaagagcgttggcccttttgtggctgcaggatctgggtgaaagagattcttgtagtctatcctatcactagatactatctgtcttagtccattttgtgctgctataacagaataccacagaccaggtaatttacaatgaatagaaatttacttgggtcacagtcctggaggctgggaagtccgaggttgagagcttacatctggtgaaggccttcttgctgcatcatggtgtgacccaaggcatcacatgggtgagagagagggtgagagagagcacctactcctgtgaaaaccagcccgctcccatgataaaggcattaatccattcagaaagatgatgtccccatgatccaaacacctcttgaaggcctcacctctcaacacggttgcatcagggattaagtttccagcacttgaactttggggaacacatgcaaaccatagcaatatctgtgccggatattttgtatttgctcctttacatccactgtccacccccatttcctgctttgtaccccaggaggctgacttctatggactacatcacatgtggtctcccatcctcttgtggctgcttgggtttggccaatggggtggggatcatagaatactagaaggtgggaggagagagggattcggatatttatttctgtggctccttcctgttgggttgccataggttggaagctcctgccaggcagctgtctttccctgaagactgtggctactctccttgggttccataactatttctcctccaggtctaggggtagaaatggctcctcactgctgctagttagggctactgcaacctccctttttgtttttgttttttttaatcccacttatacagctatatatagccctttgctaaactctttttagttaccccatttgagtttactatgtatttcctgccacaaccttgattgatacagcagcccagagaagggaagcaattaactttctcactcctttattcattcatccaacctcccatcaacacttactctatgccaggacttgtgctgaggcttttaagaatgagacatgatttcttgtctatgtccctgagttctcagttgttcaccccagaaactgactcttaccaaagaaagagaacatgccgaaggcattgctgaaggcccagccttggaaaacaccccatacaaggtgactccagatagctttatagcggcaactcctccaagggcatgcgttagggataggctgatctggggacccctgctctccctgcagagaattcatggaaacccaatagggcctgtgttcttgcatcatgagtcaaggtgccaagagagatcacctgattggctgatccagagtcacacggttgggggagggtatacaaagtggagggctcaccacagcggtcagagataaggctgctccttgcagctctgttttttgcaattcctcttggaccctccccagttcggccaccacccttgaggctagcaagggtgagttgtgtcagaagcattccatgcaaggaaataacaacttggaatccaaatatattcattagtaagtaatggaaacctgaaattgcttaaacaagatgggacattattctctcacattaaaaggaatttgggggtaggtgagtctagggttggtttattcagtagttcagttgtatcatcaaagacctgggctcttgccatctttgtgctctgacttacagagcaagggcttaattccagtcttttcctctaatgagcacaaaatgggtgccacagtgccttacatcacatcctaacacaataacgttcaatgtccaaaggtcagaggagaaaatgtgtcttccttgtgtccattgttgacagcaaggaggaaatttccatcaactctcattggtcacaatgggtcacgtgcctattcgaaagcaatcactagacagggggtcagtattactatgattagtttaggtcagtcaagattcactccttgaggctcagaagggcaacttctcctaaagcatgtgactgttcaatactttaaaaattggggttctcttagcaacggagaagagaggctctttttttgacaagcaatcgtagcatctatcaaagcataagaaaagcttgtgagtgatgaggttggagactgagaaggttccagaacatgacattctggtgaagtaggcaggacccaggaatctcaaaagtgacccaatgtcacagagtctgttggtggcagaggaattgaggcatctagaggcatctaggcagagtgattgaggcatctcactttctacgcagaaaaggaggcatttgctccacaaaagcctcctgctaattccagggacctttcgctgtagagacaactttatggcatcagtgacaactttggcctcattgtcctgacagagcctagaatggtgctatctttgggcttcatatctgtgaggcactcagaaatgtatgaagcatttccaagtccatggtctcatttgctctccactttgcagtggggaaactgaggttcagacaggtgaagagacccgatcaaggtcacatagctggagagcaggaaacactgagctcaaccccagatattttaaccaaaggttttagttctctgccttcctgccttctagataactccatacagtctgcagggtagatcctcaatcatgatgtatgaaaagcgtgaatgaatgcaaaaaaaaaaaaaaaaggtttaaaaaagctgtgcaagctgggcacagtggctcacacctgtaatctcagcaatttgggaggccaaggtgggagaatgtcttgaggccaggagtttgagactagcctgggcaacatagtgagactccttttctataaaaaatttaaaaattagctgggtatggtggtgtgcatctgtagtcccagctacttggaaggcctaggtgggaggatcacttgagcccaggagttcaagaccagcctgagcaacctagggagagcccgtctctacaaaaactaatataaattagcaaggtgtggaagtgcatttctgtaatcccatctacttgggaggctgaggtgggaggattgcttgggcacaggaggtcgaggctgcagtgagctgtgatcacacaactgcacttccagcctgggtgacagagtgagaccctgtctcaaaaaataaaaaagttgtgcaaagataaaaacccagttatgactcccattgtggacccataaataaagcaaagttatcaaatagagatgtgtgagctgctgaatggaacagaactcactgggtttatggggctgtgtcaggcacctctgacaatgccagatatttactttgcagatgaatgacttcattgcttgccccaaatgcatcactggtgggtaatatttatgcagattggaagcattctccctcctttatatggtcctgggctgtttgtaaccattggatttttttaccttttgacttgacgttgttcttcacgggaccgtggtatgggatgcatttcaataaacaataccaaaggacagatttcggctttaaataaaattgtgttccgtaaagtgggagacaaaggcttataactcactgtcggctgcagacattttggcaaaaattatctttcaggctttgatctccactgtatcattttactgagtggccccatgtgctctatcaatcaaacccactgaagatgcaggagaatcacatttaaaatcaaatacaaattgtagattcatctgcccaggaggaagagaaatgtgtcatgaatcctgccttcagtcttctatgattacaacggaattagtttttgaaaactccagaggatggttttccacttcccaactttcatattattattattatttttgaagggggtaacattagatgggtagagaggtagactaaagtgattcagctgtgagatcggagtctcgccttccatctaactgtaggttagggccttttaatattcctctgacagagattctttatgtaggaagggatgttaagaagaaagatgttctctaacaagaaaacatttagacaaagaggatatgacctccctcactcaatctcgcctgctttcttggcatacatgggaagagaggatgaactagaaaggaaatattatttgctgatctcctttctttgtctgaggcacattgcacaggatgtctcatttgatattcacatgcccatgtgaggtgaacaatccacaccatgctttacagaaggggaaactgaggtcaagaaacatgctcatgggccgggcgcggtggctcacacttgtaatcccagcactttgggaggctgaggtgggcggatcatgaggtacagcattcgagaccagcctggccaacatggtgaaaccctgtctctactaaaaatacaaacattaggccaggtgtggtggcatgcacctgtaatcccagttactcgggaagctgagacaggagaatcgaatgaacccggaaggcaggaggttgcagtgagctgagattgcaccattgcactccagcctgggcaaaaagagcgaaactccatctcaaaaaaaaaaaaaaaagaaagaaaaacaaatattagccgaacatcgtggcacgtgcctgtaatcccagctactcaggaagctgaggtaggagaatcgcttgacctcacgaggtggaggttgcagtcagccaagattgtgccactgcactccaacctgggtgacagagcaaggctctgtgtcaacaaaaaaaaaaaaaaaaaagaaaaagagaaaagaaacatgcttatggctgaagagctgagcccaagtctatgtgattctgaataacatgcttttaatttaattaattaattaatttacttatttatttatttgagacagggtctcactctgtctcccaggctgcagtgccattgcaccatcatggcttggctcactgcagccttgacctcctgggctcaagtgatcctcccacctcagcctcccaactacctgggactacaggcacacactgccatgctcaactaatttttttttttgtttttttgcattttttgaggagacggggtcttactatgttgcctaggctggtcttggactcctgcattcaattgaccctcctgccgcgacctcccaaagtactgggattataggctttagccactgtgcccagcctaaaacttttgagaaagaatgcttcttgttgattgtctcccctctctattaccttagtgtctggcatatagtaggtgcttgaaagcacttgtttagtgcctaagccaggggctgacaaccttactgtaaaggcccagatagtggattatttgaggctttgggggccatgtgctctcttgcaaccatgcaaccctgccgttgtagtgcaaaagcagccacagacaatactttatttataaactctgaaattggaatttcatataattgtcatgtaatgacgtattattccttttgtctttttcccactaactatttaaaatgtaagaactagctgggcgcagtggctcatgcctgtaatcccagtactttgggaggccgaggtgggcggatgacctgaggtcaggagttcgagaccagcctggacaacatggtaaagccctgtctctactaaaaatacaaaaattagctgggtgtggtggcaggtgcctgtaattccagctactcaggaggctgaggcagtagaatcgcttgaacctggcaggcagatgttgcagtgagctgagatggtgccactgcactccagcctgggcgacagagcgagactccatctcaaaataataataataataataataataataatataaaatgtaagaaccattctttcttagctttcaggccataggaaaacaggcagctcggatttggccttcaggctgtattttgcagattcctggtctaaataattaccttaattatcacagtagcagatactagcagatactaagaactagtgtatctccaaagtctagtttggtgcccggtacaaacattctttccccaaggtggagtccacttgaccagagtggagagttacagtgctggggaagagttggaagacatcgctgcctgggggtgggggaagggcagagaaatctcttggggtttgttctggggaaactgggaattgtgggagaactgaggaggcgggaaaggggactttaagaatattattgtgggccaggcgtggtggctcacgcctgtaatcccagcactttggaggctgaggcgggcagatcacgaggtcagtagatcgagaccatcctggctaacacagtgaaaccccgtctctactaaaaatacaaaaaagtagccggccatggtggcggatgcctgtagtcccagctactcgggaggctgaggcaggagaatggcgtgaacctgggaggcggagcttgcagtgagctgaggtcgcaccactgcactccagcccgggcgacagcgagactctgtctcaaaaaaaaaaaaaagagtattattgcaggttaggaattggaccttttattacagaggttctcactggggactgaattgtcccatgtgtgtgtgtttgtgtgtgtgtgtgtgtttgtgtgtgtgtgtgtgtgtctgtgtgtgtgtgtgtgtttgtgtgtgtgtgtttgtgtgtgtgtgtgtttgtgtgtgtgtgtgtgtgtgtgtttgtgtgtgtgtgttttaaatctgcagagagcttttggttgccctaatgatagggatgggggagtcattacggtgtggggtagttttttgaatatatatatgtgtagatcccaaattcatatgggttagaagaaccatgattatcagagtctataaccttgttctatttttttttttttttttgaaacagagtctcactctgtcacccaggctggagtgcagtggtgccatctcggctcactgcaacctctgcctccccggttccagcgattctcctgcctcagcctcccgagtagctgggactacaggcgggtactaccacgtccagctaatttttgtatttttagtagagacggagtttcaccctgttggccaggatggtcttgctctcttgatcttgtgatcggcccacctcggcctcccaaagtgctaggattacaggtgtgagccaccacgcccggtccaaccttcttctattttatctgcctattctattttatatgtttacatgttctattttacatgtaagtgttgaatgaacactgatgtttccaagaatgtagcagctatggtgtaaatcaagagaagatttgactctgtttggtatgggaatttatcaagaaagagccactcttttgaagaacatggcactctcagtaaagccgatgcgacaacacaccacgctgtctgcgtttgtgactgtcactggttattctacacacacgtgtgtgagcacttgactgcttcgctccgtctttcctggtggaaacccaaatcatttctctatatattatttcattagaaatcctcatcatttcatttctcctttttattataattagggcacaattgtgattggttagaagagtagatgggttataggatcagcacattttttttttttcagggtagaaaagagagcttttcagctgggcatggtggctcacgcctataatcccagcactttgggaggctgaggctggtggatcatttgaggtcaggagttcgagaccagcctggccaacatggtgaaaccctgtctctaccaaaaatacaaaaaaaacaatgtaccgggcatggtggcacgcatctgtaatcccagctactcgggaggctgaggcacgagaatcgcttgaactcaggaggtggaggttgcaatgagccaagatcccaccactgccctccagcctggactatagagtgagaccctgtctcaaaaaaaaaagagggcttttcaattggttggttaaaacatgggacattggatctgatggcaccaagaatgcctgccctgtaacactgtttgagctgatgtgtggggaactgcttttggattacttatgggttgctgaaatatacttctttgaatgcagagattgggcccctgattatatttgggaggcaaaaccatcaccttgtaggcacctggcagggtaaaataaatggatgcttcttagaggccaactgctctctcacttcctgtttccgttttgtttgcagcgtaaagccagatgccttttatctcttgtatcagtgctggttgtctgagaatttttttttttttttttggacagagtctcgctctgtcacccaggctggagtgcagtggcgcagtcttggctcaccgcaacctctgcctcttgggttcaagtgattctcctgcctcagcctcccaagtagctgggattacaggtgtccaccaccatgttcagctaatttttgtgtttttagtagagatgggatttcaccatgttggcctggctggtctcaaactcccgacctcaggtgattcacctgtcttggcctcccaaagagctgggattacaggtgtgcaccaccacacccagctaatttttgtatttttagtagagatgaggtttcaccatgttgtccaggctggtcttgaactcctgatctcaaatgatctgcctgcctcagcttcccaaagtgctgagattacaggcatgagccaccatgcctggcctgggcagagtttttaaaaatgcttcaaactctcctttagctcagtttcggtagagtcattcctttacagtatagttacagtggagctgccaatcagctcaggccacacccagcccacagtctcagaggggctgggtccctgctctttctctctccctgaaaagtggctgttaattttctcctttagtctcctttccccagaaagatatttccctttaccttatgggagtttgataaaactggcatctccagccttcttttccttatgttggtttttctgccacaaaaggcccagagacattgtctatggaacgtttggctgcagctgggcaggtgttttattctattggaaaattccactaggattttctatgattacaatagagcatgggtcctcagtcaaaccctccaccacttataagaagctctgtgactttggggaagtgacttaacctctctgagcctcactttttctatttggaaagagtgatgggttggtaggttttatgtgttaactcttagggatacagggtgcacagctatttgcctaaacatcattttgggtgtgttcgtgagggcgttttgggatgactgtcatttaaattggcagattgagggaagcagttgcccctcctaatgtgggtggacttcatccaatccacggaagacctgaatagagcaaaagtcggtcctttccgaagtaagagagaattcctcctgcctgaaggtttttaaactgcaccattggcttttttctgcctttgtactcagactgaaacactgctctttccgggtttcgagcctgctggccttaggactggaactaacaccatcagttctctggggtctccagtttgctgcctcgccctgcagatgacagcacttgttagcctccataattgcgtgaaatctctttctctgtttagacattggttctgtttctctggaaaaccccagtcaatacaggcggtgatcatattttgaggattaaatgatacaatgaatagaatatgcttaacacacagtgagtgcttggcacatatgatctcctcaatacacatcagctttatcatggaaattattatgtatcattatacaaaatataataagatttcaaacttgtgttctcttacatgtcctctaaattattcaatggaacaaaaaactcttcactcatttttgtgtgtatgcaaacttaatgtctttcaataaattttccaagttattgtatgttcgcaaggacataattctgtttgacttcccatctttccaatactagtagtgagcctcattagcacatgaatgctggtgtctgtgagatgtgcttgccttcactgtcctgtttgccttgcccaaggtgggcgatggaaaggacaagccatctattattggttggaggaaggaccaaccatctactgtggcagtctgctcaggctgccatacaaaataccacatactacgtggcttaaacaggagacatttattgttcactattctgggggctgggaattcgaagatcaaggtgctgggtgatttgtttctccagtgagggccctctttgtggctttcagttggaagccttcttgttgtatcctcacaggggagagagagagcacgcaagcatgagagagtgcaagagagagagggagagatcaagcaagagtgagagacagagaaagacatctctggtgtctcttctaatatggacacatcacatctccaggaccttaggcttatgatctcatctaaacataatcaccaaagccgcatcttcaaatacccaaataccgtaacactggtaattagggtgtcagcttcgacatatcagtttgggggtggaggcacaaacgttcatttcatagcacttccttttccaaaaatgctccttaatccctccctgccatccttgctattctcatttgacagatgaggaaattaagactccacgatgtgccttaggttgcccatagctgtacatcttataagtgcgagctccccagataattgcattcatccacaagagcagagttaaccacagcatcatagccatccagggagcataatgccccgttaaaaataacaaagcgtagagacccagcctgaactgaagatgtgtctgtggttggggttcagggttctttgatttccagatctaccacccagatatttgtcaagttacatctacctctggtgctcatttccatatctctaaaacagaaataataactgagaggattttgtggcgtcatgcagatgaagtggctctcaagagcctgacttagtaaacgttggctgcgtgttgggcattattagctaagatgtataaacagcagaggtttggtttgtatgagtagatcatattcctgcctgttgtcactgagggagagcagagtcctaaggggaggggacacaggtcaggagaattctagggggtgggggatgtttctgatttctcaacaatgggtaaatctgggaatctcatgagagcttcagtgggtaaatcttggaatctcgtgagcaaaatgtggacgtgaagaaggaagaaaagctgcttggaggattggtgaaggaggagggaaagggaaaaataaaaggaaaaaaacatttaggtggtgctaagtgccacacattttccgtttttgcatcagtgaattgtaaaatcacactgcaaggctggggatattatccccattttacagatgagagagaggaggctgggcaagttaatgaactggttcaaagtatcacagctagagagttggagccaaagtgagatcgcacagctacgcagactctaaagcccttgtctgtatattgaatcaaatttcccctttttctggcttaggtaaactgaggcaggaagtgatgagaaagggttaagagacgtcggctgctccttaaacatctcccttcccagtgtcatttgccatccataaactctttcaaaatgtgataatggttttgattttcctgtcatctcgatttgatatgagaaatttgggatttccaaattgacagaaaactcgattttaaagatgctggaaggcaaacatctgtgaaaaatcacaggaataatgtcaacatctgtccctgtgaaaggaaattgctgaggttctcaatttacagccaatcaatcaatcttggaggccagggtgcttgcaaattgaaatgcatgttgaagctatagggatggctaattaatttagtttgtatgcctataagatttttcattgtttccagttaaaaaaaaattctcttttgaatagaaaacgtgtgcatatggtaaaaaaaaaaaaaaaattaaacagtaccagaaaaagtatacagtgaaaattaagtttgttttccatcccaaccaccagttcttcttctccaaggtcacaagtgttgctggcttctcttgaaagtttccagagatacaatctttatatagaaaaacatatgtatatatgtctcctcccggttttataaatgatagcccattgtacatattacactgcatcttgacttcattcaacaatatatctttgaggtttttgcatagcagtccatatagacattccttattctttttatcagctgtgtagtattccagtatacggatgtgtataaattaatcagttccctcatggtggacattcaggatattttctgtcattctccacaatttatgctagtatgtccatcttggtgtgtgttcatcagtaggatacaaatctagaggtgagcctcctgggcagatgggatgtgcatttaaagtatgatgccttcatgtaaagggaaggttttcttttcttttttcttattttattaagagacgggggtctcacgatgttgcccaggctggtcttgaactcctgggctctagcaatcctcctgcctcagccttccaaaatgctgggattacagacgtgggccaccgtgcctggccaggttttctttgttatcttggagggagcatcacccccgtcaaggagatcagattggtgaaggtgggatgctgtgtctgagagcttaatgactgttcacagatattgtggctgcccttctctaatgtacctgcttcttcaggcccaaaaggtggaaatgatgtttgtttcttacttctttggggctttgactgtgccattgagattttgtgctcagggataaactaccgtgtatttacagttacctcaacctgtgaggtttgatgcctctttctttctttctttctttctttctttctttctttctttctttctttctttctttctttctttctttttctttctgtctctttctttctttctttctttctttctttctttctttctttctttctttcttccttccttcctttctttctttcttctttcttttttccttcttctttctctttctttcctctttctctctctctttccctccctcccttccttccttcctccatccctcccttcctttcttgctttttttttttcttgctttgttacccaggctggagtgcagtggcatgatcatagctcactgcagccttgaacttctgggctcaagcaatcttcctgccttggccaccctgggattacaggtgtgaaccgtggcgcccagccttggccactttctttattctaaacttctttgttccatactttgcttcttttccctggatccatccccaccagcctcccttgtcactccagtgataggacactcagtcttgccaagtcaatgtaaacccagacccttctcatttaaaacctagtctctttggtaaacagtcaattcaggattctcacatcaatctgagttttaaatcttaattagttgaaagattttcatatctttatctttccactttggtcactggcttcgctgtgggtgctgcaccactcagacctctgtgcaggaccaccgaggccctctgtccccccagctgctgggagacctggctgctaacagctcatagcaaagtcctgcctctggcaagaaggcacctgtaggaagccacctagtgctgggaaatcctcctcccctcctaggcatcccataatcctggagggttacaaaggctctgtcccttgcccctctgtatgggagtgtattagtcagcgttctctagagggacagaactaatagtatagatgtatataaaaagcagagtttattaaggagtattgactcacacgatcaccaggtgaggtctcacaataggccatctccaagctgaggagcaaggaagccagtccaaatcccaaagcctcaaaagtagggacgctaacagtgcagccttcagtctgtggtcaaaggtccaagagtcccaaagctgaagaactcagagtccgacgttcgagggcaggaagcatccagcacgagagaaagatgaaggctggaagactcagccagtcaagcccttccatgctgctctgcctgcttatattctagctatgctggcagctgattagatggtgcccacccagattgagggtgggtctgcttttcctagtccactgactcaaatattaatcttttttggcaacaccctcacagacacatccagaaacaatactttgtatccttcaatccaattaagttgacactcagtattaaccatcacagggggtgtctcaggggtcctggcgactgttccacagtgccactcccctctctgcccaatgctgcttccttgctttccagcaggtgctcctcccagtaaaccccctgcacccagatctccatcccacagcttgtctctctagaaacctgacctatgacaggcttataaacaccacaacagggcatgggtatgggccaggagagctactcctctcatctgctgagggtcctaccccaggacccctggggagggatgaggtccctgttgttcatctgggtgatcatctaactcctgatgagcccaggagttagagaccggcctgggcaacgaagtgagaccccatctctccaaaaaaaaaaaaaaaagtcaaaaaattagccagatgtggtgcatgcccccagctacttgggaggctgagatgggaggatagcattagcccgggaggttgaggctgcagtgagctatgattgcaccactgctcttcatcctgggtggcagactgagaccctgtctcaaaaaagttgtcatggtcctatgacatttttttaggtcctatgcaggggtgcaggtggaggtggtttctggttctacctgactgtcttcgttcagcctggtccatttgttgactctgctacccagaagtgaaagaatatggcatctttctcatctctatatggtccccatgcagtaaggagttgactcagccggtctggggagttcaaatcctgcacattccaaagaaagctctggccgttgattggctcctgggagataaccgccaagtctttggaacattctgcctgataagagtgtctttgtttacctatggcctcaggctgagctagctagtccatgctaacaatgcaatttatggtgagtgcctgtttttgtatgtgtcagtttgacctctagaggggctggagactgagtaacaaaagtcacccatgcaggtgctccatgcctgggtgatgaaatgctgataaaacccctggacaccaaggcttgggggagctgctgtggctggcagtactttgtatacattgctaattgtctcttatagcttggctgtgtccccacccaaatctcatcttgaattgtagcccccacaattcctacgtgttgtgagagggacccagtgggaagtaattgaatcacaggagtggtttcccccatactgttttcatggcagtgaataagtctcacaagatctgatggttttataaggagaacccctttcacttggctctcattctctctttgccagccgccatgtaagacatccctttgctctcccttgctcttctgccatgattgtgaggcctccctagacacgtggaactgcgagtccattaaacctctttttttttttcataaattacccagtctcgggtgtgtctttatcagcagcatgaaaacagactaatacagagcattaggagctatccttctaactccactgggagaaaactactggaaacttacccctggtctctcttggagagacctatgcatcttgtaccttggttgattttaatctgtatccttttagtgcaataaacaatgttcatggggacaatggctttcctgattctgtgggtccttctggcaaatcaatgggcctgagggtggtcttggagatccctgacaaaagtcactgtagccagggaccatcttctgttgagcttatttcagaggaagatgtcataggtaacgggcgttgggggcaccctggttccatttgttgactctgctacccagaagtgaaagaatgtcgcatctttctcatctctgtatggtcccctgcagtaaagagttgactcaggaggtctggggagttcaaatcctgcacattcctaagaaaggtctggcccttcactggctcctggaagataaccactaagtctttgcagcattgtgcctgataagggtgtctttatttgcctttgttctagttcttgttctaggtgctggtgatagaactgtgaaccaaaggtcattgccttcaaggagtttatattcaagtggagaagatggaaaaccctcccctcacaaacaaacagactctgaaacctgataaataaatattagcattcagtgaagtgttaatgagtttctgtgagcacatacaatccttagcagagtttatctcatcctgcctgagctagcccctgcctccctccccagcccacatattttgccacacccttttcattcctcccaacattccaattccttcaacacatggaactccttctcaccccagggcctttgcacatgttactatctctgtataaatgcattcctctcacttgacacctggataactcctcattgtcctagtcttagcttaaatgtcatcatctggccaggcctgatggctgacacctgtaatcccagcactttgggaggcggaggtgggaggttcgcttgagcccaggagttacagaccagcctgggcaatgaagtgagaccccatctctaccaaaagaaaaaaaaaatcaaaaaattagctgcatgtggtgctgcatgcctgtagtcccagctacttaggatgttgaggtgggaggatcatgtgagcctggaaggtcgaggctgcagtgaactgtaattgcaccattgcacctcatcctgggtgacagagtgagactgtctcaaaaaaaaaaaaaattcatgaccttggggaagcccagttggatactctcctctttccccagaccagctggatctaccatcataggctgttatagcatgcatccaattctctctctctttctctcgctccttttttttttttttttttgtagagatgcagtctcactatattgccagggctggtcttgaattcctgggctcaagcaatcctcccacctcggcctcctaaagtgctgggattacaggtgtgagccaccatgcctggcctgttacctttcatttttatttcagtcatcattctgagtggctgagcatatggatgtgttgattgttgaaataaatcatttaggcaaattgttacgggccccatctaaattcagaatccagccatggatctggtctgtaattcttcccagccacactcttccctgttggagtccgagttctccactctagacctgcagcgggaagctttccagggaccagccagttccaccgcctccagagccacccctcacctgctgacctcttcctatgttagctgcccctctcgctgcctgctgcccttccccgggccagctgatacgagagctggcgataacttgaaatgctccccgcagaagataaatgagaggggaatctcagcaggcattgagctctgtacctaacgactggcagttggggcttctaattttaggcctgggaaggaagctgatttctgtgatgaaggtggccacacgctttatcaagggccaatttagcaaaaatctaaaatgtatatgaagccgtggtaagtctggattttcttggtatttatgctgggaggttacttaatgagcgtttgctgtgtgaccacattgcggtattaatcataggtggcattataattctctaaaataacagccataaggcatcagggcaattgaggcttgtattaagggaatggtccttttttttcttgctgaagttaggcagcatgaggctggtgtgtttttccttaaggcaccaaggcatctgaggttttgcactgggaatccctgggctctctgggccctctgggtccctagggtcttctacttgccaacacagccttgggttctctgcttcctgttggggtgacaggaacacattggtggtctctgatggatataccaggcgctctgcataatttttcttcttgcttccgggggtaactccagccccatcccttgaaggtgaattttatgttatatatatatttttttgcttaggcaagtttgatttgggttatattttcatcataaagaatcatgactattgcaaatcattatatagaaaagtgattttattcttgagcctgagatattcacagtgaaaatgacaacacattatttctgagacacctgctgggggcatccaccactttcccccaacccattctctctattcacctccaaccaattttatccaaaagccagctcagctgactgtacaaccacaagggatttggagttagatggatatggcatttatcagctgaatgatcttgggcataatactcaaaccttctgtgcctctgttttctcatctttaaacggggatagcacagggttggtgtgaggaataaatgagttattattgtcatagtaatatactaacatatagttaaatataattctatctgtcagatgtagacaggggtggagaatgccttggaagtcatttcttcctacagaataagtgatatggttttgctgtgtccccacccaaatctcatcttgaattctagctcccataattcccatgtgtcatgggagggacccagtgggagataattgaatcatgggggcagttcccccatactgttctcatggtagtaaataagtctgataagagctgatggttttataaggggtttccccttctgcttggctctcattctctcttgcctgctgccatgtaagatgtgccttttgtcttccgctatgactgtaaggcttccccagccatgtggaactgtgaatccattaaacctatttttccttataaattactcagtctggggtgtgggggtatgtctttatcagcgtgtgaaaatggtaccataaggaagtaccttaaggttagacaataagtacaataaggaaggaggaccgcaatccagtcttgtctcccagagccttggcacagaaagatggtaaccaatgctttgtcttggaaaatccctcctacctgctggggagacaaaggagcaaatccagcagaagatggaggggaagtgctggttgagttgcttggcaccccttgccttttttcaccctcttcctcagctccctgatcaccatactctccctgtgtcttttggctcctgagatcagttgttgatgaaatgctgggctgcgctcactcccagagtgggaggaaatggatgtgggaaccctcttggggagatgggcagttaccggggcccagagaaccaatgagggctttatcctgcagtcagagttcaacaccagcccttcccagaatcaatcacaccctcctttccactatttcactgtctgccgtgaactaacagacattggttgtgttgccctcagattcataggctgaagtctaacccccaatgtgatggtatcaggaggtgaggcctttggaaagtaatgagatcatgagggtggagccctcatgaataggattagtgcccttgtaagaagagatatgagagagatgatacccgtctctccaccacatgaggacacagtgagaaggcagccatctgcaagccaggagagagtcctcaccagaccctgaccatgccagcaccctgatctcagacttcccagcctccagaactgtgagaaataaattgctgttgtttaagcttcacagtctattataatttgttatagcagctcaagctaactaagacactaccctgacactctatttcagaaatgacaaggtttgggctgggtgtggtggctcattcctgtaatcccagcactttgggaggccaaggtgggtggatcacctgaggccaggagttcaagaccagcctggccaacatggtgaaaccctgtctttactaaaaatataaaaattagcaaggtgtggtggtgcacacctgtaatcccagtactctggaggttgaggcaggagaatcacttgaaccttggagacggaagttgcagtgagccgagatcataccacttgtactccagcctgggtgacagagtgagactgtctcaaaaaaaaaaaaaaaaaaaaaaagatgagatttgacttcacaaactaaaacttttgttcagagagaagaggaaaagggagggtgggggaaaccacccatgctcccaaagatatgagacgtagaattgatctaagtgccacaaagcagaatttttctgactccattctgtttctcctgtgataattcagctgctttcaaattcctctcctctcagacggtcctgagaatccagtgggagttttctctgtgctccagaacatagtggcctcttgcattcattccctaccagaaataatgtctcattcaccagctattttctcagccaataatttttgtccacccccattcctccttcagaaacttgcccttcccagagccctaggagacccagaaccccataggattcttttggctctggccatggctgtgtaccaaggggttggatatgggattacagccaggccatgtggactctctcccagaaatttggagttgaaaatctctgagcttatctctggaaggtgcttgaaactagagggggatagaaagttggtgacaatatagtcatgtttggcctgtggacaattgcaatagaaaaaactgatatgcagggtgatatggtttggctgtgtccccacctaaatctcaaattgtagctcccataatttccacatgtcatcggagggacatggtgggaggtaattgaatcgtggggcgggtttttcccatgctgttctcgtgatagtgaataggtctcacgagatctgatggctttaaaaaggggagttcccctgcacacactctcttgcctgccaccatgtaagacatgactttgctcctcattcgtcttctgccataattgtgagatctccaaagccatgtggaactgggagtccgtgaccactctttttctttataaattactcagtcttgggtatgtctttattagcattgtgaaaacagactaatacatgggggggcggagagagagagagggagagagggagatggggagcgagaagatgggggagagagagtgagagagagagacagagagaaagaaagaagagattgagaacacaatacagacttaggaaggacagaccgggagctcccagaaagacagagacaggctgtgttgactcctgctatctttctatcccaaaaccctgctgtgctttctgactttggttttgtgggatgctttatttaataggttgaactgtgttctccaaagagatatgttgaaagccctaacatctcagtaccccagaatgtgacctctgttggaaacagggtcattgcagatgtaattacgaagatgtgatactggagtagggtgggcccttaatctaatacgagattgtccttagaagaagtaggaaatttggacacagacccacagggaagacccccttgtgacaatggggatagcgattgaagttccattttaatgtacgtgctgccgaagcgagcacaaggtagagattgaagtgaagctgctacaagcccaggaatgcctatggttaccagaagccaggaaaggaaaggatgggatcttccccagaggctcggggtacagctttgtgaaccccttgattttggacttcttccctcaagaattgtgagagaataaatttctcttgtttcaagccacctcgtttgtgctgttttgttaatcatccttaggaaatcaatatgccccttatccttcttgaatgagctctgtaccttataatgagattattgcagtctaaaaatctagaactagttgcaggaacatcacagacaagggaaagtttgaaccacaccatggatgagtgacaagcttggaaaagaagggcacttcacctctgtggtattctttgcaaaaactcatgacctgagtctaatcatgaaaaaagaaaaaaatcagacaaactcaaatggaggctaatacggtttggctctgtgttccaaatctcatcttgtggctcccataattcccacgtgttgtgggagggacctggtgggagatgattgaatcatggggacaggtttttcccgtgctgttctcgtgatagtgaattagtcttatgagatctgatggtttttaaaaatgggaatttccctgcacaagctctttttgcctgctgccatccacatcagatgtgacttgctcctccttgccttccaccatatttgtgaggcctccacagccacgtggaactgtaagtccaataaacctgttcttttgtaaattgcccagtctcaggtatgtctttatcagcagcatgaaaatggactaatacagagatatatcctgcaaaatccgtccccagtactcctgaaaactgccaagctctgtagagttagagttagaataccttttgttgttgaagatgtgagggaagtatgcatgtgaattgactgctgaattcactttttttttttttgagacggagtctcgctctgtcgcccaggctggagtgcagtggcgggatctcggcgcactgcaagctccgcctccccggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccctgaattcacttttgtgccatttttgtaaatacaatagttttgtacaaccttagaaaaataaggaaaggctgaagaagctacacatttggttggtgtggtttctaatgtagttttattttacattaaaaggtttagacaatgggtcctcatggcagttgctggtgacttaccttgtagttgtaaagctgggttcttgttttctttttcttttaaatgaaattataataataataataataataataataattattattattattattattattattttgagacagcctcttgttctgttacccgggctggagtgcagtggtaagtcgtagctcactgcagcctttaactcctagattcaagggatcatcccatctcagcctgccaagtagctgggaccacaggcagatgccttcacgcctggctaatttttaaattgttggtagagatgaggtttctgtatgttgcccaggctggtctctaactcctgtgctcaatcgatcctcctgcctcagcctcccaaattgctgggatgataggtgtgagccactgcacctggctgaggccttgttttcttgctggctgtcagctggggacctctatcagcttctagaggccacctgcattctttgacatggccctgtcacaacatggtagcttacttcctcctagccagcaagggagtccctaagtctcctaaggggaaatcttatttggtgaaatatgatcaagggagtgacatttggcacctttgccatattctgttgattagaagcaggtcacaagttccatcctctctcaggcggggaggcttgtacaagggagtcaccttagctgtgtgcaatcaggaatacagcccaggggccgtgcctgacagttaagaggactcagtgtgatcaagctgatcaatatgaagtgggttaggcagctgccagtgctaaattctgtttgggagttttccaagaaccagccctacccatgagtatctctctgggtaaacctcctgcaacttgggagtcaccttagctgtgagaaccgtttttcgatcttaccagcaaaaatgacagcccagggtattccaggcagctgcttctccagctccaggcagatgattttggccctgccttgcaacagaaatggaatcgtttcgaggggatggtctcctcgctctggatccagcagcagcagatgctccagccgaagacgtgtgtccactctgagcaaggttgagagaatcaaattaatttcttttatgacccgaggcaagcttgaaattggctcttccaagatgaaaaaggagaggcaggagtggcttgcctggctccctactctccttctcctcctgcctccacctccttcccagcagggctccagcaatttaatcggggtgggattccttccaccaagcaaggcagtctgtcacgcgccgctgcagtaggggccatgccagagacagcttttcgaagcggcatctgtgggcagacatttgggcaaccccactaggctggcaagccctggtcgatttttagtgacctcttagaagtagatgggagggactgtcagccatgccggaagtgggagagagcagaaggggtcaaagacaagcctcggctgggaagagcatctctgtggtcctgtaattgatgattggggtggggagcattgaaacgtttcccttgaatcacagccttcagtgagaatggctttgcctgctgtttggacggtgtgttgagagtagggtaaccatatgtcctcatttgctgcaacagtccctgttacgactgctttcctggttttgcctgtctcgaaagcattctggtttgggcgataacttataaggtcatcctaattctgggtttcacagtctcagcactgtggacattttgggctagataatcctttgggtgagggttgtcctgtgcactgtaaggtgtgtagcagcatccctaggctctgcccactagatgccagtagcacaaccccctgccccattgtcattgccaaatgtcccctgaggggaggaggaggaatcacccctggatgagaaccatggcccttttttaagggcactgttgaatccttccttctgataccatctgggggtaacttgagtacttggttcatgttctggaaggaaaaactccacatagtgcttctgggttcatttagcccatgtaagcttcgtttttctgtttcttagaccagtatctcactttttgcagggagaggtgggacctctcctccattctcagcccatgtgttttgggtgactcgagagactgggtttggcagatgggagaatgccattctcctggctgttgtgattgattcagaaacctgcctttaaggtggttcaaagagcatcagtggcaggacttctgttaggtggatagggaaagaggggttctctttttgctggggttgcaaacctggtagggtggaaaccgggagctgctggtggtcatctcatcaccctgggggagagcctgcctgagaaggaaatcacaggagagccgagctgagagaggagaaggaaagccgatcacactgtctaacagcctgtatcccctccaacctgatgacagatctcacctagagtgaatttctcagtgaagccagtttgacttgagtttctgtcaacttgcaactcaaaaaggccatgtgttgccatgaggtatttctctgttccctttcctaatctagagattaggtaactttaattctgctaatgctgagttttgtctcatcaaatggaaacatcacagaagtctctgatcttgccccatcaacccttcccattacctctagggctcagccaatgctgctggtatcttttgcttcattttttcttttcttttcttttgtttctttctttcttttttttttttctgaggcagggacttgctctgtcacccaggctgaagtgcagtggtgtgatcacggcttactgcagcctcaacctcctgggctcaagtgatcctcccacctcagcctcctgagcataggtgcacaccaccatgcctggctagttttttaaattttgtttgtagagaggggagtcttactcaatcattcaggctggtctcaaactcctgggctccagcaatcctcccaccttgatctcccgaagtgttaggattacaggtgtgagccactgcatctggctgcctcatttttcttaatctttcaagactctgtagaaataatacctactccttttcattcctccttatctcctgtcttcctttccaacactatagccctcttttcattattacccacatttacaaaaggtctttgtaacttaatggcatacccagacagaaataatgttctctgggttaattatctagtttgccacaatctcctgtaccagattctacccagcctgctctgattataaaggggactattgagaaatagctgcaaaaatgcacaaaaccataagaattcccattctaagacccagagcagatggcttttggattattcccttctctttttctatcatatgtttacataattgagttcatcatctatatgaagtcttacatacatatatttttataaagatataaaattatacaatcaccccaattaaaaggcatgaacattattttaataattggaagaagatttcattgtacgaacatagtgtaatttcagaaacatttttctgttggttgacacttcattttttaccatttgcaataatgtgatggcttccttgggcatacatctttgtcctcaactggatgtactcccctaaaataaatttctaggagtggaccttctgggtcaaaatgggtgagtatttgtaaggctcttgatacatattgccaaatgaccttccagaaaaattgtgcctgtttacatgcctaccagtggcatggaagggtcagatgtcagaatcatgattgcaattattgataaagatccagctagttccagttttgccaacaatattaacaccaccagcacatccaccaataataataataacaataatggtatgataaataaaataggtgatatggtttggctgtgtgtctccacccaaatctcatcttgaattataatcaccaggtgtcgcgtcgagggagggagctgtaagccccacgtgtcgaaggagggatgtgattggctcatgggggtggcttctcccatgctggtctcatgatagtgagtgagttctcatgagatctgatggttttaaatgtggcagttttttcccgtgctctcacttctccctcctatcgccttgtgaagatgtctgcttctccttctgtcatgattgtaagtttcctgaggcctccccagccatgcagacctgttgtgagtcaattaaaccccttttctttatcaattacccattcttggccagttgtttatagcagtgtgaggatggactaatacaatagacttattgggagcttgtaatattctagctatgttactaaaaatttcacacattatttcatttagtccatccagtaacctagagattaggtattattataattcccccatttacaaaataggataataaggtacaaagacgttaagcatcttgcctaatgaccacagccagtaaatggtggatcttagatttgatgccaggcatctgacttcttcaagcattgtttactgttttagtatgacggagatgactagttggatgtaattccacctgaatggctagctttactgtgtacagatcaccaaagatctaccttgaggaaaaacattgctatacattgcaaataatagtcagggctctggtattaatgtttcccagtctctccctcctaaggacattgtcaccctcccagacaggtgtgtggtagaaggaaacgactctctcctgatgctatgaattccaaagaattcccattaaccatatttctaagccagtttgctttctttcaatgtgcactttctgcaaaatgccatctgcacttgtttcctggggaaaccatctctctgaggtgggtaagttctcattgtgaagatggggacttgcctaatgtttggcattccctttttggggcacgtacagtgatttctgaactgacttgaaaggccattaacttggtttttactgccttttctggcttgcaaatttaatgcctggctcccaacatgtgtgaatggacaaacagcatcagcatcatctgggaacttgctagaaataaaaattctcaggctttaccctagacttacagaaccagcaactctgagggtaggttccagaagtctgtgagtttacaaatcttccaggtgattctgatccgtgctaaagttggatctactgctctaaaccttagtttcttcctttataaaataatagtagtagtagctgtagcagtaataataatattggcttcatggttatagggggaattccatgagtaatttgagtccttggcactgtgcttggcatacagtaggtgcttaataagtggtagttggcatcactatctctgaactgtgaaggtcgctgtgcttaacctatgtagtatttatcagccccgcatcccactccgttcagggatggcccttctcctgcctgtgggtctggtgggaccactctgcagaatttcttatgcccagatcttctatcatggtgtgacaaaagcatggcccatcaaatgcctgccttctgggaatttgcatcttaaggagagatcatcaaggatgtagagtgattagagtccggtcattccacgaccctgcagcctagtgcttctcaacctttaatctgcttaacgctaactggaggatcttgttcgagggcagattctgactcgaaaggtctggggtggttctgagagagagtctgcatttctgacgagctctactggagatggtgatgccagtactgctggtttctggactcacggtgcagttgcatcccgagagtagtgaatctcatttttcaacctcaccttagaatcacctaggggaggtgtgaaacaagacagacctgagccagttaaatctcagtttctttcctttttgccttgccttgctctgccttgccctgccttgccctgccagggtctcactctgtcatctaggctggagtgcagtggtacaatctcggctcactgcaatctccacctcctgggctcaagctatccttttgcctcagtctcctgagtagctgggactacaggcatgcgccaccacatccagctaatttttgtatttttagtagagacgaggtttcgccatgtttcccaggctggtcttgaactcccgggctcaagtgatctgcctgccttggcctcccacagtgttggaattacaggcataagccaccatgcccggcttaaatctcaatttctgagggtgagggcccagcatcagtggtttctaaaagtctctttggttgactgttggctgcagtgagggttgagatccaccaccatacaaagatggtccaactggaaccccctcaagtctgggaactctattctttctctgatcctgtaagctccccgctttttaatgtaaagatttggttctgttggctgggcatggtggctcacgcctgtaatcccagcactttgggaggccaaggtgggcagatcacgaggtcaggagtttgagaccagcctggccaatatggtgaaactccgtctctactaaaaatacaaaaattagctgggcatggtggcgtgtgcctgtactcccagctactcaggaggctgagggagaagaatcgcttgaacccaagaggcagagcttgcagtgagccgagatcgtgcactacactccagcctgggcgacagagtgagactttgtctcaaaaaaaaaaaaaaaaaaaaaagatttggttctgttgcttgaaaactaagaaccttaactgatagagcctcagaaatgagaagagagtcaaggtgagtgttcattgcctctgggctctccagctgcagatcctcttgcttctctgtgcttctctttgggatgacaccacagagacattaaaccttttggagggcccgtacagtaatttctgaaccaacttgaaaagccataaacttggtttttcctgccttttctggcttgcaaatttaatgcctggctcccaacatgtgtgaatggacaaataaaagaggaactgtcccttcctctctttgcccccatcaagggccacctgagagactgtatctctttaggatcgcttagctctttcctcagtcccaggtctggattttgcgggtgacagcttcaccagtatgtgacaagccatgccaggtgaccagagtgtgaaccagcctgctcacctgtcaggtggtggtaatgaaaaccgatggacctggtgcggtggctcaacacctgtaatcctaacactttgggagtctgaggtgggaggatcacgaggtcaggagttcaagaccagcctggccaatgtggtgagggcctgaagtagtgggaacagagggtgactgaggcagagtcagccttaaaagatcagtcgctaaaaaggacttcaactgcctgcctttggggagagggatttgatgggagaagggctggggtaagacagctttgttttccatttcaagtcatttgtatcatttgcttgtactgctttgataaagagaaatctgaaattctagaaaaaattagaagtgaaaaaaaattcctttatagccatgagcagaaccgttaacaatagcagccgggtatggtggctcacgcctgtaatctcagcactttgggaggccgaggtgggtggatcacctgaggtcaggagttcaaggccagcctggccaacatggcaaaaccccgtctctactaaaaatacaaaaattgccaggcgtggtggtgggtgcctgtaatgccagctactcaggagactgagtatggagaaacacttgaatccaggaggcggaggttgcagtgagccgagagcgctccattgtactccagcctgggtgacaggagtgaaactctatctctaaacaaacaaacaaaaagcaatagcaatagcaacagtaatgacactaacttatattgatgtgctagattttatccatgtcacctcattcacctttagttctcactacaaccttgggtgacaaacttgtgttggctttagcactttactggatttgacactgagcgttccctatacctggaaccacttcggtcctagataaaccaaagaggatggctggtcaccctactacagccccagaggcagctgctattaaccaatgcatgctgcaggggaggaaactgagaccctgagaacttctgtaactcgcatcatggtcacacagctagttagtggtagaaacaagttacataccgactcggtggtggacacaattaagggtcccacagtcagttagttgtagaaacagttaagagtcacacagctagtcagtggttgacatagttaagggttgtgcagctagtcagtggtagatactgttagttaagggtcacataggtagtcagtggtggacacagttaagggtcacacagttagtgatagatttaagggttacacagctagttagtggtagatacagttagttaagggttacacagctagttagtggtagacacagttaagggtcacacagctagtcaatggtagacagttaaaagacacatggatagtttaagacacatggatagtttagtggtagatacagttagttaagggccacacatctagtcagaggcaggtatatttagttaaaggtcacaaagctagtcagtggtaggtacagctagttaagggtcacaaagctagtcagtggtaggtacagttagttaggggttacacagctagtcagtggcagacagttaagggtcacaagactagtcaatggtagacaattaaaagacacatggatagtttagtggttgatacagttagtgaagggtcacacggctagtcagtggtaggtacagttagttaagggtcacacggctagtcagtggtaggtgtagttagttaagggtcacaccgctagtcagtggtaggtatagttagttaagggtcacacggctagtcagtggtaggtacagttagttaagggtcacacagctagtcagtggtaggtacagttggtgagccatctcatcactcgtttagtagtagagcttggattggaaccaggtagggctgtgtctgttacattacatcacgtcacatggagtctcagagctgaaaggactttagggtcgccgtgtctattccccttgtttgtagatggggaaacttgcctgagtggcggaacgccctacccaaggtcgcatggtgagttttgggcttctaagagaccactggaggaagtcagggagacatgccctggcagggacccgtccggaggcctgccaattggctttgagaggagcgcgtcttgcatctcccaggaaggattggcagagggagggcgggcgtctcgggccgggggctggtgcccggggctggggctgaggggagggggaggctgcttctctttgtaatttacatacacagcagcaacagcctgggggaaaacaacccaaacaaactctcaaaggatgttttggacttaatcccgggatcggaagcagctcggtaagataaataagataaagttggtgtgcctcttaaggttgaacgatcatatcactattgcatttgaaatattcatgaggggaagggaggtatgagaaacagctacagaaacatattctgctttgaaaaggcagaattcaaaggcatgaaaaatgaatcaggggaaattaatgtcgaggttgggaggggggtgggctggtggggggacaattattgcccagaaggaataaggaaagagatgtggaggagatgtttcagactgggccgtgatcagaattctgtatcctgcctggaatatttgaaatgtcaattgtctcatatatcatttgaagtcaatacttggtcgcaaaatggatgattctagcaaggattaaaaagcagggtgggctgggggatatgggatggggagggtggagtggggtggggcagggagatggaaaaagatgggtaaagtgaactaagtcctataaattgtggacgaattactgatcactcaaagagggctctggaggagtaagatgcaaagaaacgggaatttcttgtgatttcttgcaagtctctcggtcttggtttctccctttataaagccaggaggttgggctggatgttctcctagatggtcccactttgccttgtggagggggtggggctctgatttggagatgtgcttggaaatagagggttccttaaggcaagagggtcaagggtattgacgaacggtagcaatacagacatgatgcttgtggttaatggtggctctcagcagagccctgcaagtctacaccgtgttaggggggccagtggggtttggccccatttaaaagcaagcccttggactgtggactggcgcggtcattctagagagatctgacactaaagcaaatgaaggctgcatattctctgtggtcccagaccagcagcatcagcatcacctgggagcttgttagaaatggaaattctcgagtctccttccagacttcttgagtcaaaatctgccttttaacaagatccctgggtgagtcctgtgcatattaaagactgagcagcagcaattcccctcctggatttataccccagagaaagtttcacccaaggatgttcaaggaggtgggtttgtggtagcggggtattggaagccactgctgtgcgcatcagaaggggatagataagcaaagcatgacagatactcactgtgggatatgactgtggtagttagaaaaacaggtctgatcttcacatgccagtatggacggatcttttattttatttatttatttatttatttatttattttgagatggagtctcactctgttgcccaggctggggtgcaatggtgcaatcttggctcactgcaacctccgcctcctgggttccagcaattctgcctcagcctcccgagtagctgggattacaggcgcccgccaccatacctggctaatgttgtatttttagtagagacagggtttcaccatactagccaggctggtctcgaactcctgaccacaggtgatcctcccaccgcagcctcccaaagtgctgggattacatgcgtgagccactgtgcctggcctggatggatcttaaaaacaaagcacaaggggaaaaaaagtgagcaatagaatcaatttatagcaagtgtctttgtttgtgctgctataaaggaacacctgaggctggataatttacaaagaaaaaaagtttatttggctcatcattctgcaagaatcatggcaccaacatctgcttctgatgagggcttcaggaagcttccactcatggcagaagtgaagaggaactggtgtgtgtagatcacatggtaagatagagagagaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcacgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaagagagagagagagggagataagaggggtatgaggaaggaggatgagagaaggaagaaggagacagggaagaataggagacagaggagggttccaggttatttttaactatcagttctcggccggatgcagtggcttatgcctgtaatcccagcactttgggaggccgaagtgggtggatcacttgaggtcaggagttcgagaccagcctggccaacatgtcgaaaccctctctgtactaaaaatacaaacattagccaggcatggtggctcttgcctgtaactccagctacttgggaggctaaggtgggagaattacttgaacccaggaggtggaggttgcaatgagccgagatcttgccattgcactccagcctggccgacagagcgagactgtgtcccaaaataaataaataaataaataaataaataaataaataaataaataaatagaaaaaaataaaaacacaaaaattagctggatgtagtggcgggtgcctgtaatcccagctacctgggaggctgaggcaggagaatctcttgaatccgggaggcagaggttgcagtgagctgaaatcgtgccactgcactccagtctgggcaacagagtgagattacatcttgaaacacacacacacacgcacacacaatcagttcttgcaggaactaagagtgggaaatcactcactcttgagagaatggcacccagccattcctgagggatctgcccccacgaccaaaacacctcccaccaggccccacctccaacactggggatcacatttcaacatgagacttggcaggggccaaaacaaaccatatctagaccatagtatgacacaatttttattggttaaaaatgtatttgtacacaagacagtatgcttaaagctacaagagggcagggatttctgtctattttgttcaccgttgtcttcttgccacattctgaacactcaatatttgatgagcaaatgcacttcacaagaatgcgcacacattcaagagaagaggaatacctcagctgagggggttttgcactgcaccgtggtgatgccagaaactcaggagtaattcactccactttctgcacctggggtgaaatagaagcccaatcttgtgtgagaggtgagggggagggtggccgggctggcctacgtttgcagagcttgttccatttcacagtggcttggctgccctgcccttggtccctccaaggtcctgcttgctcagctcttggcttgccaccttcctgctccatctctaaggctttattggctgttcctgtagaaacagactctccaagtcatggctttttctcagcattttgcatgtaccacctcccttatcctcacaacactgcctacaacactggttctcaactggggacacttccatccccataagggacatttggcaatgtctggagacatttttgattgtcacaactagggtatactgtgctactgtcatccagtacgtagaggccatggatgctgctaaacatcctacaaggcacagggctgtccccagactccccagtaaagaacgatcaggtccaaaatgtcagtggtgttgaggctgacctagggtagggggctctaatatctctattttatatgtgaggaaacggaagcatggtgaggttgggtaatcctgtgtgaggtcctgcagctggtaggcaatggagatggggtatagaccaagtgagtctggctctagagtccttgcttttaaccaccatacatgattgcttctcagaagtggaaaacgctgagacaggcacagctttttatacctttactcacttatgttacggcgagggtgaccagctgtcttggtttgcccaggcctgagcggattcccagagtgtgggacttgcagtgctcaagccaggatggatagtcaccctagtaacctccagactctgtagacatctgtgtttgtgatctgattgttactttcagtctgttgagttcatattactgatgtaagagttaagaagagattatttaggcagatagtgagggtaaggaagtcctcagtaaggttttccttttaatgaaaagcagtccccaaatcatttttcttttctaacggagagcatcctgtaaaatcaagctgcagacataggcaagcaagctggaagcttgcacgggtgaatgccggcagctccgcccataagaaaaggctagctggggctaggcacgtccaacagggcagctccatcttcccttctctttgccagccatgtgtacagtaaggagcaggcaacaaggagccagccaggcaaagaccccatttgcataataacactagggtggggcggccaacttccccatgcgctatgtaaatgtcacacctggtgcaaccaatctttgggccctagtaaatcaggcaccgcctccccaaccctgtaaaatctggtgcactctgacttgggccagaagtcccactgggtgcccccctctcggaagagagacagtgttctcctttctcattcttttgcctattaaacctctgcttttaaactcactctttgtgtgtgtctgtgtccttaatgtttttggtatgaggcaacgaatctcaggtattacccccgagagaatgatgctgcttcactctgtgctaatcacaattgacacaagggccgaatcccagtctcaagttcacctacgatgactttatcatccacatggctcaaagctgtggtcaagtttcctcctgttttgaaaatatgtgctatgctccagttaagtcagcacagctctaggtagatcaaaattcatctttggaggatttctgaaattcacttgaggagtagatcagttggggatggtgtgatggaggaaaaagaaaatcccaaggtttgatggcaaggttagagtgaccttctgaccttgagcaaatggcttaagctgtctgggccttgatgtcctcgtttataaaatgagtccgtaataaaagccacaatgatgagcatcaggcactgtgctgagtgtttgccatctaaggggttatctggttatctcatttaatcatcacaaccacgggaggggaagctcctggggttaagtgtctcgcccaaggttgcagctggtggggaatagtctggttgcaaacccagagaccacacttttaactgctatggaatgttgtctcccgtggctgtttctgaggagatagaaaaacatgccaattagggccaaaaaaacgggaggtggcctcaagggcagtgcattacattaagagtgtttgcaaaggcgtgggtgtttctccacccccgagtcgctgctgacttcccgacacctacacgcagggtcaccctgcagcttctgagcacctggccggctccccccagcaatgtgtgtttgatgttatcagggggtttgaggcacggctgaggccccaggaatctttctctttcatggagaagccaagctcacatctcccagtggcagctggtgctggcgtctggctggagttgcagggactatgtgtcagctctagcagttcctgcgactgtattcacctactgaaggtccttgatctattgctggggtttgccaagggtctcaggggtctgctgcggagcagagagactgattattattttttaaatctccagttgacccccttgttctcacgttaatcactttgagaataaaaatggctaccaataattgagcacttactacgtgccaggcacaggcacatcctatgcctccctccctcctcctccggggctgctggctctccttatcctttttatttttgcttttttctccacagctagtaactgtgttctaaacaccaataagagggcctggcaaatgtggttactcaataacatttattgaatgaatgggtgtgagcgagtgtgtgttaggctccctgctaagcccattacgtgtattattttactcaactctcacagtaatcctatgagataagcttcatctttatctccatgttacaaaggagaaaatgtgctcagagatgtcaagtaatttcccccaaaatgcacagcttgtgtcaacgcaagaatgcaaatttagcagtctccaaattctaccccatttactatctcccaaatagatatgtataaatatcccacatatggagatacattttaaggatttatacgtatctatttccatgtaacacggccacacatatgtatcctatataatatgcacatgtatagtatgtgcacatattcacgtgtaaatgtatcagttacctgtagctgtgtaacaagtaacaccaccctcatggttataaaaataaacacttattttttgctcataggtctgtggtttagctggagagattctgctttaggctgtgggttgagttcaagtctgattcttacatttatttctgaggtccagattggagaagcagtggtacctggtgaaggttggcagcttccagagaggagtgagcagaaatactcaatgccttttaaggcctaagctgggaactggtgcaccgtcagctctgctcatgttccattggccaaaacaaacccatcactaacagggcagaggattctgttcttcccatggtgaagggaatgagagggaagtaaatatttgttaaacaggaaaacataccactatcatattttaattatatatggatgtatttgtattttatctttttttttgagatggagtttcgcacttgtcacccaggctggagtgcaatggcacgttcacggctcactgcaacctctacctcctgggttcaagcaattctcctgcctcagcctcccgagtagctgggattacaggcacctgccaccatacccagcttttttttttttttttttttttttgtatttttttttttactagagatgaggtttcaccatgttggccaggctggtcttgaactcctgacctcaggtgatccacctgcctctgcctcccaaagtgctgggattacaggcataagcctcggcgcccagcctatatttatctttttcacccatgaccccagcttcagtgaggagttctgttactttgtacttttactgggcattcgtttccttgtttggaaaatagtgactataattaataaaagtgtttgtattcttgcaaattgctaagagagtaaatttgaagcatccccaccacttgttaattagcttgatttcaccagtccgcaatgtatacatatttcaaaacatcaggttgtacacaataattatagacaatttttgtttgtcaattcaaaaagtaataagtaaaggaaaagaaaaatgtaagatactttaaaaaatgactggctcgtgttgagaagtaacttttactatttatttgtttttttgtttgttggttggttggttttttttttttttttttgagacggagtttcgctcttgttgcccaggctggagtgcagtggcacgatcttggcttactgcaatttctgtctcccggggttcaagcaattctcctgtctcagcctcctgagtagctggcattacagatgcccaccaccatacctggctaattttttgtatttttagtagagacagggttttgccactttggccagactggtctcagactcctggcctcaggtgatccacctgccttggcctcccaaagtgctgggattacaggcatgagccaccgtgcccagcctaacttgtactatttatttgagttaagccaacacacacttgagttccccacatgtcatagagtgatgtggacaagcccttgaaatctggctttcctgattacctggttgaccttgtagatgcctctctgagcctcagatatgttctctgtgaaatgggcatgaaaccagtacccactttgtagagcactgtgaggattaagtgagaggatacgtgcaaaagtttaccacagtgcctggctccagaagccactcaatatatatttgctgttgttattaatattgatactattcttacaacaaaaacagcacagatgttctaatgatcaattatcctagcctgtcgtctgctggtccccagcccatgtttctcggaccctgtctgtgtgtgatttatgatccgactctctctacactttgtgttggggtttgatttttcctgctttggctcaagacccccttcctacagaaatgtttggacccatcttacagacttgtgcctccttggctgtcctgcctggtcagccccttggaacacagggttggccctaagttggtcctcccatcccagcaaaatggttcactggggcattgcaggttgattgtggaatttcaacaatagcatgggtggtgggaaaaccttcggacatccacagacagcagcctggatgtataagagatgggggtggtgttctttccatctggagtcctccgggagctgtcaagcctggaatctttgcaatttaggcagtctgtttgtaatggtctcaagaaaacccattctgcctacaaacgcggtgacctttaatttttttttctcagatttttccaagatgcacattgactcttcctgtcaacgtggaaggctctaatgccgcctggggcatttagattgcatttgccaatcgctgactgctgtagccaatttgttcctgatctcaaggtcgattttgaataactttagctgggctaagtctcttgcattgaataactgggaaacaacctattaaggtagcaggcgggcgggggcaggagggggcagggggctgtttctattttgtagaagttctttgattttggataaatgagaaggcttctagctctgccagtcatggactatgtggccttgaacaagggagggaaagaaagaaacacatgccaagtacctagcatatgctagacacagtgctgggcacttcacacatgccagctgcttaatctactccgcgaggtgaacatcgtgatctccatgttacagataaagaaacggagtcccggcaacttgcagggttgagcttggatctgtctaaagccccgcccctccccctttttttgtttgtttgagacggagtcttgctatgttgcccaggctggtgtgcaacagtgcaatgatcttggctcactgcaacctccgcctgccaggttcaagcaattctcctgcctcagcctcccgagcagcttgggattacaggcacgtgccaccatgcccagctaattttttatattttttgtatagacgaggtttcaccatgctggccaggttggtctccaactcctgacctcttgagccgcccgcctcggcctcccaaagtgctgggattacaggcgtgagccaccgcgcccggccgatgatgctctttttaaactatccttatgagtgtatttcagcaacctcccccgacccgaattacagtaccacaggctgcgtcctaatgctgtgccctctcctgatatggtctggctgtatccccatccaaactcaccttgaattgtaataatccccacgtgtcaagggcggggccaggtggagataattaaaacatgggggcagtttccgcatacggttctcatggtagtgagtaagtctcacgagatctgatggttttataaatgggagttccgctgcgcaagctctcttgcctgcccctgtgtagcatgtgacttcgctgttctttggccttccaccatgattgtgagacctcctcagccatgtggaactgtgagtccattcaacctctttcctttgtaaattactcagtctcgggtaggtctttattagcagcgtgagaacaaataaacctcctgtcatcttctctccttggattcactcctctagtctgagatgtctggttcgccttgtttccccagcggtgggctcatgccggcaggggttggcatcagcaactgttctttgatcccatgactctgattttgagatgagcctggtgcagcttggtggtttcacgtggggccctttggaaggagaaaacctggtccgaatccctgcaagttgtgtgacgggttgggttccttggaagcccgagaatgagatttgggtaggtgcggtttattcaaggtgggggttctcaggagaaggaaagtgagggaaggaggatgatgggggaggggacagagccaagcaagaatgggctctcaggctgaggctagccttgatctcacgtgggtctctggagtgtattctgccttgaagcaggaggactggacttttgtgtgactcctctcgcctcatatcgcttagtcattggccagttcagcatgtgagagcataactccctgggtgaaatggcttttgctagctaaggaattctccggagaaagtattggtataagccattaggcacagatcagcaaaggctgaatgatgagtggtttactggcaatgaggatctgggtgaagcaccaggaacagctgcgacgttgtgcaactgctctgcctcagttttcctcatctgtaaaatggggatgttgataaaacccatctctgagcgttgatgcaagggttagatgagatacttgcatttgtgttactgataatgtgcctgtcactggccaggtgcaaagcaagggctcaacgaaagcataagctattattattattattattattgttattactggcagttttggatccatagcaacaagcacatataaacaatgctcacttcttctctagtttaattcttataactcttctgagataagttctacttctaccctgttttacagacatggaaactgaggcacagtgaggtgaagcactttgagctcacatgatggggctgagattccaatttagggagtccagtcccagagcccccaagtgagtgctggtttgggactgtctcttctgatcatgacaaatcttttttttgagatcactctcagttccttgaatgtatccatcttctctgttgtttctgggtctttgtatattctattctctgtgctggcaacagcttttccgctttaacctgatctgccctggttcatcccttgagactgagctctgagctcatatttggccttttttttttttttttgagacaaggtctcaccctgtcacccaggctggagtgcagtggtgcaatcgtgactcactgcagcctcaacctcccaggctcaagtgatcctcccacctcagcctcccgagtagctgggactacaattgcatgctaccatgcccagctaacttgtgtactttttgtagagatgaggtttcgtcatattacccaggctggcctcgaactctcaggatcaagtgatctgcctgcctcaacctcccaaagtgctgggattacaggtatgagccacggcgcttggcccatgtttggccttttccaggaagccctccaggttgcctccttccacagccccttgtctgttccccaaagtgtctgttaggatgtattacacttgcctagtcacttgtctgcctctcccattagtctatggctccaaagaattgaatattttgcctgtctctatcattgtcacccctgcaagtagcatttgtctggcacatagtaggtactcaataaatgtttattttgtggctgaatgagcattccagattcagaactggaaacattggaggcttacaaaagttcagaaccgcatacattggaggcttacaaaagttcctgttgagttgaattaattcattttgaaatgacatggactaagttctttctgggaaggtttcctaactaaatccgtgggcatggtggactggagcgttccagaaccagtgcaaagagtcccctgtccataggcatgagatgaaggctcagggacttaaaatacacttctattgtggaaagttcttcagagacccttctggcattttatttaattgatgctcggctcatttattttattattttatttttattttttaatttttttattttttttttgagacggagtcttgctctgtcactcaggctggagtgcagtggcgcaatctcggctcactgcaacctctgcctcccaggttcaagcaattctctgcctcagcctcccgagtagctgggattataggcaagtgccaccatgcccagctaatttttgtatttttagtagagacggggtttcaccatcttggccaggctggtcttgaactcctgacctcgtgatctgcctgcctcgacctgccaaagtgctggaattacaggcgtgagccacggcgcccagccatttttattttattttttttgagatggaatgtcactctgtcacctaggctggagtacagtggcgcaatctcggctcactgcagcccccacctccccggttcaaacgattctcctgcctcagcctcccaaatagctggaactacaggcacacacccacacaccaccacacctggctaatttttgtatttttggtagagacggggtttcaccatgttgcccaggctagttttgaactcctgacctcaggtgatctgcccaccttggcctctcgaagtgctgggattacaggcatgagccaccacgcctggcccagttaatttattttatgtaatgaatgtatttcttttcattaggaaagtatgagaatcacgttgctgaaaatgtgggaaacctagaaaagtagagaaacccacccactatcatttggtagtaaatttcttcagatttttctcctcccatatatgtttttctctttctttattaaacatacttatgaccatactattaatatagtttagtatcctgctactttttttccgtttagcaaaatgagatttttccaggtttaattacatagttttaaaaataaccatcatcattttgttcttatttttttcccttttgaatttaaaaaaaaaaatcatagtaatatgagcacatcgtacaaagttaaagtacagaggagctgctaatgaaagcagcggttcctggccccttctctcctctctcccctccttaagtcttatttcccggaggtaagtgcttgaaatgttgtttccatttttaggtcttcggttatttatctctgtaactccaaataagatgcttatgtggctgtttcttgatttatcaatttaagacattttctattgactctgtgccatagaagatgaggattcagcttattgacatggttcctccccactttttgtccttccccagtttttatttgaaaaaagtcagacgtgcacatggcaaatgatgaccggaggatgaaggagcctctcttactctaatgcttcagtcttccacccacccctcctcccagtttcttgtgtatctgtggcaggtcaaagatgagtgcaaactgtttgataccccatgcattcagaaatggggtctatttcccttttcctgagcctgggctggcctgtgactgctttgacgaatagattgccatagaagtgacaccatgatggttctggtcctggcatttaagggatcatgcagtttccgccttacacctcttggaactcttggttttaaacccctgagccactgtgtgagaaatctgagggcttttgctggagggaaacctggagagactctgagatgacatggaaagggagagaagttgctctgagcccagcttccatcctgtcccactgatatgatttggctgtgtccccatccaaatctcatcttgaattctcacatgttgtgagagggacccggtgggaggtaattgaatcatgggggtgggtctttctcatgctattctcatgatagtaagtctcatgagatctgatggttttataacagggagtttccctgcacaagctctctttttgcctgctgccatccatgtaagacgtgacttgctcctccttgccttccaccatgattgcgaggctccccagccatgtggaactctgagtccattaaacctctttcctgtaaaaatgacccagtctcaggtatgtctttattaagagcatgaaaatggactaatacacccaccaaggtgcctggcacatcactaaaactgcactagacccttcagagcagccccgaagccctctgaatactactgagtgacctcagatgatactgtgtgagcagaagaactgcccagctgggtcctgcttgaattcctgaccctcaaaatcatgatctataataaaaacagttgtggctttaagccataatgtttggggattaacttgaatggcatccttcaggagataccccatgtgtcataggttttggggatggaggttatcttagcctaccaacagtgcctgatacaaatatgtgaatgtttcattgggtcacgcaatctcaagaaagcagggataagggaaagagagaaagaggaagagcaaaaccaaagaagtgcatattgcctagtggagttgcagtttcccagaaacacaagcatgggataactctggagtcagtcatctgccagctcctgctgtttcctgtctcttattggtcaaagcttgctccactctgcacttctgagtaatggccctcagcccctcctagcagcttctgggggatccaggacctctgggagctgataggtgtgatagaggccagcccttaaccccacccagggtaggctgagtcacttttattttattgtaaaattgatatttatttacttattattttaaggtaattttttttgagacaggatcgtgctctgttgcccaggctggagtacagtggcacagtcatagctcactgcaacctcaaactactgggctcatgtgatcctcctgcctcagcctcctgagtagctgggactacaggtatgcaccaccatgcatggctagtttttaaaaagtttttttggagggatggggttttgctttgtttcccaggctagtctcaaactcttgacctcaagagatcctcctgcttcagcctctcaaattgctgagattacaggcataagccactatgcctggcctctattattattattttgagacagagtctcactctgttgcccaggctggagtacatcggtgcagtcttggctcactgcaacctctgcctcctgggttcaaacaattcttgtgcctcagcctccgagtagctgggactacaggtgtgtgccatcatgactggctaatttttgtgtttttagtagagatggggtttcgccatgttggccaggttggtcttgaactcctgacctcaagtatccacctgcctcggcctcccgaagtgctaggataacaggtgtcggtcacagctcctggccactggcttctatttttttattttttgagagggagtctagctcttgttgcccaggctggggttcagtggcgcaatctcggctcactgcaacctctcaagttcaagagattctccagcctcagcctcccgagtagctgggattacaggcacgcgccgccacgcccagctaatttttgtattttcagtagagacaggtttcaccatgttggcaggatggtctcgatctcctgacctcatgatccacccaccttggcctcccaaagtgctgggattacaggcgtgggccatggcacctggcccagcctctatttttaaagtaacttttatgggatgtcagacattgtaaattttaccttggtgggtgctggatgtttttgtgcctggcacagtcctaggtgctgaggacctagcattgaacaaaaacaaagatccctgctcttgctgaacttccatgctactgtggggagacaatcagtgaacaacaagcataatttaggtttgctcttattatactgttgcacacgtaccttttgtatatgtactcttaaacggccattgtttttagtgatttgattgaacaaatatatttgattgaacagatatatccttgctgaatgagccatttctctattgatgggtaattatattactttctctagtaagagtcatcagaagcttagaggcttaagaatctaagctcaacaaacagaggttggagaggttattataaagtccattgtgagagcagccactcctaaccttgggaccaaagattggtattgcgtgacctgtgagccagaattaccctggattggactgtcctaccaggtgggcccctggccagcaaaagagatgatgggggttgttagaatgtcagagagggccttagacaccccttttccatatagtctccagctctttgactaaaacctgtaccccagtatataatcagtcacccaggcctagagtcaaggtcttttatatcatgtaaatttattttttatttttaaaattttttatttccatagggttttggggaacaggtggtatttggttatgtgagtaagttctttaatagtgatttgtgagattttggtgcagccattatctgagcagtacacactgaacccaatttgtagtcttttatccctcaccccctcccaccctttcccccgagtccccagagtccattgtatcattcttatgcctttgcatcctcatagcttagctcccacttgtgagtgagaacatacgacgtttggttttccattcctgagttacttcacctagaataataatctccagttccatccaggttgctgtgaatgccattaattcattccttattatggctgagtagtataaatatactgctggtatatggcatatatataccacagtttctttatccactcgttgattgataggcatttgagctggtttcatatttttgcagttgtgaattgtgctgctataaacatgcatgtgcaagtatctttctcatataatgatttcttttcctcagggtagatacccagtagtgggattgccagatcaaatggtggtgctacttttctttaaggaatctccacactgtcttccaaggtggttgtactagtttacattcccgccagcagtgtagaagtgttcccttttcaccacctccatgccaacatctattatgttttgattttttgattctggtcattcttgcaggagtaaggcggtatcgcattgtggttttgatttgcgtttccctgatcattagtgatgttgagcattttttcacatgtttgttggccatttgtttatcttcttttgaaaattgtctattcatgtggatttataccttccccgtattcccatgcctttgtcttcaatgggactattattttttgtctaatggctttgaattaaatcttctgtcttctattccactgatctccagtctccagcaataattatgctgtttgcattggggaaggtggcagatgtagttgttgccttgcctatgtcctctggcataggaactcaccattcctactgcaagcatctgcaatactgcctggggctttgtctcactgccataacctaggctcttgtggggcaggctggaagtgcagagaaaccaacacaggcacatctcccccagccagctgctgagggcagttgccctgccttccataccttagggtgaggcaggcgctatgctgtctcccagatgtccccagtgggattgaaccccagttgcccatagtagcagcctgcttataaacatgacctggattagctcctttcccttctctgtctcatttccctattgtcatcccagtgtttcctgggctcactttccaaatcaacccacttatcttcaagtccttctgtattagtctgttctcatgctgctaataaagacatgcctgagactgggtcatttataaaggaaagaggtttaatggactcacagttctgcatggctggaaaggcctcacaatcatggtggaagacaagaaggagcaaagccacatcttacacggcagcaggcaagaggcttgtgcaggggaactcccatttataaaaccatcagatctcatgagacttactatcaggagaacagtatgggggaaaccacccccatgattcaattatctccacctgcccccgcccttgacacatggagattgttacaattcaaggtgagatctgggtagggacgcagccaaaccatctcaccttctcttaggatttgtttctggggaaacctaacctatctaagatgatgaaaaatacaaagaaccaggaaaatccataaatagatttaacaagaaaattttacctagtcttgatgagtggcaaagcttgactgccctgaggaagtgactttgctgagctgagacctgaggatgggtaggagttagctaagcaaagcagcactggaagaacagcaggggaagaacattccaagcatagggaagagcatgtgcgaaggtcctggggcaggaatgctagtgtggatggggtgcagaaagagaggcagagaatggtggttatctttggaggatatatggcctgaaagtgaatttgggtccctgactttaagtctctttcctctgcagtttaattatgtctatacacttttttttgaaccccattatggtctggcttcatttaaatgcatctgaaatgaaatctctaatgttaacagtgttgtcagatgtgaaggcttcatttctctttggttctttttcaccgaatgctatctgtgagtttctggggaggatatgaggattttgattgttttgatttttttttttttttgtatgaccacattatgttaatttccccattgtcttagagtatgagaacataaaagcaataactcatttatatgaagactgaatgtgctgagaggttgtcatggaaacctctcatgttggcttgagtaaattgaataacccctgttaaaagactgaacacagataactggcaggctttgtttcagggcaagagttcacaaactggggtccacagatgctcaaacattctatcatgaatagaattcggggatcccatgatcttggacagttaaaaatacatcttatattcttttatctctacctgaagtttagtctttctttccattgtgaatgaataaagcaataaacaaacaaaaaaacaaaagattgaacacagaacttatttacccaattgcatggcattcacaagagatgagaaattcaacatgatacatgagatttttcccccccgcaggggcagggaggaggatgaagagggtgaatgaatgctaggaatgtattatttttatttagacagtgatttctatttttctttcaaagattatatttttgtttccaaatgggagaggtgttatggggcgatagagaaaggatccagggaaaattgcatggtaaaattgctcctgggaaagaccagcttagggtatccatgattgtcgcttctgtagccctgagcatgtttctccccttggagcatcctctgaagtcttggtcagagtcgttgaagagacatgaaccttttcagcattttctgctttgctttggcaggattgtttactgcctatcaagctgacttacaaaaaatactagttctgttgtttttcatttttaaaagcaaattgcttcacctcttcgtaaataactccttaaaagaaaagccgtggatgacagatgaggaagcatagttgggaacagagcgcggcactcgctcacgatcatagtgtcaggtcacaggaagccctctgagccccgggggtgggggcagcctctttaaagtgattatggagcaagaggagcttgaacagtggcactctgagcgttgtcttgggccagcttggagatcaggtcctgggctccagaagacatcgaggctggttctacctggatgttgcatccgtaggtatcaaagtaggagatgctttcgaggggtgagtttttcatcagtggcctccaccccaaagcaccatagtcctacctccttgttgtatgtctttcttctcacaggctgcttgtcagacttcagaatttcatgggcatgatgggcaaataagcttgattaatgcttcatgcttgctatccactaaatgtgttcccaccatgtgttgaaacctaatccccagtgtgatggatggtattagggggtggggcctttgggaggtgattaggacatgatggtggggactccacaagtgggattcatgcctatttatttatttatttgagacaagagtctcaccctgttcccaggctagagtgcagtagtaccatctaggctcactgcaacctctgcctctgggtttaagtgattctcctgcctcatcctctgagtagctgagactactggataattatctaccacacctggataattttttttttttttgtatttttagagagatgaggttccaccacgttggccaggctgtcttgaactcctgatccaagtgatctgcccatcttggcctcccaaagtgctaggtttacaggcgtgagccactgcgcctggccaatgcccttttaaaaggggtcccagagagcccctttgcccttccatgatgggaagacacagtgaaaagagggctgtctatgaactaggaagaaggccttccccagacactgaatctgcctgggacttcccagatcttctggagagaaccgtgagaaataaatgtctgctgtttgtaagccacacaacctatggcattctcttatagcagtctaaatagactaagataataccataaggatctacctttgggactgtgtgctgttataataaaggctctgataagtcctgctagcgccgtttagaccaggggtttctaaactttttgaccacacaagttatttttccctttgcaagcaccttccatggaaatcttttgggaggctgaggcatgagaattgcttgaacccatgaagtgaaggttgcagtgaactgagatcatgccactgcactccagcctgggtgatggagtgagactctgtgtcaaaaaaaaaaaaaaaaaaaaagaaaagaaagaaaaaagaaaatattttcaaaatgatgccatggattaaatctgatagtcacaaaggatccttgtctggtgttacctccatttgatgggtgaggaaacaggagtcctgagaaaccaagtaacttgctcagggtcatgctgttaggatgtagcagaatcagaaccaaaaccctaagtcccagacgactaaaatccaccactccaatggagaggcccttactgcaatgacctgttctgaaggagcgaaacaaggcatttattgcagcatcatttaattaggaaaaaaatctggaaagaccctgaatgtccaactaaagggaaatagttgatatttatgatacttccatacaatagaatgttatggggcatcgataatagacatgaagcacagtaacatgaggtggcacatattataatgtaaaatggagaaataaagcaaaatgataatcatgcaaattaaatgcatgaaactaaaaaagaaatacaaaatagtagctgtctctagatggtaggtgagtcagttcaggtcctctgagtagcagaaggcaaaacagaattaattgtacaaggtcccagtctccactgatttcaaatccacttttcaacttctgtatgaagttctcattctcttactaatttttttttttttttgaggcggagtctcactctgttgccaggcttgagtgtagtggcgcgatctcggctcaccgtaacctgcgcctcccgggttcaagtgatttcctgcctcagcctcccaggtagctgggattacaggcgcatgccaccatgtccagctaatttttgtatttttagtagagacggggtttcaccatgttagccaggatggtctcaatctcttgatcttgtgatccacccacctcggcctcccaaagtgctgggattacaggcatgagccactgtgcccggccctcttactaattttaaataacatgtctcctgcagcttctgtattgcaaatataggaagtgattttggcgagcatttgaattatggtagctgatctgatctgttgtgtctccttactttctaattctttctttactttctgctcttttcctccctctgcttatttgcttcctcttgctgtcttcctttatctccttttcttttcctacaaatttctaaaatgatagctgatgagaaggaagatcactcttacataatttgattcctcagtttccattttcttctttttacaagtataacattctatatttcttttttttaaaaaaattattttttaattgaaaaataatggtacctattgatggagtacgtagtgatgttttgatatatataatgtatagtgatttgatcagggtaattagcatatccatcatctcaaacgtttctcatttctttgtgatggtaacattcagtatcttccttctagctatttgaaactgcattattattaccattatcattttattttatttagacagaatcttgctctgtcacccagactgatttgtagtagcatgatctctgctcaatgcaacctctgcctctcaggttcaagcgattcttctgcctcagcctgccgagtagctgggattacacgcatgctccaccacgcccgactaatatttttttagtagagatggggtttcaccatgtttgccaggctggtttcgaactcctgacctcaagtggtctgctcacttcagagtcccaaagtgctgggatcacaggcacgagccactgcgcctggccaaaactacatattgttaactgtagtcatcctacagtggtttacaacatgaaagaaaaccaagtattaattgtgcaggaaattcattgaagaaaatgcctgtgaagggaaatggggagggagcagggagagatttcagaccgtaatgcaggtctgacacctctgaaagcagagtgggaaggaagagagatagttagaaagagaaaggcttcggcacaactctgagaatgtatcagccagtgtaatagttcctaaggcaactctctctgttggacaactcccagttgggttagaatcacctaattccgttacttccactgtgcccagtcactggctgggaaaatccccagggaagtgcagcctagcatgaacacctcggtgggtcaaaaggtacagcagctagaggttgtcagttagctctgcttccagagcagttcaccttgaaggaagatttgagcacagaacttccatgactgagagcttctggtgcactttacagcagaggaatttgtgaagcaggttcactgttcactggctaccaacttgtccagtgagacagaacactcccacacaacaagttacctgaggtaggtttattacttacagataggcagcaagagatggtagaagcctaggattcattgtgagctattcctccaagtccccggaaacctgctgagggtaagtagagtcatatctgtgcatgccttacttgcacagaagctcagataccccagaaagcagctggttctgtgttttataccccaggatgtgtgatttgctgggctaaagtgtttaagacattttgtttctaggggtggactgaaacagaggttgggtcgttctggccagtccctctctatctcaagatgttgcatttctagcacattcttcagttattcttaagaaccatgagttgggaaaagagggaagaactgggtaggcccaaggccacccagtgaactgtctagcagcattttgcattttgtaaaagcacattaacaatggttttgagaagctgaagtctgtggactgattctccctgtaaatacaggcctgctttactagcacctgcactttctggttcttatgccccctcaaaagtgtactgagtcatttgaacagaaggagactgcccctccagctccccacaatgggaaattgtcatcactgccacaaaatgaatagaaggacttggccaagttcatcttcctttgtttactgcctgcacttcatcccatttggaagagagaagcaatagcattgaatggtctggcttttttttttttttttttgtaatcatggctatacagcagggtaatgaaggtcagagatgggggcttgaaccacctgcctgtggttttgaggtttccccaaatactctatggttgttaagttccataagaaagggacttgtttttcatttttattttctttccaacttttattttaggtttgggggatacgtgcgcagatttgtttcatgggtaaattgcatgttatggggcttggtgtccagattatttcatcacccaggtaatgaatgtagtacctggtaagtagtttttcaatcctcaccctcctcccatcctctaccttcaagtaggacccagtgtctattgttcccttctttgtgttcatgtgaagtcagtgtttacctcctaagtgagaatgtgcaatatttggttttcttttcctgtgttaatttgcttaagataatggcatccagctccatccatgttgctgcaaaggtcatgatttcattcttttttatggctgcatagtatattccatggtgtatatgtaccatactttctttatctagtctgcaattgatgggcatctaggttgattccctgtctttgctattgtaaatagtgctgcaatgaacatatgtgtgcatgcatctttaaggtagaatgattattcttttgggatttatacccatgaatgggattgctggattcaaccttagttctattttaagttacttgagaaatctccaaactgctttccagtgactggactaatatacattcccatcaacagtgtataagcgttaaagggacttaactgctgaatagtcttcacccaactcaaagcctggctctcagtagatactcaatatattgcttatacaattaaaggaatggttaaaaggaaggaagatgtatgcagaatctgtgtactgctaagtcagcaaacatttgctgagggtctgttgaatttggtcctgctcaacattgaacttgcccacttctcaccaccattaaggctccagaaaatttgtttatccacagccttcttcgtctaccttattaccttgtcatttctttgagacctaatatccattcctcctgatctccagctcaactccctagaatccatagcttctagagttttgtttatttattccatttttatttatttgatttattccactttcattgaatatcaagacctccaggcatagttccaggcacctggtatgcagcaacaaatatgatgttcagataatctcttgctgcataaaaaagagcctgatcccacagtggctggaaacaaatatttggtattattgctcatgactctgtgttgattgggctcacctacgtggttctcatttcaagtcctatgcagttgtagtcagataatgactggggctggagtcatctgaaggcttgactaggctggccatccaagatggctgagacacatggctggcatgatattggctactggttaggagctcagttggtgctgtcgcctggagcactttcatgtggcctttctatgtggtttgggcttctcgtagcatagtggtgtctgagttccaaaagtgagtattccaagatataggaagtagcgcttgatagtcttttaaaacatggactggaaaagggcacagtatgatttccaccatattcaatacgtcaaagcaatcatggaggtcattaaagtcaagggagagggtgtagatcccaagagattgttgtgtgtttttgtttgtttgttttttgtattttttttgagacggagtctgcctctgtcacccaggctggagtgcagtggtgtgacctcggctgactgcaacctccgcctcctggattcaagtgattctcgtgcctcagcctcccgagcagctgggactacaggcgcccaccaccacatcagctaatttttgtatttttagtggagacggggtttcactgtgttggccaggtgggtctggaactcctgacctcaggtgatctgcctgccttggcctcccaaattgctgagattactgatgtgagccaccgtgcctggccctaagggattgctttgatgtaaaaatgtacagccatttgaaaatggccacaggtggtctctgctgtcaaggacttcagagttgataaagagatagtgatgaaacctatagtaggctgaatcatggccactcaaagatagcaggttctagtccgcggaacctgtatatgttaaattataaggaaaaggagtctttgcaggtatgattaaattaaggatgttgacatggggagattattctggattatctaggtgggccctaaatttgattgcaagtgtcttataagagaaaggcggagagatattacacccagaagacaagaagttgatatatccagatggaggcagagattggggtgatgccactccaagcaaggtaatgctggcagccaccagaagctggaagaggcaaggaacagactgtcccctagcacttctatagggaacgagctctactgacaccttgatttcagtttattgcaaccgatttcagtcttctgacctccagacctgggagagaagaaattcctgttgtttgaagccatttagtttgagatcattgttacaaaagtctcaggaaatgaatacaaacccagacaatgacaagcaagggtggaggtgatatggaggaagcatataggaggcacctgaagcccagcccagctgggagagaagaaagcaggaatgcttctttaagctctgatgttcaaatgagaacacatggacacacggagggaaacaacacacactggggacagttggagagtggggggtgaggggtgggagagcattaggacaaatagctaatgcttgtggtgcttaaaacccagatgatgggttgataggtgcagcaaaccaccatgacacatgtatacctacgtaagaaacctacacattctgcacttgtatcccagaacttaaaaaaaaaaaaaattctgacgttgattcatccctaggaagtgtggcatcatggtgatgttcattcatccctaagaagtgtggcatatgacaacatgtggaacttgaatccattaaacttctttttctttacaaattacccagtctcaggcatgtctttattagcagtgtgagaatggactaatacaaatattatgatgaatgaggacattctcatatcttccacaaaaccatcatggaagacattatccatcatttggttacatttcccttatgtaaggatccaaggggatctggagtactgcttttctgtttgcgtctcaactctgccacatactagctgggtttataggctgctgtgaggtttcaatgagtaaatcaaaacctgtaaacacttggtgcatgcatagtaagtacttaaaactggtattgttataattttcgggatatggtaaaggatattgtttttctggggaaagacactaggcccatcatgggggtaataccctcgtgacctcgtctaacccaaattacctcctccaaatgccattgcactgggggctagggcttcaacgtgtggatttggtggagaaagacaaagacattcagtccataacaattttccttggatttttatgtatatgatcaagtcacctaggaatgatgactgtttcatttcttcctttctggacatttcccccctgtctaactgcactagctaggatatccaggacaatgtggaatggaagtgaggcttatgggtatcagtgctatgataccatccacagggagaaacctttggctttgtatgaaaagctgatgggtagggatattgatatggtttgtctgtgtccccacccaaatctcaacttgaattgtagctcccataattcccatgtgtcatgggagggacccagtgggaggtaattgaatcaagatggggggtcttttccatgctattcttggccagttgtcagcctgcccaacatattgtgaaaccgtgtctctactaaaaataataagccctctcttgcctgctgccatgtaagatgtgactttgctactcctttgccttctgccgtgattgtgaggcctccctagacatgtggaattgtgagtccatttgtgagtccacctctttttctttataaattacccagtttcaggtatgtctttattagcagtgtgagaatggactacttcagatgtcatgatgaatgaggacattctcatatcttctgcaaaaccatcatgggagacattatccatcatttagttacatttgccttatgtaaggatccaaatggaattttttttgaattctattctaagaaaaatcatttcctttcctgtgaacagctatacttccctttgttaaatgatgatattcatgtgtcctttatgttttctttttcttttgctctggctattagggagctaaaacccaagagcacacgcaatcaaaataaccatattaaatgagttttcttatgtatttgataaataaataatttttcttttggtttccctttgggtgtaccttttattgcaagctgtctcaagaagtttttttcacagtaaatggggataaaattattttaaaagaataatacctgacctgattattacctgggtttatttcattgactgaatggtgagactaatgaatggacaagagctttatgaactgtaaaatgccgtgtctgttattaactaggggaagaacatgattgtccttgactttaaccaatgtaccttgtgtcttccttagttggcactgatggttctgagttaggtaaccatgctccctaaagcctctgagatttcccctgagcatcctggccactcagtgcttattttgcaccactcttgtgtgtccaggatgactccttcaactttatctttcttctagaaagttgctatccattgtttacatccagtggctcatgcattcatagactgcagcagcattttctaagcaccagctgctgggtatgtattggttacctgcccagcaacccttttctcttcttctttgctgagaccatcccattttcattcatgcatcagttggcaatatgcccagagaaatggagccccttccttcctcatgctcttaggcatggaactcagttggcccaagccaggcatgctcatcttgtttctctcactgctgactggtttagccttgggcacatgacctggttctcagtagtgagctagtaaggatcagaaaaaccacaaagccatgacattattgaattaacctgtctggaccacctacgcctggattttgtgtgggagatacaataaatctggattataggttggtgcaaaattaatatttaaatcacctgtagttcaactctgtgttgcttgcagtcaaaagtatccttatcaggctgggcacagtggctcacgcctgtaatcccagcattttgggaggctgatacaggcggatcacctgaggtcaggagtttgagactagcttggccaacatatagtgaaaccctgtctctactaaaaataaaaaattagctaggcgtggtgacacgtacctgtaatcccagctactcaggaggctgaggcaggagaatcgcttgaacctgggaagcagaggttgcagtgaactaagatcccgccactgcactctagcctgggtgacagggcgagactccatctcttgcaaaaaaacaaaaaaagtcctaatcaactgttttagtttggatgctcactgaagtagactctgaggcaaggatttgagtgccaatagtttattaagcttgaggaggtgggggaaaggggacaggcaagggagggaagtggcaagaaagatgcattatcatgtcagttaccagtgtggggaatcacagtttaatctctctggggaactctggaaaatgacacagagcagggatttgcaaactattggcccatggcaaacctgttctgccacctgttatttcaataaaatgttcctggaatacagtcacaccctttcatttatgtatagcccatggcagcttttatacaacagcagcagagttgagcatctgtgagagacaatatgacctgcaaaacataaaatatttactatatgaccctttttcaagaagtttgccaaccctagtgttgagcatgtagctcagaatcaccccctggaggagtgaaggagctgggatatttatacatccctccagttagtcactggtgaagacctaatgcaggaggtatgttaattctccaggacttccgacctgtcctgtgcacaggcattgtgggccctggccaagcaaagagatgtaaataccgattgttgggatttgtgcaagtatggaccctactggtccataccagtacactaacagagatggccacatcagtgcatccagagatggctgagaagtgcacctgtcctccaggaacccatagtctgaaggcaaggttggaaatggccaaacatttttatttttattttttttgagatggaatctcactctgtcacccaggctggagtgcaatggaatgatctcggctccctgcaacctccgcctcccaggttcaagtgattttccctcctcagcctcccaagtagctgggattacagggacctgccatcatgccggctaattttttgcatttttatagagatggggtttcaccatgttggccaggctggttttgaactcctgatctcaagtgatccacccacttcagcctcccaaagtgctgggattacaggtgtgagcaatcgcacctggcctttatttttattttgtgagacagggtctcactctgttgcccaggctggagtacagtggcacagtcatagctcactgcagcctcaaaatcctgtgctcaagtgatcctcccacttcagcctcccatgtagctggaaccacaggcctgtagcatcctacctggctaatttaaaaaacaaacaaaaaaaaaaacaaaaaaaataaagtgtgtagagacagtctcactgtgttgcccaggctggtctcaaactcttgggctgaagcattcctcctgtccccgcctctcaaagtgcttgggattacaggtgtgagtcactgtgccctgctcaaacattttataattaagtagaaaaaccgacatgtcagctggggtcccctgaatcctcaaagatctaggtaagatcttctatgcaggctacttcctgctaatctggggagggcgaccttctcaaggtcgtatctgcctctggccctggtgcccccaacccacgctggctctgctttttcccctacaggagcttaagtgcagaactttgcgtctcccattgcctgcaggaaacctactcagctagtgagttcatagggcttcactgaagactgggggattctggaggggatgattttctggcacattcaggcttctagaaccctctattctttccccagctctgcttctcgtttttttttttgtctggctccaaaaccttactccttttattgagcacattatttctctccagttcccacctctgcatttcctttcctgaatgcttctagggcctcagcagaacaaggaacgcctcattgatgacgttaaaaaacaacaacaacaaaacaacctaagacacaagacacagacaaaactttttttttttttttttttttttggtattctccagacaaaacgtttgcagcatgagatgaggtcccctttggaaacatctccccacattctgtgattctgccaagtcctctaaattttgtctcctccttcatccaccaggtggatttcaggactcctactgtcagaggcttggaataaacctctggcatgctttgcttctgttttgctttctttctttctttttttctgagatggagttttgttcttgttgcccaggctggagtgcaatggcgtgatctcggctcaccacaacctccatctcccaggttcaagtgattctcctgcttcagcctccagagtagctgggaagctgggattacaggcatgcgtcgccacgcccatctaattctgtatttttagtagagatggggtttctccatgttggtcaggctggtctcaaactcctgacttcaggtaatctactcgcctaggcctcccaaagtgctggggattacaggcatgagctatcgcatccggccctgtttggctttctaaaatagactgtgtgtctcacccagcatgacgttagatctgtttagcatgacagcattccattgagtcaactccttggacatactatatgttttgtttccctggtagctaattaaataagacaactaagtgcagtctagaaagttcctctcataacaaagttcccaagaatttacgtctttgctttacttacttactttttcgtggtagttgaagttcaagtggaaactgattataaaggagaaacctaaatcaagttaggtgaattctgcagtatgaactgtgcttggaaaatctaactggtaatgtatccacattgggaacttggtccttcctctcacaaagaaaattccaggtcaatttcatcccctatgctaagcatttgagtgttcaggaatgtgattttagttttataaaaattgttctttttaaaattcctgtcaaataatcagatttttttctcagcacatttagaagtaaaaatggaaagtttagagcattttgatattttagtatttccatgaagtcatttaaccctcccagactagtttcagagttttgtcttccagcccatctttgtgtctcactgtacattttctgcatgtacaatgagaggtgatttttaattggaatcccttagatttttagagagaaagctctcctcctctattcttcttcctctcctctcactgtctctcattttaatccagagaatcaaagtgtctcttacaggcttggatatcaagctgaactgttaaaaacagtggggtccaggaacctgagtttaaaacaagcacctctgattgtctaagtggacttagagaaagacaaatgctgtgtgatctcacttatttgtggaatttaaaaacgttgaactcatacaaaaagagtagaattagctaagtgaactaattcagacagagaaagacaaatgctgtgtgatctcacttatctgtggaatctgaaaatgttgaactcagaggaaaagagagtcgaattagaatggttgccaggggctaggaggaaatgttgctcaaagggtacagactttcggtgataagatgaataagttctgggcatctcatatttggcacggtaactatggttaacaataccatattgcttacttgaaatttgttaagagagcagctcttaaaattttttttttactttttgtgggtatataataaatgtatatatttacgggtacatgagatgttctgatacaggtatgtggtgtgtaataatcacatcatgaagaatggggtatctataccctcaaatatttatcctttgtgttacaagcaatccaaatacactctttcagttattttaaaatgtacaattaggccaggcgtggtggctcacgcctgtaatcctcacactttgggaggccgaagcaggtggatcacgaggtctagagtttgagaccatcctggccaacatgatgaaaccccgtctctactaaaaatacaaaaaatgagccaggcatggtggcatatgcctgtagtcccagctactcgggaggctgaggcaggagaattgcttgaacccaggaggcagaggttgcagtgagcccagatcgcgccactgtactccagcctggtgacagaccaaggctctgtctcaaaaaaaaaaaaaaaaaaaagtgcaattaaattattgactatagtcactctgttgtgctatcaagtagtaggtcttttttttttttttggagtgaagatctcatttctgttacccaggctagagtgcagtggcatgatgacagctcactgcagcctcgacttcctgggctcaagtgatcctcccacttcagcctcctgagtagctgggactacaggtgtgccccacaatgcctggctattttttgtatttttagtagagatggggtattgccatgttgcccggctagtcttgaaatcctggccttaagcgatctgtccgccttggcctcctaaagagctgggcttacaggtgtgagccaccacacctgaccaagtagtaagtgttactcattctttgtaactatttttcttgtacccattaaccatccctacattccccagcccactacccttcccaggctctggtaatcaccatcctttcactaagagaccagatcttaggtgttctcatcacataaacatccaaagacaactatgggaggtaatgaatagggtaattagctggttcatggtgatcatttcacaatttgtgtatacatatatctccaaagatcacattgtacactgtaaatgtattccatttttatttgtcaattttacccctctaaagctgggaaaatgaaataaaataagcatcctgggcaggactggctgcatagttttcagggcccagcacaaaacgaaaatgtggggattcttgttatgaaaattataggaattctggctgggtgcaggggctcacacctgtaatcccaatacttttggaggctgaggctggggagttgctttgagtccaggagtttgagaccagcctgggcaacatggcaaaactgcatctctacaaaaaaaaaaatgaataaattaaaaaataaataaataaataaatcagccgggaatggtggtatacatctgtggtcctagttactcgggaggctaaggcaggaggaccgcttgagcctaggaggttgaggctgcagtgagccatgttcatgccactgcattgtagcctgggtgacagagaaagaccttgtctcaaaaaaaaaaaaaaaaaaaaattataggaatttcaaaatgccagcatcacagtggggtcgtctaattatggggccttgtgcagttaccccaggcagcatagcaggaagcctggaagagctttgctgcaggattcagatcccagaccatggtgcccatgagtttcaagatcttgtaacatgaaggcgtgtcttcaacagactctctccaaagaaatcctctcttgctcttggcccttctttgtgcctgaaaagcgtgagaagagggtgtaagcaggacagaaccacttttatttttatttatatatattttttgagatggagtctcgctctgtcgcccaggctggagtgcagtggcgccatctcggctcactgcaagctccgcctcccggggtcacgccattctcctgcctcagcctcccccgagtacctgggactacaggcgcccaccaccacgccccgctgatttttttttttttttttgtatttttactagagacggggtttcaccgtgttagccagggtggtctccgtctcctgacctcgtgatccgcccgctttggcctccgaaagtgctgggattatagtcgtgagccactgtgcccggccagaaccacttttcaaagattttgtttgaaaatctgccttttgattttgtacttgattttggaattctttattattattattattttttgaaacgaagtctggctctgtcacccaggctggagtgcagtggcgtgatctctgctcactgcaagctccgcctcccgggttcacgccatcctcctgcctcagcctcccaagtagctgggactacaggcgcccgctaccacgcccggcaaattttttgtatatttagtagagacggggtttcaccgtgttaaccaggatggtctcgacctcttgacctcgtgatccgcccgcctaggcctcccaaagtgctgggattacagtcgtgagccaccgcgccgggcctggaattcttgatgctttaaacaaaacttaacatcttgcctgacatgtttttgtagcccaacaggataactaaaacgccagcattaaaactcagtccctggcaagatgttgtctgtgatctccttcatcttcacgacaagatcatctagggttgtatgctgaggttagcagcagagtctcagtggagtcgaccctgcaggtgggaagccacacttggaattcctccatcgtgcttagttcaccttgaggactaggtagctatctaatggcagaatggtttcaaaacccaagtatctgtgaagagctttctcttttgtgaattcttcggtccagctcagtgacttccaactgttcgaggggcatagttatgacttaaaatgattacatacacaagtacatgcacactctataaattatggttgatttaaaggaatctcaggagtaattttgaccacaaataatttttcctcttctgtactaactatggaaatgaaatgtttgtgtaatatatgatttcattttgccagaatatatgaatacttctgtgaaagtgtcctgaaataaatgaaatgctgtctctgcaaaaaaaaaaacctaaaaaacaaaaacagttctttggctgtgacatggacatgaataaaaaggttataactagcatcaaattcaagcatttggttttattgcttatgtgaacacagcatggaacatcttttgattcacgttttccccattcttagtcgtgttatctgttcgtgactatgcaagtggttttgtctctcagggacatttggtcatgtctggagacattttcagttgtcacaactggggatgaggaaatggtgctactggcatctggtgcgtagacttcagggatgccagtaaacatcctgcagtgggcggaatagccctgcatggtagagaatgatccactctagatggtgtcagtgccctctaaacattacgtcctgggctgtacccactctctggatgtgaaaatggaggcctagggaggctaagcacttatttattatttctttgtagttaaaaaaaagtccatcttgttccaggaaggaacaatttactttctaaacatgaggcataaaacagaaataactaggaaatcggtggaaatgtgttttcatggggaccgtgtagactgaggacaaattttcaggcttctatttgtccggtgaggttagtgcttgtgcgctgggccaagtcaacatcctcttagcggtgtcttgtctccttcctgatttagaaaaggcaaacccacctgctgtcatgaaaaataccttctagaagctaccgggtaattgggtgatatttctggatttgtctccctgtctaatgtacatcagttaaacttttgactcttcagtgccttctggagaaagtaataatcggaaactaaatcgacttggttttttctctccccctttgccccgtatttgtaaagattaatcttcagtatctatgagtgctgggtgatttgcggaaactgcagctgctttgtcaatatcagcttggcctccattgatcaaaccctcatttaggcgttcactgccgtctgctggaaacagcccagggatgaggagggaagggaaaaggccacttcgggaggccaccttgccttggagtttccgtcgttttccgaggtgagcttggatgtcactgctcagcacagttgattaaagaggttggtgctgtgagtgagtcactgtgtgggaatcaatcccgatggtggcagatatgaataaagcgtcggtgtaactgtcctggctggattgtttttctccgtctcaccatactgttttccctctgcacgtgtctgtgacctccggcaggcttgcagataaaagtgatgcatcttcattttgtcggaggagttaattttgtgtgtattccaaggtaagatgatactcacggtgcttatatcttgggcacccactgtgcattggacactttccataaattaactcaaatttttcttagcagcttgctatggctcttcactgtttctccaattcgatttacaaaaccttgatttcagtgggatccctgtttgctcttgcaaactcttcactcaccacctgctttttgcccactccacttcagctgccctgaactttgtgttgctggaattgactttgctcactcacacctctggtcctttgcacatgctgtgccctgggcttagtacatttcactttcatcctcttaacctcgttcatatcttgcttgggacaacagatacggctgtaagtatcagaaaactctattatcatggcttgaaggtgcaagggtttatttggcttacacaataagctaaacagtaggcaagccatgttggtagagtgaatcaaagagaccatcagaaacccccacttttttcattttcttgctctgctgtgcaatttctatcctcatggttacaaaatagctgcttcatctccaggcatcacgtcagcaggcatagaagccaagggagggcagcaagccagaaaactaaaggtgcgctctcccttcttttcactggtcacaactacgtcagatggccagccctagctgcaagagatgctagtgaaagatgatttttagctggatacattgtcgccctcagcaaaataaagatgcatttttcttattagcagaatcctaacaattaagattcagtgctcagttttgatgccactcagctgagtggtcctccctgaatccctgtgacagagttgggacacacaggtattaggcaatctcatagatggcattggagttacatgaaattgtggtcttgtttccctatctggattgaaagctccatgaggaggacttggtctacctttcacacagttgtatctctactacctacatagttccagatatatagtagatgctcaataagtaataaatgaaggagttacatgaaattgtggtcatgtttccctatctggattgaaagctccatgagaaggaggacttggtctgtctttcacacagttgtatctctagtacctacatatatagtagttctagatatatagtagatgctcaataaatacttaataaatgaaaaatagctactattttgcccctttgtagttgacacctagagctttagggagataagataacttgccctaagtaacacatgtactccttaattcctccattcagtaatgtttatagtgcaccttctatgagccaggtcttgtttcagacacttgggatacatcagtgaacaaagcagataaaacgactgcctttgagaccattatccctaatattttattacaaaaaatttcgcacatacagcagagttaaaccaatttcatagggaacacgtgttcagttactacctaggttctaccagtcactggggcacattgataccagtgggggaaggcacacagtaaaccggaaacaaaacaagtaaattacatggcattgtagaaggtggcaactgctatgagaaatacagagaaggtaacggggtgtagggcgtgcagttcggggtggtggtggtggccaggcttggcctcattgagatggcgacagttatgcaaagacttgaaggacatgagggagcagtgtcgatattggagggcaaagcagttctaggtggaggcaacagccagtgcaaaggtcctgaggtgggaatctctgttccaggaggggcaaggtggaatgtgtggttggaggaggagcgttgatggtggctgggttagtagaggaggaggagtttggggaaaaagatcaagggaactcagctttggacaggctatgcttgaacaactcaggggcagagctgggatttagatcccagacctcacaaccttcctgtattagggttctctagagaaatagaaccagtaggatatatatgtctatttattatatggattgttgtatgcagttatggaggctaggttccatgctctgccatctgcaaggtggggtatgaggaaagccaatgacattaagtcccagggtaagtctgaaggcccaagaaccaggagctctgatctccaaggtcaggagaaggtgaatgtcccagctcaaatagaaaatgtacacttcctttgcttttcgttctgtttgggctctcaacagatgggatgatgtctgcccacatgggtgagggtggtcttctttttttctttttttgagacggagtcttgcagtgttgcccaggcccgagtgcggtggcatgatctcggctcactgcaagctccgcctcccaggttcacgccattctcctgcctcagcctcccgagtagctgggactacaggtgcctgccaccacgcccggctaattttttgtatttttagtagagatggggtttcgccatgttagccaggatggtctcgatctcctgacctcgtgatcggcccaccttggcctcccaaagtgctgggattacaggcgtgagccaccgcacctggctgagggtagtcttctttactcagtctacagattctaatgctaatctcttccagaaatgccctcatagacacacacacccggatgtaatgttttaccagctatctgggcatcctttagctcagtcaagttgacacatgaaattaaccgtcacactttaccattttgccaacatctgtcccccagtcattcaaagacactgtgaccagctggccaggtggcaagaattcctagggcacaagcctgaagccttcgggagaaacttcagctttacagggggcagaatgtttggtaactatttagatttaaagcagaagcactttggattgagcaatttcatatgtgacaactgtctttgccacaagcaacagcagagacctgcagatgagaacacctttatgaagaacaagaccatgctttgaagttgggcagagatcttggttcaaatcctggctctgctgcttgttagctaagtcacttcaggtaagcgatttaacttctttgggccttgctttcttgatctgtcaagtggaggttcataatagtatcaccccttgagggcagataaactgatgtatgtttatgcatacataaactgatgtatgtgatgtaatttagcacggtgctggtccacaggtgaatggagatgatttttgactttctgtctcgcagaaagtctgtacctccccaaggacatctcatgcccacagcagcccagcattgagtcctcaccaacccagactgactttccagcctcatatcctcaaaggatctgacattttccagccaccaaccttggtttgcactatgcccttcatcaaaaatgtctttgcttctctttgatgcctgggtatctattcctttagaacccatttcaaatttctcctccttaaagatgccgttggtcactgttccaatctgtaggatactctgttttgcccagatcccttttgcactgccttctgggactcagatacagagggggcaaaacatcccggaaggggtggggcccatggactgctcttggagtggggacagagatcaccacgagatggcgctattgagccatcactgtcaactggtttttctctgttttcattttcttacttgatgagaaatgtgtgatttccaaatagtcccagaaggaatagaactgtgactgtgtcccaccactaaaaaggtggttttgcatatctctgatcgtcctatcacatcgcccactgttaaaaattccatccccacatgcaggggatttagaaggagaatatcacacacttgctaccacccccaatccatgcaaataccttggtacttgctatagacacttggtacacaaatactgcctcagtcttttattaaattatattttatatattgcatcagagtattaagcccttaagggtaggacctggggtccatgccaacttactagaacggtgtcgacttctctaggatatggaatccacacagctccttggaaagctggaaaatgcagttttgaagcaaccctgcttcatttccacaccaatggaaaggaaagtgataaatcctttatggccaagagtccgttctgtttatttcttcctggaaatgctattgatggtggctggggaagttgtttgttttttaatctttcccttggcaaggtctccttactcatagcccttccttatgttccccaaatggtgcagggggcagtgttcagaagcccagtatgcaggtcttgcacagaggagaattatggcttaaagaaacttggctaagtgtggtggctcacacctgtaatcccagcactttgggtaggtcaaggcaggccagatcgcttgagtccaggagtttgagaccagcctgggcaacctgatgagaccccatctctacaaaaaattagccagggatggtggtgcatgcctgtagtcccagctactcaggaggctgaaatgggaaaattgcctgagtccgaaaggtggatactaaagtgagccgagattgtgccactgtactccagtctaggtgatagggtgagaccctgtctcaaaaaaacaaaacaaaataaaaaccaacaacagaaaaagaaacttgggtgggatcatgtgtccaggcctcagcactgttgtcccttactctaactcctgcagagaggtccttgaacagacgtaagcggacacaccttgaagtcaaggtgctctttgcaaagcaacacaatgttattgacatattccatttgaataaccaaattttgtagttgattgtgcgctaaggtggatacgcattacattatgttcttatgtagggaagtagaagttagtgccgagatttaaagaaaaatcagtggggaaaataacagttgaatcttatttgtttaaaaacttaggacttatttattcttctgtccacccattcatatatacatttaacaaaagtatttgaaattagttttatattgctatttattttaaaaataggtattatacacgtatggctcaaaattggaaagatacaaaagagtgtatagtaaaaggtagtttccactcccatccttgtcctaaccagtttgtttcttcacagaaatggcaaccactattgatagttttctatgttccccttgagaaatattctatattgtaaatgtatattcatgtattcatttattcacccatctatccatttattcatctacccatccatttattatctagccacctatccatagatggatccatttatgcatccatcaatttattcatctatttacccatccatccattcatccatttatccatccatctatctatttactttccattaatctatccattctttcatccacttatccatccatctatccatccactttgcattcatctatccattcattcatccatccatttatccattcattcatccatttatccatctattcatttacttacccatttatccatccatctatccatccacacacacatccatttatccatccatccatctattcactcatccatccatttatccatctaatccattcattaatccatttacccatctatgtcatttttttccaggaagaggaaaagggcagccattatttggttttagatggtagaccaaatttgtgctactgttccactggaaaagagatttggaaccactccttggcgttaagccagccactccaaagctgtagtgttgcaatgtcatacatctgtcagggaaggctgaacattttaaaaacaattgggtatggccattcagattttattttggcccagcataatgagtttgtgtttgattctgaaggagagggagatttgtaataaatcagcaagtgaaattaaaagtgagccagtgaggtgccataaaagggtggttggaatcagacattctcaaatccatatcctatccccacccatgttaaaagctatataggaggttatttaacttcttgggagtctcaattttcctcttatgttctgagatggggataattgtatttttctttgcaggttaaaggctaacacaatgcttggatatagtcagtgctcatgtggtaactgcccttaacattattaagcccacataattctcttcttttttgtaagcagttgagatctttaggttgaagattcaatatacaatgtaacagagtcagagggtgggtggcaaaaggtacatacatactgcagggcagggacttggagtatggaatggagaaatagcagaggacatcttccagctgcagttgggatgggtgctgagctacaaagctactagagaaataggaaactcaggtctcatcattgcagggacccttgtttcctgcaaagaatccttggagaaatctctcccactgtctctgggcattgtattcagaaatgtctggcctggatgatagtcttcctgcttttggcctcaccctctatccactgtcctctgctgaatctttctaaaatgcttgcttaaaactccttatctccttcaggagaaagttaaatcctttaccacacaaggccattacctgggggccctttctaactcctcccacctcaattttgtcctctttctgcaggtatctaagtgtcatgatttagatgtcctggcatgcactgtgctctttttctggaagcctcctttctttcttcatccaactacctcctcttcttccttcgagattcagctgagactctcttgagcaaattttccaagactccttaaggggaaggacctggtccaagttgacttggtgtctccgtcatcaagcacaatgcctggttcacaatggattcttcatgcatctctttctacaagatgagaaggatcagagggtgaggattggagctgggtgtcttaaaaatctgtgagagtggaagctaagccagtgatgtttgctttgtaagctattcttgtgatattacaatccttcagagtggtgaggttggtgggagtggtaaaaacaaacaaacaaacaaacaaaacctagtttctttgtcttggattttcctgtgtcagtttatagagagagactatccatcatattttattttagcttaaccaaagtcctactttttgttgtttctttttttctttgctgggatcttaaaagagattgaataaaaattcagttgtaggaatggctttaccttcctctctggtcttgttgttttgtttttagactatgatatcacatgtcaagactatgatatcatatcaggactaggatatcaagtttataatagaacaataattatgtattatttaaacttattttcatcaaactataactaatacacaatggattttttaatggtatatacagatatttaaaatttgaaataattttagatttatagaaaagttacaatgatactatagcaagttccaagaaatcccttctcagtttcagtttttcttaaattttgttgttgttgttgagacggaatctcgttcgatcaccaggctggagtgtggtggcacgatctcggctcactgcaacctccacctccttggttctagcaattctcctgcctcagccccctaagtagctggcactacaggcacacgtcacctcacagctaatttttttatttttagtagagacgaggtttcaccatgttggtggtcaagaccaccaggctggtcttgaacttctgacctcgtgatctgcccacctcggcctcccaaagtgctgggattacaggtgtcagccattgtgcccggcttctttaatgttaaaaaaatgttaatgtctttgtcacaactttggaaactattaattgcattccaaattttatttgaatttcaccagtttttctactaatgtctttttcctgtccaggattcaatccagagtttcatgttgcatttattctcacgtctctgtagtctcttctggtatggaacaatttctccatctttccttatttttcatgatcttgatagttttgaggggtactgggttagggattttgtagaattggacttggtgattagaacctaggtctggccgcctacccatcacagtatcagtaaaagcctcccttgaaattgaccaatggcatgaacatttcagatgagtctgccatctttggtgctcctgggacacgagagagacctgtcttggagacagagacctcacagactcagagattcaggtgctttttctggtaatgattttgtctgcgggctgatcacaaaggtggatgagactttggccaaagctaaggctgcagggtctgggctaaaaaattccagaaaaactaccttgccatgggaggctgagttccaaatcgcagcccgcgtgcagcctgctttaccaaataatgaggcactgggtgctttttaaggcagctgacctttggagcaaattatccaaggaaatctgattagctagttcactgggttcctgcaaaatggagcttggtgtgtttctgcagcagaaatgtcagcataattggagtttctggagctcaaagagcttctttcttattgtttccatcctttggaggaaaaaaaaacaccccaaacaaacaaaacccaaacccccaaagaattgttctttgacttacattctttgcttttgcacatggttcagaagctgctcctgactgtgtttacgactttattaatcaggggaacagcccgaacatcatttaaacaaacaaggccaaaaaaaaaaaaaaatccatccctaaacagatgatgtgagcttaatagagatggccaagccaaagaccttaaataaataaactgactttaatttgtaggaaggagcatggggtggtcattacttgaggctgtgtgccatgcgatgtaaccaaatttgaaactcgctaatttcattattttaatggaagtctgcctcccattcattaggctgacatatgactagccattagtaacagtccatttccaaagctatggtggataaagggtgattggaaatgagcgagggccaggcctggtggaggctggcaatttcagaagggaactggtgggtgggatttatgcaagaggcagggaacacaactaggaaaattgtcaatgtggatggaggcagcaaaccattgagtccaaatacaggcttgagagacctgggtttgaattctggttctgccacatactggctgtgtgaccttgggcaagttacacccccgcactgagcttcagtttgctcatctgtgagatgggagtaatcatagttcctatctcgtagggttgcttgcaatgactcaatgaggcaaattcttaggaggctctagtatagggcttggcaaaagtaaccacttaataaatggtagctatgatgatgataacgttggccaaagtccccagtatttagggacttggagattttgctaatgaagaaatgaaggctgacagaaataaagtaaggtatccaagtttgccccgaacttggactcaaatttctgattcttaatcctatactcttaaaaaaaatcctatactcttaatcctatactcttaagacccgtatttttaaaattgtttcatttcttgaacaggccagtaattcatatgattgaaaaatttaaaaacaagagtatgctagaatagtcagtgaaaattgtcccttctgcctggaacatttccttttcacagacagccattgttacgtgtttcttctttatctttgcagaatttcaggtacgtacaagcaaatacaaatgtatatgcacttcttttttttttattacacagacagttctgtatcctgccttttaaaacttatatcctgcttatctttctgtatcagggtatagtgagttctttcattcttacttataattatatgtttttctattataatggctatattatgtcttatttaattatttctctcttgatgaacagttgggaaagttctcatcttttgctattacaaaccacaatgcgatgaataacattgcatgtatgtcattgtgtacaggtgtacgtatattctaggataaatttccaaaagtagaattgctgagttacagagtgaatgcatttctgattttgatagtgctcaaaggtctgggggcacatagagatggtgctttagcagtgagcttaggctgacagcggttaagagagacatgcctcaggttgccagttaaaaaaaaatctgcataatgtgttgcttaaagaatgtggtaaggtgaaagcttggaaatactggtgtcattggaaagacagaaataagacagagattgtgttgggaagagaacacggaatttcgagtaatttctgcctgggtttgcatcttgaccctgccactcctggctgcatgaccttgggcaggttgcttcacatctctgagctcagtatcctcacctgtaaaataaagaccatgataacttccattataggctgctggaggaagtaaaaaagaaaatataaacagcagttagcatgatgcctggcacatggtgtgcattcaggatataactggggcctttgggtgagtaaccaagttcataatgactcatagctagctaacattattatattatatatactatactgtattagtgggaaatagctaacatttattgagtgtttactgtgtggcacgcactgtgcttactgcctcccatgaaacattccacttacctctcataacaactctgtgaagtattcttgctcacctcagcttacagatggggaaacggaggcaggacactcaagtactttgtctgttgaaacactgtgaacaaacgacagagcttatatttgaactgaagccacttgtcttggagggctcctctgatcccacatcctgttctttttttttttttttttttgggagatggagttttgctcttgttgcccagtctggagtacagtggcgcaatctcggctcactgcaacctccctctcccaggttcaagcagttctcctgcctcagcctccggagtggccgggattacaggcacccaccaccacgcctggctaattctttgtatttttagtagagatggggtttcaccatgttggccaggttggtctcaaattcctgaccacaggtcatccacccacctcagcctcccacagtgctgggattacaggcatgagccactgcacccagcccatcctgttcttttgatccacgtattataacataagaggctgacttattctgagacaaggacatcatgggtggagcccccttctcatctcggtgtgacctagttcagcttccccatctcttaggcagataccattgggttcagaaaggttcaaggacactttttctcctcttagcttagtgcttcctcaagtgatccatgacttatgaccttatgacgatgccgtgtggtgagtctgaaatcagatgaagatttttatcccgacatgatgaacacaagcattgcataacctgactcgggttacccaggatctttcctctgcttgtggtcaccactgctaggattttggaagaaccctttaaaaactaagctctctgaggacaggcatttttgtttggttcactattgtgatgccaatgattagaaaaatgcctgggcccataggagggactcatgttcaatgcagaggtggataaatgagaaagagactgtttgccgcagaatactaagagattttattgttcttgtcataggaaccaggcaatattccagacacacatgacatcagtaacatccatatgtctgtgatggggtaggagagaagactacttttcaggtgggacattttgattggagagggtctctgattcagagagtgaggtgagctattttcttcttgggagttcttggcatttgataatccttggtgtttatttcaaaatatggaagaatttgagatttacttagacatcttggcatgcagtgctaaacctcagacttcctgaatttatttaccagctaggggaagcatattcccaactttaattgtatttacaaagggctctaatctggtgtgaagtctgaaggcatatttgttgtaggagttactcaattagccagtgagaaaagaacaaaggaaaagtcattatgcagatgtatgcccattcaaatctattccgcctctagatgctttcttcgtagtgaagggaagaactccagtctgcaagtctctcgtctctgctgtgttttctgctaattctcttctaatattaggccatgaatgattaataatattgcattttgacactgttagattttgtcaatttttttcaatataaaagcagataattacagattactttaacatccaggaagtgaaatcaaccatgaattacactcagactcatccacgaccccttgaatatctgtcttttttttttcaataggagattgaagtttctttagtcaattacacaagtcatgtctgacaattgagaaaatgctgttcacataaaacatcataaattaaaaatatacagtgtttatattttaatacagtagggtcccaggattcaaacaaagaattttgatctcagaggttgcattatgtagttatgtgttctgctttaaagaactatactggaggtaaacttgaaactgcctttgcagaaattataactgaggaaattatgacagtgaaagagatcagacctaaccaactacaccttttatctaatcttaaagctatccttattcattcctgggcataggccgaaataaccttgggaaggaatttagtttacagtttgactctgaaacaaaattgataatagccgtttcctgaaaagacctccttcttgcctggtgaccagtctgcctttgtaggactaacaaattggctacaagattggaaattatggtttaggggtcatgcagcccctgactccaagagtctgaacctccccagattgctcctagggatagcgtcattattgtaaaacttaagatcagtgcttgagatattttgcaaaccctgcactcagtggatcagctgacaccacccagactggtaacttggctcccagttctgccatcccacccaggaacagaagaccacaaaaaaacctcacttcgaccccctatgataccatctccaacctgaccaatcagcaccacttcctgagccgctacccaccaaattatctctaaaaactctgatccccaaatgctccaggaaggctgatttgaataataataaaactcaggtctcccgcacacgtggctccgtgtgaattactgtttttccactgcagttcccccatcttgctaaattggctctgtctaggcagggggccaggtgaacccattggatggtatatttctcaagagtcaaatattaataggtttaacatgtaagacttacatatgtgtgtgtgtgtgtgtgtgtgtttacatatacatatatttcaatagcttttggggttcaagtggtttttggttacatggatgaattataaattatatagtggtaaagtctaagattttagtacctgtcacctgagtagtgtacactgtacccaatatgtagtttttgtatccttcattcccttttcatcctctcctcttctgagtctccagtgtccattatatcactctgtatgcctttatgtacctatggcttagttcccacttataagtgagcatatatggtatttggttttccatccctgagttatttcacttagaataatggcctccagctccatccaagttgctgcaatgacattattatatcattattttttcatggctgagtagtattccatggtgtatatgtaccacacattttctttatccactcattggtcgatgggcacttaggttggtttcatatcttgacagttgtgaatcctaaattttacgtgcaaggttttgcatctgtagaggaagacaggattctcagtgcatgtgccaatttttgggttttccacttgagaatcttcaccagttttctcttcagaatcaaattcctgactatctggtgcttcagagttatccagaggttcatcattcagtctctgggttgcctctgtcatatactgtactctgccgcttttgccaattgtttactctccttttccaagtggtcaatttcattgttctttcttcaatttctctgtgaagcctctcattttccttaagtgtttcatagagggtgttcctttgttctgctacttctctccaatattgaggggataaatttcatttaatcctaaaatcaaatgcttcttgggtgactcctccaagattttaattgtcactctattctgggacaatgacaactctagagtgggaagtcctggctgtcaactggtcattccaatgcttcctcttggatatgctttgggccagtcacttttttttttttttttttttccgacaagagatctggctgtggaaggatgaatcatcttcagagttcttcttggggagaaactgttctttacatctttgattcctccttgtttctactttatcctaggattcattatacagctggtaaagcacaaaagatgggaggagaggattaatgatcatagtgaattcaggtgactgtggcacagccaacctacattgatccccactgtcgctggagtggctggggcacactgctgaaaagacttactcctcttgaacatactcctttgagtagtttttatatatgtaattttgcatatttttttcattttttttattattatactttaagttttagggtacacgtgcacaacgtgcaggttagttacgtatgtatacatgtgccatgttggtgtgctgcacccattaactcgtcatttagcattaggtatacttttaatcgtagtgccatacaattgtattgcattttccatttatagcatattataattattttgacttttattatgaaactttcaaacagaaaagtagatagtataataaaataaaataaaaagtatatatataacaagtatgtcggctgggtgtggtggctcatgcctttaatcccagcactttgggaggctgaggcaggcagatcacttgaggtcaggagttcgagaccagcctggccaacatggtgaaatgctatctctactaaaaataaaaaaaaattagctgggtttggtggtgggtgcctgtaatcccacctactcaagaggctgaggcaggggaatcacttgaacctgggaggtggaggttgcagtgagccaagatcatgccactgcactccagcctgggcaacagagcaagactccatctaagaaaaaaattatatatataacaagtatgtaaacaaaatacataagtaaaaggtagaataaaaaaagatagcataatacacacccatgtatttattgcttagaattaacactaatattatattttctttgtgcattttttttcttaagtggttcaaaagaaagtacagacatcatgatattaaaccctaaatcagtggctctcaactgaggttgactttgacccttgtcctccgcaagaggacttttggcactgtctggagacaatgttggttgtcacaaaaggaagcatgcctgcatccctggtagagatcagggatgttactaaacatgctacaatgcacaggactgccccctccaaaacaaagaattatctggttctaaatgccggtagtgctgaggttgaaaacctttggtctaaatgattaagaatgcgtttcttaaaatgcaaaatttcacataaccacatagcaccatcacttctaacaaagagaaaaataactctttaaaattgtctaataaccagtccatgtttccccaccattccactaaaatgttttttacagctggttttagcaaacactttccattttattagcactgttaatagaatctcactctaaatgactacagaatagtctgttaaatggattccctgaaatttattcaaaggatctatttttggatattagttttgcttccaggttttagacaaattatatttttgtaaataatgagagtttacttcttttctaactttgtgccttttctttcttttatttgccttatgttctggctaaaaacttcagtaaatactgaacacagcatatgagagtgggcatccttttgttgttccagattttaggagaaaaagatttaatattttattaagtatgatattaactgtaggtttttaaagatgaacgttatcatattggagatggtcccatctattcctagtttcactgagcgtttttatcataaagaactaatgatttctgtcaaattttttttctgtgtattttgaaacgatcaaatggttttcaaactcttactctgttatagtatgatgaattatattgattgattttcattaaaccaaccttgctttcttggaataaaccttgcttggtcatgatgtattattctttatatgtatgtataaatatatatctatagatacatatacatatatacatatatctatctatatatatagatatgtatacatatatatatagagagagctggattctgtttgcaaatatttggtttagaatttttgtgcctatgggctgggcgcggtggctcacacctgtaatcccagcactttgggaggccaaagagggcagatcacgaagtcaggagtttgaaaccaacctcaccaacatggtgaaaccccgtttatactaaaaatacaaaatttagctgggcgtgttggtgggtgcctgtaatcccagctacttgggaggctgagtcaggagagtcgcttgaaaccggaagggggaggttacagtgagtcgagattgtgccactgtgctcctgcctgggcaacaagagtgaaattccgtgtcaaaaaaaaaaaagaatttttgtgcctatgttcgtgagggattaggctgttattttttttacttgtaatagctttgttatattttggggtcagggtgatgctggccttctatattaaattgggaagtgatacctcttcctctatgttccgaatttgtgcattattgatatttctcccttacatgttttgtagaatttactaatgaaccatatatgtggaaaattttctttttagaaaggttttacaaatttaatttctttaatagccatggggttatttattttctgtgtcttcagttgttagtaatttgtgatttggattaattaatataagttgttgaattgttagaatgttttaatatttatcctttttaacatttttagaatatgtagtgctgtttcatttttatttatgtgggcaatttgtgctttccctcttttttttgtccattgttgttaagactttgtattgccactttactattagtatttcctttcttttacttgctttagatttaccttattcttctttttctagcttcttaagatggaaggttgtatatacctttcttctccagtgtaagtatttaaagtcataaattttcttctaagcactgcgttagctttatttcacaaattttgatatattttcatattattcagttcaaaatattttacagtttcctttatgatttcttttttgatctatgggttatttaggagagggttgttttattgcccaatacataggggatttgctagatatcttattgtgaatgattttattctatcgtgttactctgtatgatttcattctttgatattcattaatacttttatatgatccagaatatggtctattttactgaatgttccatgacaactttaaaagaatgagttttctgcagctgttggatgtagtagtttaaaatattatgtcagtttggtttacagagttgttcaaatagtgtttactgaatctttgatctgcttgttctatcagttataagttgagcatccctaatttgaaaatctgaaatctggaatgctccaaaatctaaaactttttgagtgctcagagtaaatgctcattggatttggagcttcatattaggaatgctcaaccagtaagtataatgcaaatattccaaaatctggaaaaatccaaaatccttctggtctcaagcattctggataagggatgttcaacctgcaccaagagggtttacattctccaactatgattgtgaatttttttttatttctcctttcagttctgtcagtttttcctttgtgagttttggaaatgtgttgttaggtacatctatattcatgattgttttcttctcaattatcctttttttattattttgaggtattcttcttaatatccagtcatactctttgtttaaatgctacattgtctgatattaacatagtcataccagatttcttatttttggtgttttcatactgtatctttttctttccttttactttctattggcctgtatctttataataaaattgtgtttctcaaaaacaacctatagttgggtgttgcctttcatatccaatttactaagctctgactttttcttagaggagttagtccatttacatttaaggtaattattgatatgattcgacttatgtctcccatcttggtatttgttttatatttatggtatttattctttattcctttgttcatttttgtcttttcaggggaaaattaagtattcttaatattacttttatatcctctgtggatagttagattatatttcctttttaaaaaatttagtggttactatagaaactacatgtaaatgttcacagtataccttcaaacaatgtttaacctaattcacagtataaaaatcatgctgcagtataattccacttatgtccaatcctgccttttgtgctcttgttatattctgtgttacagtgacacatatggtattaatcctatcatacgttgttattatttccagtctacactgtaaatagtcacttaaatatttgagaaattataaatgtaaaaataaaagtcaaaaaaggtcttttccatttatacaaatatttaccttttctggtgtttttaattcctttctgcacatctggggttccatctgatataatttccctcagcctgaagtatcagcaagtatctcagattttgtctctctaaggatatctttatttcatcttcattttgaaggatattttttgctagacatagaattctctgcttccatttcttttttcttgtcatactcaatgatgtcatttaattgttttctggctttattctagattctgatgaaaagttagccatcataaatttttttctaatgtatttaatgtgtcattttattcctattgctttttagatttgctgtttattgttttatgtgatttttggttgttaaatagctaggtaaggttttctttatatttatcttgcttagggttcactgagcttcttggctctacaggtttatgtctttcatccattttggaatgttctcagatggttattattatatcaaatatattatctatccagtttttctcttctctttctggaacttctattacatcacttgatatcatgttagattcatttatactgtccaacagatcttgaatattctgttgtattttttccactatttttgccttttgtgtttcagtttggatactttctattgatctgccttttgtccctgatgctttcatctgttttttttccagtgtgctgttaagcacatctgatgttattgatttctaatattgtatttttcattgctacttatcccatttgattttcttctaacatttcctggtgaacatgtctttaggaaattttccatttcttcatgcatgttatctatatttttcgttaggcttttggcatttttattatagttattttaaattccctgtctaataattccaacatctgagtcatctgtggatctgtttttcttgattgtttctactcttaactataggccacttttttgttgttctttaaaaaaatattaatacgtcttctaatgtttgattgtatactgaaaattctgtataaaagaacagtagagactaaagtaaaaaatatttacatccaaaagagcatgcttttgataagacctgtagtaaatctctcctctcctctaaaatgatcttcactttgtggaatttagttcatttggatttttctgtgtccttagttcactgaaggttttcttttttccaaatagctttgtagctcatctaatttgttttgattatttgcatgagaatggcattttctgttgactttctatttctgaattcaaagtagtatgcaaccaaatatgcttcaacaaagatgtgcattcaccaaatatttttttaaaaatttacaataatttccttaacataaattctagaaggtagacattgatcaaaatatctaaagattttttatggttcttaataaaatatggtcatattacatctcaaaaaaacaaggaagttatacctatttttaatgagtgcaaataaccattttgcttcataagctttaagtgttataattaatttgactttgctaacttattcaaaaaatattatttcatattacatacctttaacttcaagcactgtacaggatcaaaatcttatgttcattttttagcaggactgactttacctggagaataagtgaacccattaaacatcagaattgtttgagtagatagatggtaatgactgatatttattgagtgctttttatgaaaaaagtggtgttttaattctcacagtgacctgtgaagaaggttatcatttcatcactccagaaggagggtttattccctacagaggagaaaagagaggctctgatataatgggacaggattaaattcaggagaatctgagccccaaacctcagtcttccaactttgatgtgatttaaatcatatctgaatgcaaccaatattgctatctgtattagtcagctgttgctacaataatgccatataacaaacaccccctaaactcacacttaaaacaatagttttgtattctcattgagctgcagtttggcagtagaagttttgctttaaaactcccctcttagtcatttattgaagaaaaacataatgaatacctcttattttccaagcactcttctgggctctggagaaacaacaatgaataaaatacacataaatgctgcccttaggaaacttactttcttgagggaagagacatacagtaaataagtagactatatagtaagtaagatgctgataatttctttattttgtttatttttctttttctaaattggtttcctcagattgaagataatttctttctttttttttttttgagacggagtctcgctctgtcgcccaggccggactgcggactgcagtgggcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgataatttatttcttttgtttttttttttgagacggagtctcgctcggtcgctagactggagtgcagtagcgcaatctcggctcactgtgacctctgcctcttgggttcaagcgattctcctgcctcagcctcctgagtagctgggactacaggtgcacacaccactacacccagctaatttttctatttttagtagagacaaggtttcatcatgttggccaggatggtcttgatctcttgaccttgtcatctgcccgccttggcctcccaaagtgctgggactacaggtgagagccacagtgctcggccagattaatttctaatgacagctataaagcagtggaagaggagaggacgggctgtcaggtgaagaacagcaacagggattgctgttgcaatgtgctttctcttatcactgcgcttcctagcataccgccaaaccctggcatctctgttcatttttacaatgcagagctatttcactacttctttgtttcactgtcttcttctaaactgtgccctggggggcctcacatttcataaccaaagctgcctatcaaagtgttttgctaaagaaaatatatttagtctggagagaaataatgtctctcccttagggacagaagcagctgcagtcagtagtagttttagatagcatttttctcctctgtcacgcagcattgcaatctcttctttatttaaaagttgaaggtcagaggtgaagatgtgtggaaacttactgaggaaaggagacatttgcagagcacccactatgtgctagatctggtgcaagcagatgtcttcaaataatccttgaattagacattatgattcccattttcctaatgcaaaaactgagctgtatgcaggcaaaataatccactctcggacacaaaaccagcagttgcagatctaagttttaattcttgagtgtgtccttccagcctcctcccaaccaccttcttgttgctttggattggatgtagagagctgcttattttataatctttgtggctagacctggaatgctggctttgtgtttctgggcctctctcccgcttcatggctagtctgtgtggtatagcccaactgctgccccagtaataggaggaggcagtcaggtctggggggaaatgaaagaattcccagggcacccggcaaatgaatgaattccactgatcttgtttggttccttatgggatcatccatcatgatttaacaacttgcagcccagggtaactacaggcatgcttcttgcccaaagccacagacacagtgtaattcatggctgaaaaacagatttgtttttctgttattattacctgtatcatgcccattatactatattatatgctgtgttatcatgtaatttagtcctctgtctgccgcattgacgtttgcttttgagaagactcggcttttctcattcttttgtaatgcactaaagtaaacaaattccctggctgtaatgtaagcagatatttgttgagggcccactgtgtgtacagtagatgggatacagaaaagctctggttttgctcaggaaacttaccctcctattgttttctgcatttaattttatttttaatttttttctgaggcagagtctcactctgttgcccaggctggagtgccctggcatgatctcggctcactgcaacctctgctgcctgggttcaggccattctcctgcctcagcctcctgaggagctgggattacgggcaccggccatcacacctggctaattttttttttttttttttgtatttttagtaaagacggagtttcgccatgttggccagcctggtcttgaactcctgacctcatgccatctacctgccttggcctcccaaagtactgggattacaggcgtgagccaccatgcctggcctatttttaaattttttaatgcaatatttgaaacacagaaataatatatatatataacatgtaagttatcaaacatatcaacaaaatgaagacccataaaatcattgctgtcttagtccatttgtgttgctataaaggaatacttgagactgggcactttattttaaaaagcagtttatttggtgtatggttctgcagtctgtacaagaagcctgacactgcatctgcttctggtggggcctcaagctgtttccacttagggcagaaggggaagtggagggactgtgcacagatgacgtggtgagagaggaagcgagagagagaggaggagatgccaggctcttttcagcaactagttctcctgggactaagaatgagaacttttttttttttgagacaggatatccctttgttgcccaggctggagggcagtggcatgatcttggctcactgcagcctccacctcccaggttcaagtgattcttgtgcctcagtctcctgagtagctgggactataggcgcctaccaccacgccctgctaatttttgtatttttagtggaggcagaggttcttcatgttggccaggctggtctggaactcctggtctcatgtgatcctcccgcctctgcctgccaaagtgctgggattacaggcatgatccactgcacccagcccaaaatgagaactcacttctttgagaatggcaacaagtcattcatgagcaatcaactcccatgccccaaacacctcccaataggtcccacctccaacatggggagagatttcaacacgatgtttggaggatcaaatatccaaactacattaagtgcctaactgattgactaaaatgaccagttctactggatccatctgggtggaaagtgcctcttgcatcccccatcctatccccatgtggaaatctacaatcctgttttgtgtttatcatcccctttctttgctttgttagctttaccacaaagctttatcagttttgcttgcttttgagctttataaagatggtctcataccttaaataatttttttttttttttgagacagagtcttgttctgttgcccaggctggagtgcagtggcacgatcttggctcaccgcaacctccacctcccaggtccaagtgattctcctgcctcagcctcctgagtagctgggattataggcatgtgccaccatgcctggctgatttttgtatttttagtagagacgaggtttcaccatgttggtcaggctggtctcgaactcctgaccttgtgatctgcctgccttggccacccaaagtgctgggattataggtgcgagtcactgtgcctggccttaaataatattttaagacttgctttgttcacactatatggtttctaagatttattccatttttcttcatgcttcttttctttcttttctttaaattgaggttttttgtttgtttttgttttgttttcaaactctgcttttccctttacttgttggaattttaaaattccaaattcaaatattaagattctaaaaattctaaaattccaaaaatttaaaacctcttttctatcatctctcccttgaaattttattgtgtgtatcaaggaaaattgaaagcccataaatatcttaacttccccttccaaatactgtaaggactttatgatactttaatgtcaatgacttccccattacttaaatgtcaatgttgtcagtagtttcaatctcatcttaaattctcacaaatcagattgttactattaatattttatatagataatgttttagatttatctcctagtttgtaagcttacttgctaactattcttcttacactcgaaatttttttttctgggctatttttttttttttttttttagtattcttttagtgggaatttatcggtggtaaaaatctctcagtttttgtttatatggaagtgtcatcatttcacactcattcttaaaagacacatttgcctgaagcgcaattctagaatgatggttgttttcttttagaattttggagatgttattccagagtcttttggcttctgttgctttgcctgaaaactcaggtgatgatctaaatgtagtgtttttgaaggttatctgcccctttcccctgtgagcttttaagtcttctctgtctttgatgttctgtggtttcactgcaatatgtctagctatgaatttctttgcattcatcttgcttatatatgctgtgcttggacctgaagattttatgtgtgtgtttgtgtatatgattatctatctatctatctatctatctatctatctatctatctcatcatgcctcacttaacaatcgggatatgttctgagaaatgagtcattaggtgatttcatcattgtgtgcatatcatagtgtccttatacaaacctagatagtgtagcctcctacacacctaggctatatggtatagcctatggctcctaggctacatgactgtacagcatgttactctactgaatactataggcagttggaacacaatggtaaacctttgtctgcctaaacatatctaaacatagaaaaggtccagtaaaaatacagtattacaattttgtggagccactgatgtatgcagtctgttgaccaaaatgttatgtggtacgtgactgtattttaccatttttacaacatttctttccccctcccctcccttcccctcccctcctctcctttctctctcggacagagtcttactctgtcatccaggctggagtgcaatgacgcagtcttggctcactgcaacctccgcctcctgggttcaagcgattctcctgcctcagcctcctgagtagctgggactacaggcatgtgccaccgtggccggctaatttttgtatttttagtagagacagggtttcaccatgttggccaggctggtctcaaacttctgacctcaggtgatctacccacttctgcctcccaaagtgctgggattacaggcatgagccaccctgcccagcctttgcaaaatttctatctattatcacttttaatattgcctcttatccagtctctctattctctcctaatattatgtctaatatattagacatacattagtctgtttctttctgtcctctgtatctcctaacttctctttaatagttttaatcacctaatctatttgtgttgttgcaccctagataatttctttagacatatcttcaatttctaattctctttcctgctatttttaatctgaattgagtttttattttatttttcttttttgttatatatatatttttgagacagattctcactctgtcacccaagctagagtgcagtggcacgatcctggctcactgcaacctccacctcctgggttcaagcgattcttgtgcctcagcctcctcagtagctgggattatagacctgcgtcaccaggcccagctaattgaattgagttttttacttcgacagttatatatttgatttccaaaatttttatttgaccatttttcaactatacctcataatttttttataaacgttgattattttcccatttttctaattccatcttttatttgtttaaatattttaatcagaattattttatattatgtatctgattatttcaatggttccaatatctgaagtttgtgggagtaaaaatttgttgtttattaattctgctgattctcactcatggtggcttatttcctaatgagtttggtggcttttgattataagctcacagaggcttgatcttaatctatggaaattcttatgacccaagtagaaaatgctttcacacagggagaattttcatttgcctccattaggagcctgggacaccaccagcattgtcttccttcaaaataactagccttacatgggagtctcagattccccaaccttgtcacagtcagtgactagttgttaatttaatcataatcacttgatgtatttttttaatgtcacacactgtccggtgtgttccacaaacattatttctaacttgcaaaataatcttgtaaaccacttcactgttgaggagataaaagctgggggaggccttccacacaatctgcttctcacaattctcctacacttctacaccatctctgcccatcaaaatccctcccctccttctacaccgtcctcaaatgctgcctcctcagggacactattcttgagccacaaagctgagcttaggcttttgctcctgtttatttgtttgttttttgagacagagtctcactctgtcacccaggctggagtgcattggtgtgatctcacgtcactgcaacctccgcctcccaggttcaagtgattctcctgcctcaacctccctcccaagtagctgggattacaggtgcctgccaccacacctggctaactttttttgtattttcagtagagatggggtttcactatgttggccaggctggtctcaaacccctgacctcaggtgatccgtctgccttggcctcccaaagtgctgggattacaggcgtgagccaccgtttgttcctagaacacataatttatatcggtgattcaagtaatcatcccatttcacagatgaagcatttgaggccctggagtttcatttgtaggcatttgtgcggatctacctaaaatgtcatctggctgcaaggccatcgcttcagtgttatttttgcatttatccttctccatccctcctaggcaacccctagttccttaccttcctcatatacatacagaatgcaagactaagaggaaggattccaaaaagttggatacattaaatttaggtggagagatgaggaacatatggagaacaggccatcagcttagtgattgtcaggcgattcctgtcatcaatatgtacccccgtggcccatgttaagtcccttactcattgggactgccctggtcctccgttgacctcaggtaaacaatcatttaagtgggattttattcaaaaattgcacttagagtggttttagtgggtcacattggctcttccatgaattctttgcgtctttttaagccagatctttggcattttatcaatctttgctttggcatcacgtttgaggatatattcaggggattttttttatttttaaaaaaactcttttgtttattgacagaaatagcatttctactaatacctcaagagcaagtactatcatgaatttaaattatttttccccaaatttaatcaagagtacttgagttaccagcttccaggttggccagaagtcctgaattaccttattgagactttctgctccagttccagggttcttgtataattaggagtcctcacaacttgtactcccaattagggaaaagcgctggtatttgtcagcctgtttgggtttcctactgagagaagatggcactgttgaacacggagccagtgctgctgggctacaatgtagtgcgggctggtaactctcacggtaacccctcttagaggtcctgttctggatgaggtttgtttatccactcaccacggtccccacaactccaatgccttttccaatgacagcaggtgaatgagacctacccaggatcaggccatttttactttcagcccctgagagagaaaagaaattaatttggttctcttttctgaacaatagagatttattcgttctaaaaattctacaaaccatatccagcaggcaaagaatgcctggactttagataaaccaaaagggcagtcatcctttgtggcagagtgctaatttttctccagtatttattttctccttcattttgttagcagtagaacttctcaagctttcactctgtatgtgaccatctgggtagagactacctttcttagcttctcttgcaactgtgtgtggacacgcaactaaattactgcctccagggtgtgagcagaacggatgcgtgcagcttcaagtcacagcactggaaaggaaaatacttgcctttcattctctatttcctctttctacacgttggaatttgacggagttctggcaagtctacttcaaccatgtggatgaggacaatacttcagaggaaagaagaacattaaaatgcaaggaaccagatccctagatgactgattgcaaggggcaaagaaactatggcagccctagactatgtacctctggaccaatctgtgaaagagaagtagattcctacttggcctgagtcactgtgtttttggatctcttgtaccagcaactcagccagtgtcctaaataacatgcatcctccctagtgggactggagagcttataggttcagtctcactgatgatccaacctctttagagcaggcaagaggaatttcatgtacctcttgataaagcggtaagcaaaacacaaattcagtgggacactccactgcaggtgattttgaggttctgcagtctgtctatcaagttaaatgagaaaaaagaagatagaggatcctggctgcataatcacacatgcacggaaggcaaaatcatttggacgggagccttgagtggtggagaaagcaagggctctgagccagatatttcagagttcacatcagtgtgtctttataatttagttgtttaagtcactactttctcatctgcaaaatgggaattgcaatgcatatttcatgtacttgttccaggaactaaatgagataatctatttaaaggtcctggcacagggtctggtaaaaattaggtgttaagtgaaagtaagttcccttccaatgtctgggcttttgatcattgcaccaagctgcctctgcaaggcacacaagactctaggtgatctgattcctccctttttcaccccttcagcttcatctggggccacttttcccttgcccatgactctctgactcctaagcccatgactagtttcccttcagtaccaaagccattctaaattctctcctgcctctggatcttcatacttccttttccttctgcttgcaaccctttctcatgatcacatttcagagaagccctcctgaggaccacgctatctaaagtagtttcttgtccactgtgttcagcagaataatgacaccccgcaaagatgtggtttttatgaagacagaaacatctgtcttatttaccagctcacctgctacagtatggattatgtagcacatactcaatatttattgaatgcatatatgaatgaaaaattgaatgggaactttgaaattcatcctcatccctggaacccaagagtatgttaagtgacatggcaaagggcaattaaggcagcaggcgaaattaagtttactaatcagctgaccttagggagctattcctggaatatctggttggacccaaaggaatcataaagatctttaaaagtggaagagaggggcagaatcgaagagtcaaaggtaggagtgtgatgacggaaacaggtatgttactgcccttgaagatggaggaaggggccacaagccaaagaaagcaggcagcctttagaagctggaaaaagcaagaaaatggatgttctctagagcttccagaaggagcagccctgctgacatcttgatctttgcccagtgccttgatttcagctcagtaattttagcccatgttggacttctgaagtacagaactgtaagataatacgtttgtattgttttaagccactaaatttgtggtaacttgttccagcaacaataagaaactaatatacctgtatgccagcccagtatctaatatatatatatcgccctctttatttgctgcctaacactcagcacgatctgcaattatcttatccatttatgtgtcctcttgacttagtcaaatggggcttttatgaagacacaaatgtctatcttatttaccagctcacctgctagagtacgggttatgtagcacatactccttctttattcatttattaattatactttaagttctggggtacgtgtgcagaacgtgcaggtttgttacgtaggtatatacgtgccatggtggtttgctgcacctatcaaccacactaagtatttctcctaatgctctccctcccctagccccccaccccaccaacaggccctggtgtgtgatgttcccctccctgtgtccatgtgttctcattgttcagttcccacttgtgagtgagaacatgtggtatttggtcttctgtgcttgtgttagtttgttgagaatgatggtttccagcttcatccatgtccctgcaaaggacatgaattcctccatttttatagctgcatagtattccatagtgtatatgtgtcacatttctttatccagtctatcactgatgggcatttgggttggttccaagtctttactgttgtgaccagtgccgcaataaacatacatgggcgtgtgtctttatagtagaatgactccatatttttttaatgcatgcatgaatgaaaaattgaatggaaactttgacattcattttcttcatctgcagggcttgtttctgagagtgtgcacggagattgaagggcaggggctcatgtgacagtgtgaagcaggaattctgaccgttggccaaaccaagccctgaaactcaagttctgtttgggagtgagaggcaggttagaggagataaacacccagccttttaattttttttttccagcctgctttaaatcacctgtaaatctttagtggccaccaggaggtgaatgactcatgctaccttttctcagcaaaggctcttcaggatgggacactccaagtttttaactcccagcaacagttcggctcacagcgagaccgggccctctgctgtcactgaagtgtgtgtttgtttaattagggcgccgagtagagcctcatcctggtggcagatgttgccatgtgtagtataataaataaaagtctttataggacccagcaggcagtagagccttcagttagcagatggcgaaatattaaactggcagagcaataacttaactgcctgaatcagctggtccctgcccggatttgctccaacatgaatcaacttcatataggaggtgtcgctcagcctcagatgtgtaccctcacctgccctcgctcctggtccctgctaggaccatgtttgccttggcataccactattaaagtcagattactgggtttaataccattattaaagtcagatacataagtttttttataaccttattagctggtcaaagagaggtgcttgctgggctggaccgtagggttcttttacaggggaaggaaatgcagtaagcctgtggatgtcctctgtgccagtttctgcttggctccagattagccagacagtatgttacctggcccctgggccctcgtggtgcaggagaaggatcccacttggctccaggaatcctcctgtttaagaccaggaggatggttcagttagcccagggagaccccactggaggagagaacagggctttttgttctgaaaagacccaaaaaagggattgactgacatctattacattgctgcaggggtggagtgaggggcattggacttgtttactaaattccagattatacgactgatatttacagagggcttgctatgtgttgggactttggataagggctttgcagacgaacagaaacccaccccatctttaccataaccctgtgaggcagtaacaacgaacccttctagcgctgtgtgccaggccccgttccaagagcttaatgtacattgactcactcaactccccaacatgaaacattaaacccatttctcacatggggaagctgaggctctgagaggtgtgatgatttgttcaaaaacacacagctagaagataccggagctaagatgcaacccaattgtgtctaaactcagaggcggcagttgcctttgactccaggaggcataaaagtaaacttggacagaagatggtgaacccgtaggcaaaatgccacctagaaaatgaagtggggaactgatactaggaaagaggatataaaatttatatttgttgccatttattgccataaattcggctactttttaacagatatctgaaataattttctcctttaattcttacagaaagccttggaggcagcttcaattagaagctaattttactaattagaaaattggtatcagaaggacgattgaacgtgtccaaggtcacacagccagtaaggagaggggcctggactggagcagacctgtctgattcactcagacaggactggagcagacccttgctttgttcactcaatagttttttccaaaggctttttaagaagaggactttggagttgtaaagaatttagatacgtggaaatgagagaaaggccttccaggcagaggaaacaggatgaacaaagtcttggcaggtatggacaactctgtgtgtgtgtgtgtgtgtgtgtgtgtgtgtgtgtaggtaggtaggttggttgttggagacagacccagggaagccttgaatggcatgctgaaagaattggtctttctgcccgggcttggtggctcatgcctgtaatcccagcactttgggaggccgaggcaggcagatcacttgaggtcaggagttcgagaccagcctggccaacatggtgaaatcctgtctgtactaaaattacaaaaatatcagcccagcatggtggtgcagggttgcattctcagctactcgtgaggctgaggcaggagaattgcttgaaccccggaggcagaggttgcagtgagcagagatcatgccactgtactccagcctgggcaatagagggagactccatttcaaaaaaaaaaaaaaaaaaaaaaaggtgcttctttctctggcaaaggaggatgctcaagttttctaagtcaataattaagctcatgcaaacaaagggccctttctgatcaccatggtgggtttccactgcctgcttctccgctaacttctataacgaaaatgatactcaagacttttcttgccatcatggtcaataatgtgagggtttgagcacatcctcagagttaggctttggaatttcttgaattcctgctgtgtggggcgtgctggggagtctttggtctgagggctggctgctgctcgctttggccctttgatctcccagtgcccgggatctttcagtctagcttttcctgtgtcctgcattgccagtccccccaccctctggatctgtcccctttttgttgtctctgagctaatgggacagattccatggatgctggcctggacctctctttcttcagcctgtctcatgacctctaaggcctggcctgaggaggaggcataactctaggaggtcgaggtgagcctggcgctgcaagtatgcccctaatttgtgaaaccacagtcatagatatcacagttggttaatacactcgtccttggattctttcaaattcattgctcctgttcaaaaaacatttctctttttttcttattgcagtagtaatacatgcttattgtatgttatgaagaagatgcagaaaaatataagtgatgaaacgatagcccataataatcccacaaccccaagacaatcattattaaccttgggtatattttcttacagtcattcatacagacgtatacaaaacacacgtctgtctatatgaaatacttacgtgcttaaactcataccagatatatgattttgcattccatgtttccactcttataaaatcagtgcaatttttttacattgctaaacttctttgtaaaaatttatatagaaaaacactgtaggccaggcacggtggctcatgcctgtaatcctagcactttgggaggctgaggcgggtggatcacctgaggtcaggagatcgagaccatcttggccaacatggtgaaaccctgtctctactaaaatatgaaaaattagccgggcatggtggcacttgcctgtaattctagctacttgggaggctgaggcaggggaattgcttgaacccgggaggtgaaggttgcagtgagctgagatcacaccactgcactccagtctggtgacagagcaagactccatctcaaaacaaacaaaacaccataaaacaatattaaagggaaaaaagcagaatttgaattcatatgtttaatataatttcaattatgttagctaaaaacacatgggtacacgatgcctatgcactacaaaagtaccacacaggatggaagcagagactacaaaatattaatagaggttatctctaggggatgtgttttattttattcttgcatctttccatgttttccacgtttttcccacatattaatcatgaatttttctaatgagaaaattttgcatagctacataatagtccaagatatgaatataccattgtttatttaattattggcctactaaaggcctttgggtagtttcaaagcttttacatttataaataatgttgtgttaaatgttcctttatctgttcaacagatatttgagagtctatggcatgccttgtatcttggtgcctatatctgcatatgttatataaataatattttatttttgtggaaactgaagagcaaagaaatcaccgagttagttggggacacggatgggtctgtgcttttaggtctttcaattctgaggatttatctttgccagactgctttcctcaaacctctggtctccctttggcagaatggtggcaaattggaggttctcttgggtatattgagtcacagatctccttgaatagtgtgtgacactactcaagaagtacctacttggcccccagcctattgcctggtggcctccttcttgcagatgcacccattttgcagatgggtcaaagcatgtagtcttacagcacaaatacttgtctttgtggaaagtcatcctccctctgcttggctgctagactttcctgtgtgtccatcataggtgtggctttgtggcacccagtcaatctgattaagatggttcttgcttatcagcttggtgctatttgagatgatacattggaagtccacctcaaatatcacctcctccctgaaattatccagatactctcagacaaagttcacagctcttttttggatttttttttttttgtgtgtgtgtatggccttattttaaaaacatatctctccaaaccatggctgtgtctgtacatctttttctcatcaagtaggttattagctctttaaggtcagggaccacatgttatccactttggtaccctgtccatttgcttctgtttctcagtctagcgcttgccttcatctccactgccactattcaagtgcacaccttctatcaccacccacctagaacactgaaccagtgtccgacctgctgggactccctgcatctgctctcgtgccacttacaatccagttttcccatagcagtgaaagggattatttgaaatcacaaatcaaatgtgccatttctttccgtagctcagcaagatctggccctcgcctgcctctctgacatcatcccagtgaactcatccccattcctcacagcacttctctctgatcccttttatcacatcattctgcataacagtttggattattgcccagcaagtgttgatggcctccccgctccaattgtggatggtatttacttccctaccacatgattttgggcttggccatatgactcgttttggccaacaggatattagtgggtagaagtgaacagagatttgaaatgtgatagagtggttgggctcacctactttagttcttccatggccatgagggtaacatgccctgggtaacctgttggtcccagaagagtgagagatgcaaggaacagacatgaactaaacatatggcctggagccaagcccagcctagatcagccaaacccaggacaaaccatagttgcataaatgaggtacacatgcttgctgttgtggagttactggctgtatgctacccagcactgctgtggcatagttgactaacacaccctattttatgcacttcataattattattttgaactttccgtcttttctaatcaggacatagtttctatgataaaagagacattgcctattttgctctataattccagctatatatatgaaatcaccaataaatatgcatgtatgtgtgtatgtatgtatgtatttttgagacggagtcttgctctgtcgcccagtgacgcgatctcggctcactgcaacctctgcctcctgagttcaagtgattctcctgcttcagcctcccaagtagctgggactataggcacgtgcacctttttttatttttgtatgcctggctactttttgtatttttagtagaaatggggtttccccatgttagccaggttggtcttgatctcctgaccacgtgatctgccagccttggcctcccaaagtgctgggattacaggtgtgagccactgtgcctggcctgccaataaatatttattaaatgactgaatacccccggcatgcttagcacaatacctgtgcccgatcaatatttgctgaatgcagttggtgaaccatccaaagcagcctgtattgtgtcctaacatgtatatctttaaactcaacttggcacgtgggtgacacctctatcccctctcttcctctctctgatcacataaaagatcctccttgtaagaatacacacactgaaaacagatgatgtgtcaatgccgtaatttaaaccatgaatctgtacttgcttaaagatgaacttgtttggaagaaaaatgaggaaaatgcttgtgcccgtccaacagagtccccggataagtacatcaattttgcttcttagcggatccagcacataataaaagaaaactgctgaggtcagcagcagcagagaagccacacttcttattttcacaaacacagttttggggatggtaatcatatctattagcaagggtgacaccactgtgggcctggcagaaaaatgagctctcccgcattgcaaaatgagcaaagtggagatcgataaatcataaaattagttgagacatcatctatctttcatggctttccctttattcctgccacggtccctcaggacactcattcatttactgcattttattgttgggaaaacacgtcaaggtttggaggctgcattcagttaggggagcaggggccataatgtgtgtcattaattaggcaggtttgggaggttcaatccaaagtctggtctcaactgacttccataaattgagttttaggactgcttctgcgtcttgtgtgacttcatcaaaaagagaacgttattgaaatatgccctgagagggagagagagagaaagagggacatgtctgctcactctgtagaaacgataaatttagggacaaaccaggtgataagccagatgcaatctgagttgtctaaagattcttgctgttatctacatgtgattgaaataaatgtgagacacagagcttggagtgcatagatacgtcatctggtacctatattcttcatgtcaaggcatatagtaaacagattttttttcaaaaaattattgtgataacacttaacatgagacgtaccctcttaacaaattttaagtgcacaataccttgttgactctaggtacataatgtgcagcagagctctagaacgcattcatcttgcctgacggaaacttcacgcccattgatgagtagctcctcattttctcctccccacagccctggcaaccaccattacactcttttgttctacgcatttgactatttcacatgacccctgtaagtggaaataagaaatatttgtctttgtttgacagatatttaacttaccataaagtcctcaagatttaattcttgttctcacatcttgcagaattttctcctcctgctcctcctccccctcccacctcccccctccctcccttcccccccacttctcctcctcctcctcctcctccttctccttcttcctcttgttctgatggagtttcactcttgttgcccaggctgtagggcaacggtgcgatctctgctcaccgcaacctccgcctcctgcgttcaagcaattctcctgcctcagcctcccgagtagctgggattacaggcatgtgccaccatgcctggctaattttgtatttttagtagagatgggatttctccatgttggtcaggctggtcttgaactcctgacctcaggtgatccacccgccttggcctcccaaagtgctgggattacaggcgtgagccactgtgcccatcccaaattttattctttttgaaggctgaataatattccattgcgtgtatataccacattttctttacccattaatctgtcatttaggttttttccccattttggctgttgtgaacagtgctgcaatgaacatgttagtgctaatatttcttccacattctgattttaatttttatgggtataaatccagaagtaggattgctggatcatatgctagttctattttcaattttttgagaaacctccgtactgtttttcttagtggttgtaccattttgcattgccaataatagtgtgcaaaggtttcaatttttctacatcttcaccaacatttgttgtcttttgtctttttgacactagccaatctgacaggtgtgaggtgatttctcattgtggttttgatttgcaattagtgatactgattatttgtggtattggacattttttcataaacttgttggcttaactaaggaggtgaaagacttgtatactaaaaattataaaaccttgaaagaaacgaaagaaggtggcccggcatggtggctcatgcctgtaatcccagcactttgggaggctgaggtgggtggatcatgaggtcaggagtttgagaccattctggctaacatggtgaaaacccatctgtactaaaataaaaaaaattagccaggcatcatggtgcgtgcatgtagtcctagctactcgggaggctgaggcagaggaatcgcttgaatctgggaggcggaggttgcagtgagccaagatcacaccactgtattccagcctggtgacagagcgagcctttgtctcaaaagaaaaaaaaaaaaaaaagaaatgaaagaaggtataaacaaatggaaagacattccaaattcatggattggaagacttcatattgttcaagtgtccatactatgcaaagcaatatgcagattcaatgcaatccctattaaaatccaaaaggcatttttcacagaaatagaaaaaatgagtctaaaatttgtatagaaccacaaaaggccacaaatagccaaatcaaccttgagaaagaagaacagtgttggaagcatcacacttcctgatttcaaaatatattacaaggccacagtaattaaaactggtataaaataaaatatggtactggcataaagacagacatataggccaaaggaatacaatagcaagtccagaagtaaatctacacatatgtgatcaaatgatcttcaacaatggtgccaagaatatgtaataggggaatgattgtctctttaataagtgatgctgggaaaactggataaccacatgcaaaagaatgaaataggatccttatctaacaccatacatgaaaatcaactaaaaaaggactaaagacttacaagtaaaacctgaaactgtaaaactcctagaagaaaacataggggaaacacttcatgatgttggtcttgccaatgatttcgtgaatatgacaccaaaagcacagacaacaacaacaaaaataaatgatgagaactatgtaaaacgaaaaagtgtctgcacagcaaatgaaacaatcgagttaaaagacaacccacaaaatgggaaaaattatttgtagaccatctatgtaatgagttaatttctaaaatatataaggaatttctacaactcaatagcaaaaaaaaaaaaaaacctctaacaatctgattaaaaagtgggctaaggactttaatagacatttctctaaagaagatattaagtaggtttctaaaatcgtgatgtgtttttcatttgatgtgtgcatttaattgacgctcattactccatcaaaagcatcctgaaatcaaggaaacagtacttactagaatgtttcagtgatcgatttctgcctattaaaccaccccaaaacttaatgcattaagactaatttattattgctgtgattctgggacaaaacataactaactttttattcccctttcaaggtgtattttctgcagaacccccatctcagtaaatgccactatcatccactcccttgctcagctccttaaacttggagtcatccttgacatttttctttctctcatgcccctcatctagtttatccacaaattaccaagaaacacccacaagcctcctctcttcagcactacccccgtaatccaagccaccatcccatctcccttgggctattctggtagcctttataatcggtctcctgctttacctcttgccttattcagtctattcttcatatagaaaccagaatgatctttaaaataaatataatcagaggatgtcaacctccccaccacccggaccccacagcttatgactatccagcagctacctgttgtattcagaataagacccttataaaaccacttgctatagtctacaaaggccctgccctcctctcctcccttagctcatctctagccacactggccacactggccttccttctcccctttagcatgcatggacgtttacaccccagggcctttgcacctaatgtatgtgtgtgtgtatatatatatatatatatatatgtatatttgttgttgagaggaagtctcgctctgtcacccaggctggtgtgcagtggcgggatctcggctcactgcatgctccgccacccgggttcacaccattctcctgcctcagcctcccgagtagctgggactacgggctcctgcccccatgcccggctaatttttttgtatttttttagtagagatggggtttcaccgtgttagccaagatcgtctcgatctcctgacttcgtgatccgcccacctcggcctcccaaagtgctgggattacaggcgtgagccacccccacatccgcacctagggttcacaccgaaaaaaaatagtaggctctggagatgcaacagaccctgctttcattggagctttcagagagggaagacaagtgaacacatgaataaatgttaagaggtagtgagcattaaggagataaagtaggtatagagaatggagagagatgggaggtgtgaccccgtttcaatagggtggtgagtgaaggcctctctgaaaaggtggctttgagcaaacgcccaaataaatggaggggctgagccgtgcaggtatctggaagcaaatggggcaggggaaggagctgtttcaaaggatccaagatgggcaaatacctgcagggcttagaaatggtggctataatctgaaagcatgtagcaatagaagccttgcagctgaatacatgcatttgaggcagcaatgacttctttctagggggtttatgtgaggagggatttttctttttgggaaaaaccctgaggtacacgtattcaaaggaaatatttgttgacttggatggaaagggcctgtcttcagctttcgttctgctctgcctggctgcctctcagtgttaggttcaatgcttgaggctgtgccaagttgatttccctgtgagagcagacgcctgatagtagggcacagtgccagtcccgttgataatgaaatctttgcatccccgttgacacttctataaaggacagaagaggaactgtaagttcccattctgatcttttatttctgttttgtcaccctcaagaatacctgtcagaaagcttttgggatctggactcagatggacctgaatttgaagcccactgtgaattttactgcagtgggattttggtgagagctgctcaaacctgaacttgaggccaggcctggtggttcatgcctgtaatctcagcactttgggaggccgagacaggaggatcatttgaactcaggagttcaaggccaggctgggcaacatagggagatcctgtctgtaataaagaataaaaaattaaaaccctgaatttgagaggagcacgtggtgacagtgctcagatttgggttattcatgcccaatattgtggctctttctgtttttgttttcaaattttgttttatatttgtctttacagaacattaacattgttccaaactaataactaaataaaaaagccatcctcagagtaggtacagagtggttagttgccctggttggaggagtgggagagttctatcaccaatattgtttagaattgccagtaataataaaaatggatgacctttaattgctttttgttcatgtcataatactcgtgtatgaaattcatatatttttagaaataaccacgttgttttggaataattttagatttgcagaagttgcaaaaatagcacagataattcctatagttacccttcatccagttccccctaatgttagcatcttacatcaccatggtacatttgtcaaaagaaattaatattaatataacactattaactatagactttactcaaatttcatcagtttttccaccaatgtccttttttcctggatccaaaatttgatttagataccaaattgcatttaatagttgattgtattactgttttttaaattctctacagacaaggcacctattgactgcacctggcagaacaaagtgctgggattacagccacgagccattacacctggcctatatttcagtattttctattagtttttgatgaatttgttttgcctggctaggattattctgtagataggattttagatctggcttttgtcactgactgctgtaataaatacttgctaggaatttttttttttttttttttaagacaaagtcgctctgtcacacaggctggagtgcagtggcatgatcttggctcactgcacctccgcttcccagattcaagtagttctcgtgcctcagcctcctgagtagctgggattacaggtgtgtgccaccatgtctggctgatttttgtatttttagtagaggtggggtttcaccatgttggccaggctggtctcgaactcctgatctcaagtgatctgcctgccttggtctcccaaagtgctgggattacaggtgtgaccaccacgccctgccttaagaattgttccaagagaatctggtgccacttgcaggtgcccattgaagtgcaatgggcactgttgatcactgaggaggtagtgggtgctgacccggtgctggggcctgtcccctagtctctgctttgcccttggctagctaggtggtgtgccaagtggggagagaagctaccttattaaggggcatggatcagcttcctgaaaggagggcctgcctctgtaagatgtgggaagtcgctgagaatgttacagaacggccctagagatggggcagataacggcccccatttgtgagaagtgagttgggaggcatgtttggggcctctgatgtttgggaggctgtgggtaattaacatgagttttggggtccagcagcagaattcaggtttcctcttccactcagtaacctcaacatccgtatctgtaatgggaatgatacaaaacctatccccaagttgagggaaaaatgagattgtgtaaagcgcacttggcacatgacagtcacaagcatggggacagtgagtccagaaggattttcttatgccagcattgtaagccctaggatcacagggctctggcttgtttaaccatcgtgtctctggtccctagcctgcaaacctggcgtgtagggatgcctcagtcgcttacatgttgattgagtgaatcgtcggtttctttctggacactgacttcaaaaataaaataggatatgaaaatggctccatttgttgtcaccattttgtggggatcctatgtcctttgaagtggtcaggagtgggagaaacgtgataggggaagaaggagtggtgtggctgatggatttaacatgtgttcttttatgttggcaaggaagcggatgaccttaccccttgttcctcagatcctgtaaatggctttataacatgacccagggctgcttggtgtgggactagaccccagggtttgagggtctgaagacaatttaggttcgtgctggcaggatgtcttggctcagagacaagtatttctgtggggtgatcccagcatcctcccagcatactgctgctgttgctaggcagagaccccggagtggggagagggtgatagcatctggatcatccattcctacctaggtggttttggctcatagtaaaagggacctcagcacctatccgctgctcagcctcggagctgcaggtgtcagggatatcatgcactgtccaaaaagacatgcaaaacttaacacccgtgcattttcatggagagaccccgtggagcctctgaccagaggctgaaagaaatgtgtcattcaaaagaccagggaaccactgccaaggacccctacattcagcaacacatctatactcgtgcctgccacgtgtccgcacttagaggccattgtctcacctcagggtcaggagtgccaggtgaaagagcacacaggtctctgggcaaggcagagtttgaagctaggtctggaccaacgtctgagagtatgacttcaccccaggcgaggaagttcactttgagctcctggccagggagaaagcaagctctgggagacctaaactctgaatctcacttggcttttcagtctaatccgttgttgccaaagacatacttggcaatcccgaatcctcagagggctccatacgtgctgcgcttcagccttcgctcacggttcatcccacctggaatgcctttttctctccaaagatgttcccaagagccaagttaaatgtcacttccatttatcttcctccaaaaggaacatgtgttttacttcatctttctcctaaaaatgtggatgccttaatgagactaataatggttgttagtgcttgccaggcgtggagctaagagtgttacatatattatttaatctgagcaatcctgcatcatgggtactattaccagctccagtttttttgagacggagtccgttttgtcgcccaggctggagtgcagtggcatgagttcaagcgattcttatgctccagccttctgagtggctgggactaccagcacacatcaccacgcccggctaattttttttgtattttagtagagacagggtttcgccgtgttggccaggctggtcttgaactcccgtcctcaggtgacctgcccgcctcagcctcccaaagtcctggaattacaggcgtgagccactgcgcctggcccagctccagttgttcaggtgaaaaagatgaggcacagaattggaaagccatttgtccaagaggctaagaagtggtcacgtgagcatttaaatgtttttaagcctcagcctactcctctccaggcccttagcgtgtttcgtcctgcgttttcctggtctttcccagtgtttattagatgtctatagtgtccagacaatgttaggcagacgggacacaagggtgcacaaacaaacagtctgtgcccttattggaacctgttaatccctaaagggctaagcctccctacagcaagaaccctgttagtcacctgtgtatccccagcatctcgactctccacgggcatggcactatgctgtaaaaaaaataatccctgaccctcatggctatgggaaagcatgccttttaaagcataatccggctgggtgtggtggctcacgcctgtaaccccagcactttgggaggccgaggcaggtggatcacctgaggtcaggagtttgagactagcctggccaacatggtgaaaccccgtctttactaaaaatacaaaaatttgctgggcgtggtggcaggtgcctgtaatcccagctactcaggaggctgaggcaagagaaccgcttgaagcctggaggcagaggttgcagtgagctgagattgcgccattgcactccagcctgggtgacgagtgaaactccgtctaaaaaaaaaaaaaaaaaaaggataatccaatctaggtgcctctgcctcagtgttgcattcacagaattccgtggacccaaaaatcagtcttggaataggctgggatatggacaggacacccaggttctgcccctacacctatcccccacctggcttttttttttcttttccttgagacagtctggccctgtgagctgaggttgcaccactgcactccagcctgggcagcagagcaagactccatctctcaaaaaaacaaaaaacaaaaaaacaaaatggggttaagagaatgggctttggaatctagtggcttcactggttgcttgctgtgtgatctcgggccacttgctgtgcctctgtgcgtcagtttccttgtctttagtagagagatgatagtaacatttcctgtagtggttgtgaagattatacataatgtttgtaacctgctggagtggtcattagagctgttcaccaaatattcagattctccccggttggcacatggtgggagtgccttgtccatgtgactaactggccagtcagctgggagcagaagtgcctccttcaggcgggggcctttagtggctggcaggagacctctatggctcctctttcttttttttttttttaattaattttttttattatactttaagttttagggtacatgtgcacaacgtgcaggttcgttacatatgtatacatgtgccatgttggtgtgctgcacccagtaactcgtcatttacattaggtatatctccaaatgctatccctcccccctccccccaccccacaacattccccagagtgtgatgttccccttcctgtgtccatgtgttctcattgttcagttcccacctacaagtgagaacatgcggtgtttggttttttgtctttgcgatagtttactgagaatgatggtttccagcttcatccatgtccctacaaaggacatgaactcatccttttttatggctgcatagaattccatggtgtatatatgccacattttcttaatccagtctatcattgatggacatttggcttggttccaagtctttgctattgtgagtggtgccacaataaacatatgtgtgtatgtgtatttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgtttctatttctccacatcctctccagcacctgttgtttcctgactttttaatgatggccattctaactggtgtgagatggtatctcattgtggttttgatttgcatttctctgatggccagtgatgatgagcatttttttcgtgtatcttttggctgcataaatgtcttcttttgagaagtgtctgttcatatcctttgcccacttttcgatggggttgtttgtttttttcttgtaaatttgtttgagttcattgtagattctggatattagccctttgtcagatgagtagattgcaaaaattttctcccattctgtaggttgcctcaatgaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcattaccaagtcaatcctaagccaaaagaacaaagctggaggcatcatgctgcctgacttcaaactgtactacaaggctacagtcaccaaaacagcatggtactgggaccaaaacagagatacagaccaatggaacagaacagagccctcagaaataatgccgcatatctacaaccatctgatctttgacaaacctgatgaaaacaagaaatggggaaaggattccctatttaatacatggtgctgggaaaactggttagccatgtgtagaaagctgaaactggatcccttctttacaccttacacaaaaattaattcaagatggattaaagacttaaatgttagacctgaaaccataaaaaccctagaagaaaacctaggcattaccattcaggacatagggatgggcaaggatttcatgtctaaaacaccaaaagcaatggcaacaaaagccaaaattgacaaatgggatctaattaaactaaagagcttctgcacagcaaaagaaactaccatcagagtggatatggctcctctttctttctgccatggtgatgggcgattatgcccaggagcggctgcttcatttgcctggcacaggagtgagggtgacaatgcagagatccagccacccagcaatgggtgtgtagcagcaagaaatgacccttttgtgaattaagcaactgcaatttggcgtttttataacctaacgtatcttgactgatacaaatgcttagagcaacctctgatatttagtaagggcttattcagtggcagaatagaaaagaatgggatctagagtaataaaagggattagccttctctttgtcagttagggatgtcaagagattatctgtagcaccctctgctgtcaacatgcctgtcttccatgaccagcctgtacccccctccctccacatgtttttgtttttcccagacagggtctcactctgtcacccaggctggagtgcaaatcgacctcctgggttcaagcgatcctcctgcctcactctccctagtagccgggactacaggcatgtaccaccatgcctaattttttattttttgtggagatgggacctcactattttgcctaggctggtctcaaactcctgggctcaagcaattctcctgcctctaccttccaaagtgctgggattataggtgtgagccattgtgcccagccacatggttcttcaatactcacccccaccccaaaccctctgacacatgcgtttagtcctggggtggggcacctgactcaacccaggttgaagatactttaggatattttgaacctgggagatgtgagggttgtctctttaaaatggtggaaattatgagatatttgggaacggcactactgatcctcctaatttatttttaattttttttttaggccgaggcgggtggatcacctgaggtcaagagttcgagactagcctggccaatatggtgaaaccttgtctgtactaaaactacaaaaattagcagggtggggtggcaggcgcctgtaatccgagctactcaggagactgggactacaggtgctcaccaccgcgcttggctaatttttgtatttttacaaagctttaaataaaaattgcttaaagctgaaaattgggtgggcgcagtggctcacgcctataatcctaccactttgggaggctgaggtggacagatcacttgagcccaggagttcgagatcagcttgggcaacgtgatgaaatacgatctctacaaaaaatacaaaaattagccaagcatagaggtacacacctgtagtcccagatactccactgaggtgggaggatcacctgagccgggggaggttgagggtgcagtgaggtgcgatcgcgccaatgcactccagcctgggtgacagagtgagatactgtctcaaaaaacataaaaataaaaaataaaagctgaaaaatttatatttaatattttgaaaacttaaatcttattgcatattattattaaataactttccagttctagtgttcaatgtcagtctaattgctcatctaaaggactgatattgcaacatacattttgtgtctcgatcttatatacaaattagagagtgatacaaattgtttaaatggctaaatgttcctcagctacagtgagtagccatattggtctcttttaaaaatttttattatttttatttaaacaaagttttaatttttttttgtagagacagggtctcattatgttgcccaggctggtcagccacaagtgatccttctgcctcagtctcccaaagttctgggattataggcatgaactaacacgcctgacccagattactctctaactcatgagtatgtctggaggcgcaatttggaacatgaagagaaacagaaaaatggactctcagtacttctgagaaatgatacttgttatacaagaatctactgcattcagcctccctgagaagaggaatttaagaattaatttctgcttcctcttacttaagtgtttcaacactcaagtcctttgcatactctgaagcaatgtgtgtctccaacattgggagcagctgcaacccacaaaccttcttgacataaaatagttgcattcattcattcatttatttgctctgccgcacaggctggaatggcagtggtacgatcttagcttaccgcaacctccacctccctggttcaagccattctcctgcctcagcttcccgagtagctgggattacaggtgcgcaccaccatgcccggctaatttttgtattttttagtagagacggggtttcaccatgttggccaggctggtctcaaactcctgacctcaactgatctgcctgcctcggcctcccaaagtgctgggattacaggcgtgagccaccacacctggccatagttgccttttgttttgagattttaggacaagagatgaatatgtttttttttttttttttttgagtcagagctttgctcttgttgcccaggctgcagtgcaatggcatgatctcgactcactgcaacctctgcttcccgggttcaagcaattcttctgcctcagcctcccgagtagctgggattacaggcatgcgccaccatgcccggttaattttgtatttttagtaaagatagggtttctccatgttggtcaggctggtctcgaactcccaacctcaggtgatctccctgcctcagcctccgaaagtgctgggataacaggcatgagccaccacgccgggcagaaatgagacatactttggggcctgaacagtgtttgttatgaaatggatgtttagggctgcagattgtgctgagccagtactgaacataagatcctgagtggacaggaacacctttgtggtcattagtgaatctgtttttaagagctgggagtggtggctaacacctgtaatcccagcattgtgggaggctagggtgggatgatcacttgaggccggagtttgagagcagcctgggtaacaaaacaagactctgtctctacaaaaaaggaaaaaattagctgggtgtggtggcatgagtctatagtcccagctactcaggaggctgaggtgggaggatcgcttgagcctaggaggtcaaggctgtagtgagttatgtttgtgccactgcactccagcctatttgagacagataatgtgtctcaaaaaaaaaaaaaagaaaaaaaaagaaaaaaaactcttggccgggtgcggtggctcacgactgtaatcccagcgctttgggaggccgaggcagctggatcacctgaggtcaggagtttgagaccagcctggccaacattggtgaaaccccttctctattaaaaatacaaaaatttgctgggcctggtggcacgcgcctgtaatcccagctactctggaggctgtgggaggagaatcacttgaagccgggaggcagaggttgcagtgagccgagatggcgccactgtacacactccagcctgagcaataagagcaaaactccatctcaaaaaaaaaaaaaaaaaaaagaaaagaaaagaataaaagaaaaatccattgaaaaaatcatacatttgtgagatggagagccaatcttgctaggaactgagggggttactggctgcaagggagatggggaaaacaagtcctggcctccacctaggggatctatagactcacagtgcaggaatttccccggagacagaggagcgctttaaaggtactgtgcggcccaaaatggtggagtagggaattccagggctccatccctcccccaacacaactaataaggtggcaaaaactgtcagaatcaacttctgaagtactctgggatctagctttttgttagctttcatttttttgagatggggtctcactctgtcccccagactggagtgccactgtgcaatctcagcccactgcagccttgacctcccgcctcagcctcagagtaggtgggatcacgggcgcaagccaccatgccaggctaatttttgtattttttgtagagacagggttttacaatgttgcccaggctggtattgaactcctgagttcaagcaattcaccagcctcagcctcccaaagtgctgggattacaggcttgagccaccgcacccagccttctagtttttaaaaagggaaacaaacaaacttataactagcacgggaaaatttggagaaagaaagctctgaggctgggcgcggtggctcacgcctgtaatcccagcactttgggaggcaaaggcgggtggatcccctgaggttaggagttcgagaccagcctggccaacatggtgaaaccccggctctactaaaaatgcaaaaattagctgggcatggtggcacatgtgcctgtaatcccagctactcgggaggctgaagcaggagaatcccttgatcccaggaggaggaggttgcagtgagccgagatagtgccactgccctccagcctgggtgaaagcaaaagtccgtctcgaaaaaaaggaaagaaagaaagctctcctgtgataagagagtgtgattgatggcgtttttgcttgctcatgtaacatccccccaaactccagatcagcagggaccatgaggatgtcagcctgcacttctggggctggttgctagcgtagggggagtacacagaatttactctcaaagaattgtggttgtaggctgggtgtggtgtctcacacctgtaatcccagcattttgggaggccaaggcaggtgaatcacgaggtcaggagtttgagaccagcctggccaacatggtgaaaccccatctctactaaaaatacaaaaaattagctgggcatggtggtgggcacctgtaatcacagctactcaggaggctgaagcaggagaatcacttgaacctgggaggcagaggttgcagtgagccaagatcgtgccactgaactccagcctgggtgacagggcaactccgtcttaaaaaaaaaaataaataaatttggggttataggtctgacgacttccccaaggactagcagaaaggtttctgagctttttaaccagggcattttcagggctggcatggcttcccaggtggctttagacaaaagcattgaaagacataggtattggcctcaataccctggggcaggggacaacacttgggacaagcaatagacagaccgagcagcctgggaaggaaaagtttggaaaaagagatgtgtgtctgtagaggcttttaaaagtgtctacataaaccaggaaatcaagaaagctgtgtgcaggcccatagtcagttgcaagctcagaaaaggcctaagaaactttgtgaggccaaggcggttggatcacctgaggtcaggagtttgagaccagcctggccaacatggtgaaatcttgcctttactaaaaatacaaaaattagccaggcatagtggcacacacctgtaatcccagctacccgggaggctgaggcagaaaatcactttacctgggaggtggaggttacagtgagctgagattgtgccactgcactccagcctgggtgacagagtgagattctgtctcaaaacaaaacaaaacaaaaacaagcaaaagaaaaggcctaagaagaccctgggctttcatctctttctggccttcagtctctgtgcaagcaggaagtgaaggctaaggcagagtataaatggcttggttaagggttgagagagtgccccaaacagatccaatttgcaaagactaggatagtgtttttcttttcttccttcctccctccctccctcccttctttcctttcttccttccttccctccttccttcctttctctcctttctgcctgcctgctttctttctctctctctttctctgtctttctctttatttctcctgttttcttgtttctttccttttattcttctttatttgttggcttcagccattttaggtagctctcaaaataccagctgactgacaagcaaaaagaacagaaacaaacaaaaagaacagaacagaaaaaaaaaaaaaaaaaccagaaacagaaacacaaagaatacagactttacaataatagtttggaaaatttaccaaacaagcaaaccacagcaacccacgatatacagcaacaatagaccctggggagggaggagaatctgattttcagtgttgccataaattgaaaatgtcaacaaaaaccctcatggcatggaaagaaataataaagttccactcatttgtggcaagaaagaaatgactagatactgtctttgtggcaacccaggtattggtcttactggcaatgactttttttttgagacagagtcccactctgtcgcccaggctggagtgcaatggcacgatcttggctcactacaacctctgcctcttggattgaagcgattctcctgccttaccctcctgagtagctgggattacaggtgtgcgccaccacgcccagctaatttttgcattttcagtagagacggggtttcatcatgttggtgaggctggtctcaaactcctgacctcgtgatccacccacctcagcctcccaaagtgctggattagaggcgtgagccactgtgcccagcccagcaatgacttttaaaaaaaattatttatttaatttttttttagagacagggtctccctctgtcactcaagctggagtgcagtgatgtaatcagagctcactgcaatctctatctcctgggctcagtgagtctcctgcttcagcctcctgagtaggctggaactacaagtgtgcaccacaatgccaggctagacaattactttttttttttttttttttgagatggagtcacactctgtcacccaggctggagtgcagtggcataatctcggctcactgcaacctctgtctcccaggttcaggtgattctcgtgcctcagtctcccaagtaactgggattacagatgcccgccaccacgcccagctaatttttgtatttttagtggagacaggttttcaccatgttggccaggctggtcttgaacttctgacctcaagtgatctgcctgcctcagcctcccaaagtgctgggattacaggcatgagccaccatgcccagccgacaatgagtgtaaattgactgtcttaaatatactcaaagagatgaaggaaaccatggacaaagtcctaaagagagagcactttgcagaagttgtggcgccttgagagccagcagggcagtgggccagtgagatgttgagttattactattattaattcaaatcacatgaatagcaaaccctcagagaacaagaagtctttgttgtatcacaagggctccatcagcagaggtggagtcctgaactcggcacagtgtctggcatatactaggtcttcaagaaagttttagagtaaacaaatgcatccacaatgcttttatgttgggtaaggtctttctagcagtcaaaattttctttctttctttctttttttttttttttcctccttgtgatggggtttgcgggaatgggaacaatggcatagaggaagaggaaaccaaaattatcttgagttagcagatgtctttctcctgtctcctttcttcactaagaagaacagtctttgctgggcatggtggctcccacctgtaatcccagcactttgggaggccaaggcgagtggatcacctgaggtcaggagttcgagaccagcctggccaacatggtgaaaccctgtctctactaaaaatacaaaaattaggtggggtgctgtgtggctcactcctgtaatcccagccttttgggaggctgaggctggtggatcacctgaggtcagaagttcaagactagcctggtcaacatggggaaaccccgtctgtactaaaaatacaaaaaaaaaaaaaaaatagctgggcatggtggtgcatgcctgtattcccagctacttgggaggctgaggcaggagaatcgcttgaacctgggaggcagaggttgcagtgagctgagatcatgctattgtactctggcctgggggacagagtgagactctgtctcaagaaaaaaaaaaataaaaaaataaaaataaaaaacctaaagaaacaaaaaaaaaaacaaaaattagccaggtgtggtggtgcacacctataatcccagctactcgagaggctgaggcaggagaatcgcttcagcccagggatgcagaggctgcagcgagccgagatggcaccactgcactccagcctgggcgacagaacgagactttgtcttttttttgtttgtttaaaaaaaaaaaaaagaaagaagaacggtattgtctttgggtaagcacaggcacagagttaaaaaaaaaaaaaaaagagtcgtgtctttgggactgagtggatgggcatgtgttctgagttagtgtgcccaggtgtggtgaaagacacggagaaaccactgcttgatgcgttctcttttgttgttcaagttgtgggctgctgtggggtggggttacatgtctgcatccccttcgaaaagcacacaatatggcaagtggaagctggagagagctcctaggagtgcctcgtgccaggtgaagaggttgcattgcgggtggtgggtaggtgcctagggagaggaggtccacgcctgttgtccttccagcacgatggctccaaaagcagagcgaagaggtgatgttcccacttcccaaggcatccaagggacggggcttgaagaatgcagcctagcaaccatgtgcgtaagactgtggggaaggagggcttgaggatgagcctgagagtcaactggactgtggggaaatagtgtagccttctttcctttgagcttcagttatctcgcctgtggtgatgatgacgatgatgataaagatgataccatacttctatggcacatactatgttccagatattgttcatataactcatctaattttcatagcagttttacaagatgagtactatttgtttttgtttttttgttttttttttttgagatggagtctcgctctgttgccaggctagagtgcagtggcgcaatctgggttcactgcaacctctgcctcctgggttcaagcaattctcctgcctcagcctcctgagtagctgggactacaggcacataccagctaatttttgtattttcagtagcgacagggtttcaccatgttagccaagatggtcttgatctcttgacctcgtgatccacccgcctcagcctcccaaagtgctgggattataggcgtcagccacagctcccagccaagatgggtactatttttatacctattttatagaagaggaaactgaggcatagagaagtcaagtcacttgatcatacagctagtgtgtggaggaggcagattcaaaccctggcttcggtcttagtcactgcattggcttcatgggcttatcatgaggattaaacgcgtgaacatgctcagtgtttagttcagtgtctggcacaggatcaatgttcagaaaatcctaacagctgctgtcagtatcagaacccaaacaaacaggtgggactttcgccaactctctaacatcacatgtgcttgtataatcagccactgtttttttcatgaaaaaaaatttttttgagacaggttctcgctttgtcacccaggcaggaaggcagtggtgagaacacagctcactgtagcctccacctcctgggctcaagcgatcctcccacctcagcctcttgtgtagctggaaccacagcatgtgccaccacgcccagctattttttaatatatttttttattttttgtagagatgaggtctcaccatcttgcccaagctgttctcaaactcctggactcaagcagtcctcctgcctcagcctcccaaaaggctgagaatacaggcatgagccactgcgcctggctaatcagtcacttgttgttgttgttttttgtttttttgagatggagtcttgctctgtcacccaagttggaatgcaatggcgcgatctcggctcactgcaagctctgcctcctgggttcaaatgattctcctgcctcagcctcccaagtagctgggactacaggtgcacgccaccacacccagctaatttttgtatttttagtagagacggggtttcaccatgttggccaagatggtctcgatctcttgacctcatgatccgcctgcctcagcctcccaaagtgctgggattacaggtgtgagccttaatcccaaagtgctgggattacgtgcctggccttaatcaatcacttttaaaggagagtggggaacatcatgttttgcaactattttttgaactcttggatatttacttggaacaaataaaaacacttttgtaccatgtgaaaggtaaaatttgctcaagccgtccctcatcctgccctggcctgcttccacatgcggctgggtgagctgaccccattctctgtttatttattgtttttgttattgtattttattttacttttttgagacagagtttcactcttgtcacccaggctggagtccaatggcatgatcgtggctccctgcaacctccgcctcccagattcaagcgattctcttgtgtcattctcctgagtagctgggattacaggtgcctgccaccacgcccagctaatttttgtatttttagtagagatggggtttccccatgttggccaggctggttttgaactcctgacctcaggtgatctgcccgcctcggcctcccaatgtgctgggattagaggtgtgagccaccgcgcccggcccattctcagcttcttgatggcttccccctactgggacattgatcacttattcatgacattgactggtcatgagccactcctccgccagcccttggaggatccaagtgattcacaaatggacacaaggaatatgattagtcctctgtgagtgattctgaggggccgtggtatagagagagagaggggaaggaggatgggaaaatgccggcagttccctccccaacccattctgacagtttgctggttagagaaaaatccccatgtcagagaatttttttctttgtttatttcctgtgaaatagaatgtgggtctggcattggggaggactctagtaattcatattttctgcttatttggctcctggctgaacaggaatttacattacttaatgtctgggtttttcctggggaatcaaaataagttttctattcaattattaagcaaatttcacagccaaataatcctcttatttttacaagtggtattttccctggcagagggttttctggcttctctgggtacttgatccgtctcctctcttctgtttcctctgtctttgtctggctatgaaggaagctaaagcccctcattcatggattaggggcttctcaatggcagttggcagactttggctttgcaagctagagatgaatcttttttttctttcttttttttttttttcgagacggagtcttgctctgttgcgcaggctggtgtgcagtggtgcgatctccactcactacaacctctgccttccaggttcaagctattctcctatctcagccttccaagaagctgggactacaggcatgcaccaccacacctaatttaaaaaatactttagtaaatggctaatttaaaaaatatttttagtaaatgggaggttttaccatgtcggccaggctggtctcgaactcgtgacctcaggtgatctgcctgccttgtcctcccaaagtgctgggattacaggtgtgagccactgcgcctggcctagagataaatcttaatgtccgccagccatggggtaagagtccactccctctttctgctcttcagtctattgactttgggcacaggcacagctgcagctctagtaggggttgggcctggagtcagtggagacaaaatgtgaaggtaacaggacagtgcacggggcccagtgtgctctgcctgggctgctcagggaagaaaaatcacacacacacacacaaataacaaccctttttttggcagaagtatagtgaaagatctctacgtcttggccagcatttgttatctttttgcttctttgaaaatagccatcctgggccagatgcagtggctcacgcctgtaatcccagcactttgggaggctgaggcgggtggatcacctgaggttaggagtatgagagcagcctggtgaacatgatgaaacctcttctctactaaaaatacaaaaattagctgggcgtggtggcacgcgcccataatcccagctactcgggaggctgaggaacaagaatagcttgaaccctggaggtagaggttgcagtgagctgagattgtgccattgcactccagtctgggtgacagagtgagactctgtctcaaaaaataaataaataaataaattaaaaataaataaataaataaaggaaacggagtcagtgtgttgaagagatatctgcactcccatgttcactgcaatattattcacaatagacaaggtatagaatcaacctaagtgtccatcagtggatgagtagataaagaaaatgtgatacacatacaccaatgtggtatatatactcttcagccttaacccatctccataaaattaaggaaacaaagaaggaagtcctgttattggtgacaacgtggatgaacctggaagacattatgttaagtgaaataaatcaggcacagaaagacaaataccacatgatctcacttatatgtggaatctaaaaaagttgaactcactgaagtagagagtagaatggtggttaccagaagcaaggtgagggtgtctgtgagagggttggggagacattggtcaaaagataaaaaatttcaattagccaggaggaaaaagttcaagaggtctattgtgactagttaataaaagtgttctaaccacaaaaatgatccatatacaaggtaacatatatgttaattagctttatttagccattccacactgcgtatatcaaaaaatcatgtacaccataaatataattattattattttttgagacagagtttcactcttgttgcccaggctggagtgcaatggcacgatctcagcccactgcaacctccgcctcctgggttcaagcgattctcctgcttcagcctccctagtagctgggattacaggcatgcaccaccatgcccagctaattttgtatttttagtagagatggggtttatccatgctggtcaggctggtctcgaactcctgacctcaggtgatccgcccacctcggcctcccaaagtgctgggattataggcgtgagccactgtgcccggctcataatttttatttataacaaaaagtaaagtgaacctcctgtagacagagtacagttggatcttgttttttcaacctattcacctactctatgtcttctaattggggaatttaattcatttatacttaaagtaattattgatagataatttacttagtagaagtataactttgagcctgttatttaccttttctaaatgagttttcatttctgtgaaatgggcacaattaaagaggccgcctcctgggactggggtcaggattagttgagatagtctgtgtaaggctaggatggtgcttgacagccagtgttaattattattttttgatcctgtgggatagggcaacccagatactccggtgggaaacacttgcaaccagagaaccttgactcaaaatcttggtcctacttggtttgaaggatcccattgcatttgcattgctgccccttctgagaggttattcacactgataaaccccattttgcaacttacacgtgcaggattcagctaattggacagcagtggacactgaacctaaggtgaaaaatccaacaaatagagaggaccaactgaaaaattcagttgctttcttttgaagaatctgaatacgagacacagagaaaggattagtagtcagtattgagggcagaaacagaaacacagagaaggaaagttataagaggaagctttgagtcagcagaagctatgggtgaataggagccatgaattgacaggaattatgagtcagcagaaacttgagtcgtggcaagagccacaagtcagcagaaactatgagatagagagtagcatggagatagcagaggaataggccaagacccggagatgctgcgtcaccatcttggtggagcctagagggcagagctaggatggtcccctgaattacagagctgctgtcagtgatgagtgtaacctgaagatgttccagcctctggcagccctgactgggtggtgagactttggccttccagctttcataaagtaaactgagaatatttctgtttctggccaacttacaagaatctgactgacacactacccatatcaaactcctctgagactcagttttcttgcctgtgaaatggggacagctaaatatacaagttgaatgggttgagaaaacaagatccaattatattctgtctacaagagactcattttactttttaattacaaataaaaattatatgtatatatgatattttgatatatgtatacagcatggaatggctaaatcaagctaattaacatatatgttaccttgtatacttgctttgggctgcttagcatcccttttttggggataccagcctttatttgacatctgccagtaacaggattctacctctaaggtggccacataatccaggccgggcccgtcagagcctcattgtagaaatttgccttcaggtcaggaggtggaaaccctgagagagttcctgggttctgggatattctaagctgtccaggctcctgtgttttctttgtttttagagacggagtctagctctgtcacccaggctggagtgcaggggcacaatctcggttcactgcaacctccgcatcctgggttcaagtgattctcctgcctcagcctcctgagtagctgggattacaggcatgcgccactatgcccagctcatttttgtatttttaatagagatggggttttgccatttttggctaggctggtctcaaactcctgacctcaggtgatctgaccgccttggcctccgaaagtgctaggattacaagcgtgagccaccatgcctggccggctcctgtgttttctaaggccagtttattcaactctgttttctttctgagagtttccgaatggagtcatcccttggtatccatgggggattagttccaggactttccatggataccaaaccccacagaagctcaagtccctgatataaaatgatgtagtctttgcatttaactatgcacatcctgctgtatactttatttttatttattattattatttttgagatggagtctccctctgtcacccagactggagtgcagtagcgcaatcttggctcactgcaacctccgcctcagctaggttcaagcgattctcatgcctcagcctcttgagtagctggaactacaggtgtgtgccaccacgcccggctactttttgtatttttagtagagatggggtttcaccatgttggtcaggctggtcttgaactcctgacctcaagtgttctgcccatcgcgacctcccaaagtgctgggattacaggcatgagccaccatgcctggccctcctgtatacattagattatctctagattactcataaaaatgaatacaatgtaaatgccgtgtaagtagttgctatactgcattgtttagggaatcatgacaagaaaaggagtctgtatgtgtttagtacagatggtttttgttgtcgattaaaaatatatatatattttatagagacggggccttgctatgttgctcaggctggtcttgatcttctggcctcaagtgatcctcctgcctcagcctgccaaagtgctgggattacaggcatgagccactgtgcccagccttcctgaatatttttttaattctcggttggttgaatccatagatgcggaactcacagaggcagagggccaactgtagccttcctacagatatttttatcttgttaaagtaataaccctaacctgacccacacctcacaggtctgttgtgaagtgacataagccagcacataagtggaaaagcttggtgaatgatttaaaggaatcttctggcctggtgcgggggctcacgcctgtaatcccagcactttgggaggccggagtgggtggatcacctgaggtcaggagtttcagaccagcctggtcaacgtggtgaaaccccgtctctactaaaaaaaatacaaaaatcagcccggcatggtgacgggtgcctgtaatcccagctactcgggaggctgaggcaggagaatcgcttgaacccaggaggcggaggttgcagtgagccaagatcgtgccactgcactctagcctgggggacaagagtgaaactccgtctcaaaaaataaaaaaaggaatcttctggcctctgtttcagttgaacaaagtgaggtctagagaggggagaagtgagcagttccaggtcgcatgggcggtcaggggtgaaaggggagtggggacgtgaactccaggcgggtgctctttcgcgcctcctggtcgctccctccccttccctccccttccctccccttccctcctcttccctcccccgctctccctgatgtgcctgccttccctacctaacagctctgagttctgcctacctgaattagcccaatgttttcaccctttgaaagaagattctaagccgaaaccagcccccagttccccgtgggctttgcccactccttgccaagcactctgagtgctaccctttctctttctgaatagggtgagatacttgacgctgccctgaatcgaagtcaaacgggggctcctctctgcagtaccacagagctccctgtaggtggcagggtaggactgcaaatgtcctggaatattggtccctgagcgcaagcccagactggagctggggtacagcatttacttgccgtggggaagaggaggacgccggagggaggaggaaggaaagtagaagtgttgccagtcttgaggcaaaagagagttgatttgagggccgaaggacaggaatagttggtgtacctcatccgtctatctctccatccacctacccacctatatacccaactaccctccatccatccacctactctccattcacccacccactcacccatccacccatccacccacccacccatccatctacccatccatccatccatccatccatccacgcattcatccaaacacccatctatccatccacccacccatccgtccatgggttcattcatccatccatctaccaatccactcatccatccaataaatatttttgagcacctgtgctaaatgcatatacacacacacatatctatgcacacacatacatacacactgatatatatcacacacatgcatacacacacacggagaataaccggtactgccttttgttgagtgtcaaggttgcttttatctctccagctggagatttctgcacctgtctgtagcatccattactagcatcccattcccaatattattattcactcctttacttccgaatataaagcagatgtcatctggggccctttttgccccttctgatttcaataaaattttccccaacgtcctgtcttcctcctcctcctctatcccattcctgaggcatctcaagtcttcccttggatttctgtcaactcctgacttttctgcctctagagctttggctcctagtaggatatttctgacctgcagcatatcatattctttgtttttaaaatttattattgttggccaggtgcagtggctcatgcctgtaatcccatcactttgggagaccgaggcaggtggatcacctgaggtcaggagtttgagattaacctggccaacatggtgaaatcccgtttctactaaaaatacaaaaattagctggatgtggtggcatgctcctgtaatcccagctactcgggaggctgaggcaggagaattgcttgaacccggagggagaggtttcagtgagtcgagatctcgccactactccagcgtggacgacagagcaagactccatctcaaaaaaaacaaaaacaaaaccaaacaagcaaacaaaaaaaaaaaaacaagaaaaggcagctcagagaggtcaagtgtctagcttgaggccatacagctaactgggtcagaactgagatttgaacccatgtatgtctgacctggtgctgggctcttttctgtagaggattcatccagccccacatacctggtctagaagaagggaagtggtgggagaggagcaccccagagagaggagcccgaatcatggggctgcaagctggtcctgggtcccatggagccatggggtgaggaagtggcaggggctaccaccaaactcagatgcgggcccaaggctggttgggggagaggaccctggctgtgggtgcccatctgccagcttgtatgaaggagtaggcggggtaggtgggagaagggaagtggtgcttcggtgggaccacaggaaacgctagattttggttagtagttggaaagtaccagcaatttctctttcaacagaaaaccagaaggaggtcaggtttttcttattaaaacagagacaaatgcagactttgcaaaggaagcagggatttgcagagtgaggctggaagtcaccgaagctgagtgatattccccagagaaaggttttacattcatgtggagtgggtcagaggaccttgagttgagctgatgagcagccacaggatggcaccaggttttcacgatatggagagaaggggacctggtggtggtttggccaccgtgtcctgtttcctgaagaacagagggtgtacgtgacagctggggcctcatagccagttactgccagcaggactccatctcaattcagatcttacttcatgggactacacagaaagaaggaaagccaggccgggcatggtggctcatgcctgtaatcccagcactttgggaggctggggtgggcagatcaatagaggccaggagttcgagaccaacctgaccagccttcaccaatggtgaagcccatctctactaaaagtacaaaaattagctgggcgtggtgacgggcgcttgtaatcccagctacttgggaggctgaggcaggagaatggcttgaacccgggaggcagaggttgcagtgaggcgagattgcaccactgcactccagcctgggtgacagagcgagactcggtctcaaaaaaagaaaaaaaaaaaaaaaagctgggcttcgtgaagggctcacacctgtaatcccagcactttgggaggatcactttgggtggattgcttgagcccaggagtttgagaccagcctgagcaacatagcgagactccatccttacaaaagataagaaaacaaaagacagaaggagtggtttggagctatgcaagtgtccctcttggctctggcaatttctgggtggataaccttgggtagcacccttctctttgaatctaagtttccttatctaaactggcgatgataagacctcccttgctatgttgttataaaattacttgtgtgcctagcccagagtaggtgtgcaatgaatgagtaaatggatgaatggctaaattccacacatatttatggagtgctaagtctgtgtcaggcattaccttggggacacagctggaagtgaacaagccccagtcttcggtttttaggagcccacattctggcagaagagacaggaagtagctgggcagggtggctcatgcctataatcccagcacttcgggaggctgaggtgggctgatcacctgaggtcaagagtttgagaacagcctggccaacatggtgaaaccccatctctactaaaaatacaaaaattagccaggcatggtggcatgcacctgtaatcctagctactcggggggctgaggcagggaaatcgcttgaacccgagaggtggaggttgcagtgagccgagatcgagccaccacactccagcttgggtgacagactgaaactccatctcaaaaaaaaaaaaaaagagagccaggaagtaagtgagacagataagatcaacacagagcatgctaaacagaaaagtaggaaagacatactattcagtgttggggtgggtggggagattaatatttcagaaagggtagcctgggaagggctcattgagaagctgactgttgaataaagattggcaggaattacgcaaccagccgtgtagatctctgggagaggagaattccggggagaagggacagtcagtgcaaaggcccttaggccagagcatgcttggggttcaagaaacagagtgagtgccagtgtgcctgaagcccagtacagaagggagaaggttgtcggagatgaaggcaaagaggtaatgacgggtgggttagagtttgcagggcctttggaagctgtgagaaggattttggctttttttctgggtcagaggggagccagtgcaggagtttgagcagaggagtggcatattacggttctccagagaaagggaaccaacaggatatacacatgtctacattaatcaattaattattttgagggggttctccagagaaagggaaccaacaggatatacacatgtctacattaatcaattaattaattttgagattgagtttcgctctttcacccaggctggagtgcagtggcacgatctcggcctactgcaacctccatctcctgggttcaagtgattctcatgcttcagcatcccaagtagctgggattacaggtgcccgccaccacacctggctagtttttgtacttgagacagggtttcaccatgttggccagcctggtctcgaactcctgacctcaggtgttccacccgcctcattcttcccaagtgctgggattacaggcatgagccaccatgcccggcctatattaatttctttacagagatttattataatgaattggctcgcatgattatggaggccgagaagtcccaagatcggcagctggcaaacaggagacccaggagaactgatgatttagctccagtgtgaggcccaaagaccctgtgagttcccaggagagccaatgacataagttctggtcctaacgcgagcagacttgagatgcaggaaaagccaatgtttcagttcaagtctcagggtggaaaagcacagtgtcccagcccaagcaggcaggcagcaggagttctcttgtactgtgcctttttgttctatatgggccttcaacggattggatggggcccacccacattagggagggcgacttgctctattcagtctgcagttcaaatgtgaatctcacccaggaacacccttacagacacacactcacaataatgtttgaacaaaaatatctgggggccaggcatggtggctcacacctgtagtcccagcactctggaaagccaaaatgcgtggatcacttgaggccaggagtttgagaccagcctgagcaacatgacaaaaccctgtatctataaaaaaaaatacaaaaattagctggtatgatggcaccacatgtggtaccagctactcaggaggctaaggtggaaggatcgtctgagttcagggaggttgaggctgcagtgagccatgactgactgtgccaccgcactccagcctgagcgacagagcaagaccttgtctcaaaaaaaaaaaaaaaaaaaaaaaatctgggcagcccgtggcccagtcaaactgacacatcaaattgaccatcccaagtggcttcactggatgtagctttctacaggctctctctggctgtggtgttgagaatagtatgaaggtaggggtagggttggggagtcagaagcaggaaggtgaatttggtggctaccatatagtcatccaggtaagtgtggtggtggcttggactaaagtggtagtaagaggtgtgacgaggttattagattctggatgtattttgaaaggagtgcagatggggtgagagagagaagaagagaaataatgggtgacctgtggtttttggcttcagcaccttaaagaatgaggttgccactgattgagaagggagtatcaggagtatggcggacacgttgagtgtgagaaatgtaagctttggaggagatgtggggtcagcaggtagatgtccatgcctggagtccagcagagcagcctgggccagacagctggatttgggagctgtcattagcacctgcctggctgtcttcattattgcatcaagagtggctcttggttgcaagtaacagaaaacctggctgcaggccagacatggtggctcacgcctgtaatcccagcactttgggaggccgaggtgggtggatcacctgaggtcaggagtttgagaccagcccggccaacacggtgaaaccctgtctctactaaaactacaaaaattaaccgggtgtggtggcatgtgcctgtaatctcagctactcaggaggctgaggcaggagaatcgcttgaacctgggaggcagagtttgggtaagctgagattgcaccattgtactccagcctgggtgacacagcaaaactccatctcagaaaaagaaaacttagttgccttgagcaaaaacagaaattattggaaaactctaggggtccacaaacccaccaggaagctggggatccaggctggggaaatgagtgggggccaaggaggctgtgaagatctgagcagcggcagccacagaaaaggccccggcaggagcaatccggtcctaaaacccccatggctaccatgtggataggccctcctgcggccccttgctgggatcaccgctcatgatgcagagtctgaggagagcagctcattggttcaaccaagccacatgaccttcaggctggggtgcagggagggaggcctggccacttagggtttccattttcttttttctgagacagagtctcgctctgtcacgcaggctggagtgcagtggtgtgatctcagctcactgcaacctccgcctcccggattcaagtgattctcctgcctcagcctccccagtagctatgattacaggtgcgtgctaccatgcttgcctaattgttgtatttttagtagagacggggtttcaccatgatgaccaggctggtcttgaactcctgaccttaagtgatccacccgtctcggcctctcaaagtgttgagattacaggcgtgagccactgcacccagcccactgagggtttcctagtggaggaggaggccaccatcccctcattgtggtgtttataatggggaactcccagaggagccaccagggtaaaagaggaagagatgagatgttggactggcataaaaaaagaaaagcagaccaaaactccagcgtgacagcagcaaagcccatcacaactgcatcataattatcatcagcagcaatagcagctggagtgatttcttttctttttttgagacagggtcttgctctatcacacaggctggagtacagtggtgtgatcgtagctcactgcagcctcgacctcccaggctcaagcagtcctcctgcctcagcctcttgagcagctgggactacaggcacaagccactataccaggctaagttaaaaaaaaaaaaaaaagtgtagagatggagtctcacttaggctggtcttgaactcctggcctcaagcaatcctcctacctcggcctcccaaaatgctgggattacaggcaggagccaccttgccaggctgatcttttaaattctttcagcgtcaaagccaaagttttctcaatgtcctaaaaggccccaggccctctgccctccctcccctgctaccccgccctgtggcctctctgacctcatctcctgttgttcctgccttgctcattcttccccagcctcactggtcccctggctgcggctccaaaacgctggccactcctgccccaggacacttgcctttgctctcttccgtgcccttcccagacatccccacgacttgctcccttactgccttcaggcttctctctctctctctctctcttttttttttttttttggagatggagtctcactctgttgcccaggctggagttcagtggtgtgatcttgcctcactgcaacctccatctcttgggttcaagtgatccttctgcctcagcctcctgagtagcgggggttacaggcgcatgccaccatgcccggctaatatttgtatttttagtagagatggggttttgccatgttggccaggctagtttcaaattcctggcctcaagtgatctgcctgcctcagcctcccaaagtgctgtgattacaggcatgcgccacggtgccccgctgagacttttctccaatgtgaccttctcagccagacatccttgatgatgccatttacatttgcaatgctccctctatcccatctcctcccaggaatgcctcttcatgtctttgctttttttttttttcccccacagaacttctcatcatcttcatgctacatatctctgtttcttgtgtatctccctcctccatgtggatgggggtttccagaaccgagcctggtatggagcaggcggtcaggatttgctcttgaatgaaggatgggggttcactccctggagctatgttgggagccctgttctgaggagctctggcttcgtgggtccccaggacccagggtaagacagtccactccttgggcaatgactgggaccagtacctggggaggttggggcccttcatcccaactcagtcccatccttgagggaatcaactgtgactcacagctaacagggtgagcagagctgcttcttcagtcacgaatgaaaataaccttgtctctgtaaacaaacagctctcaatttattcattgggaagaaagaagtgtgtgtggaaagaaggaggcactttcctggggggcggagtgtcagagtgttagacttgagttactcagagtaattgattcacgatgctgcgtgtcaggggtgttacatctaatcgggagctgtccatacaatttctcactaattgtcactgggcgccataacaggataatgactgttggggcacaagagacttggatgtggtgagccaagggtatcattttgatttttgttttgagatgtgctggaactcagatgaccctccttaccgaaaggctccatccctttaaatttttttttttttttttttaagagatgatgtttttctgcgctatgttgcccaggctggtctcaaactcctgggcttaagtgatccttccacttcagtctcccaagtagtggggaatgcaggtgtgagccactgcacccgactgaaaagctcattctttttttgttgagacagggtctcacgctgtcacccagacttggagtgcagtggcgtgctcacggctcactctagccttgacctctcaggctcaagctatccttccatctcattctcccaggtaggtgggactacaggcatgtgccaccatgcctggctaatttttttattttttgtagagacgggggtctcactatgttgcccaggctagtctcacactcctgagctcaagcgatcctcccaccttggcctcccaacatgctgggattacaggcatgtggaaggttcattgtttagccagagttttgttctggaccggagacaatctagagggatgcagacctgggcttggaccaccagaggtctggctggacccctgggggccagaagtgcctagttgaggggtatcttcttggactcgttacttactcctcactttgaacctgtcaccaagtgtgtcagttttgcctctaaagcatctgtcagctctgtccacttctctccactcccactgccaccccctgctttcacctggtgaccacagacgctgcttagcttctgctctgtctcttattcccttccctttgcctctacccgggagcatacatgtaatggtgacagttccctgcataacacactgcagcggtcccattcccttgaggatgaagaccaaaatccttaacatggctcaagagatcccacaaccatctggcccctgcccacttctcagcctcactgttcaccattttctccaggcaaaaggaaggaccagtgacctaagaatgccatggggctgctgccctcattttgcactctaggattttgaccttattatttcctgtgcatgggatgctttcttcccctccctccctccctttcttccttccttccttccatccatcctctttctttctctctcctctccctctctctctctccctccctccctcccctcccctgcctcccttcctcctcctcctccttctttcccctctctctctctttctttttgagacagggtctcattctgtcacccaggctggagtgcagtagtgtgatcgtggctcactgcagcctcaacctcctgggctcaagtgatcctcccaccctagcctcctgaggagctggataccactgtgtgcagtgagtgcatgccactgtgcccagctaattttttgtattttttgcagagatggaggttttgccacgttgcacagtctggtctcaaactcctgggctcaagtgatctgcccacctcggcctcccaaagtgctgggattacaggcatgagccaccgcacctggcctaggagctgcttcttagatcttccgcagctctttctcatcaccagctaaaatgctgtattctggtagcattgtctttatcctcctctggactgtatctctcttgaagtcttccattccagttcatttctcctgagcctagtacaataatacatagaaagcgctgggatatttttaaaaatactaatgtttagaatcaattttaattccttctgtaaaaaatatacgtattttgcctttttaaaaaaatgcaaaactgggccaggtttagtggggcatgcctctagtcccagctacttgggaggctgaggtgggaggatggctggagcccaggagttcgaggctgcagtgagccatgattgcaccactgcactccaacctgggcaatagagtgagatcctatctcaaaaaaaaaaaaaaaaaaaaaaaaggaaaactcaagtccttttagtgatcacaccaagttcctgcaccttgtcgcttttttattttattttattttatttttttgagacagagtcttgctctgtctcccaggctgaagtgcagtggcatgataccaacttactgcaacctccgcctcctgggttcaagcgattctcctgcctcagcctcctgagtagctgggattacaggcatgtgccaccatgactggctaaattttttgtatttttagtagagacagggtttcaccatgatggtcaggctggttttgaactcctggcctcaagtgatccttctgccttggcctcccaaagtgctgggattacaggcgtgagccatcacgctcggccagcccttgtttttatgaacatcgtgtatccttaaggaccttcaaatacttctgcatccatttgtatgcatctttagttttgttctgaaaacctcaagatatagcacgctatgtgtatagtttgcaacttgaatttttttcactcaacactgtgtttctgagaccaatcctcgctgatacatagagagctagttaattcctcctgccttctgcatagcatctcactatgttattaattgccttttgttttctcaagctatttctgtgttgatgggcatttgtgttgtgtctactgccttgctattgaaaatagcacttcagtgcgtgcaccgcgtaggcctctgtgtactaccgtgaagtgtttcctgaggccagtagttctcaacttggctgcagacagaatcacctgaacgttttttttttaacaatcacaccaactctctgcctttccccaaattcttaattgaatggttcagggtaggcatcggcagttttagaagctccagggtgcttctaaatgtgcattcagggttgagacctgctgttctggggtgtacattggggatgttggtgttgcaatgactgggccaaaagaagaacccaaccccgtgttttaccaggctctgcccaattgcctttcaaggtgactgaactgatctacatcctgctggcagtgtgtgagcgaataatgactgttttgtgtgaacaagtgactaccagtcactgcaggtcagtgaaccagagcgttctccactgcacaaactgcctccaagtggctcatcaccatgggctacagcccacaaacgtctgagcttggaatgctttgtgtccttaggtggcagcttggtgcagctgaaaaggtgccaggctgctaatgggacaattcggagtccagttcagacccaggttctaccttgctatgtgtcctcccaggtcacatccccacactgagcctcagcatccctgcccttggagggaggagagctggaaactcacctgcggtcattttcatgtttctcttctgtctgagccacacgttacttgcagcctgtggtctgagcatgggcgttagagcccagtcctgaatagtttctgcactgtgggccctgttggtatctggggaagcctattacccttctcagagcaatgtttctttttcttctcttttctttcttttcttttctttcattttttgtttgagacagagtctcgctctgtcactgaggctggagtgcagtggcatgatcttggctcactgcaacctctacatcctgggttcgagtgattatcctgccttagtctcctgagtagctgggattacaggtgcctgccaccacgcccggctaatttttgtatttttagtagtgatggggtttcaccatgctggccaggctggtctcagacagctgacctcaggtgatccacccgccttggcctcccaaagtgctgggattacaggcgtgagccacctcgcccggccttttttttttttttttttttttagagacggagtgtccctgtgtccctctgtcacctaggctggagtgcagtggcttcatctcagctcactgacctccgcctcccaggttcaagtgcttctcctgcctcagtctcccaagtagctgggactataggcatgcaccaccacgcccagctaatttttgtgtttttcagtagagatagggtttcaccatgttggccaggctggtcttgaactcctggcctcaagtgatctgcctgccttggcctcccagagcactgggattacaggtgtgagccactgctcccagcctctgagcaatgtttctaaatatgaaatccaaaggcttgtgaagacaactgattatatggaaatacagctgatataaatattacaaaattattacaaaaatattacaaagccaaactgtgatatagcaatacccatgcctctttattaacacaccaaataaggcgatctgatggtgggttggcaacattattacgattgcagtttaaagcagtgatgagtgtaaatgatattccaacatctttgcaacaaatgtaacaggacatgaaaatatctgtgattcctgttggtgacaaagttacaggttctgttgacacgacggcagtttgctgcctacactcataatggaaagaattgctacattgcagtttgatgttagtaaaattaagaggtctattttttcttccgagttcattgagttcattgattgcaggttactggcccttgctagagttatatagacttgagtttctttcttttttgtgagttttttttttttttttgacggagtcttgctcgtcgttcaggctggagtgcagtggcacgatctcggttcaccgtaacctccacctcccgagttcaggcgattctcctgcttcagcctcctgagtagctgggattacagcatgtgctaccacgctcagctaatttgtgcatttttagtagagacagggtttcaccatgttggtcaggctggtctcgaactcctgacctcaggtgatatgccccctcccctccttggcctcccaaactgctaggattacaggtgtgagccattgtgccctgcttttttgtggctttttaaaaatttttattttgtagagacgaagtctcactgtgttgtccaggctggtcttgagctcctgagctcaggtgatctttctgcctcagactcccaaaatgctgggattacaggcataaaccaccatcccaggctagacatgggtttcaatctctgctctatagcttcctgtgtgggtgcatttgggtaaattccttttctttcctgagtctcagtttcctcaactgtaaaatgcatgtaagacagtgagctcctagggtgctgggaagagtaaatgtgacaaatcaaattcaacacacatttgtagagaacttttgatgtgctcagggccattttcggtgccaggatgctggaccgaatgagaagggcaaaatccttgcccctctggagtttacagttcgggggcagagacaatgaataatgaggcagataagtaaataacggtttcagataatactaagggcaatgaagaaaatagtacaggtgatatgaaagggaacaaatgcctggtgcaggtgacattaaatagggcaattaggtaataatacagacagaaatgaacaatattgatgcataagacgagagaatgtatttgaagtatcagctcggcacctggtacgtggtgtatgttccatttgtgctggccacggtgatgatgatgatgatgccatctctccggctacactgcgagcacagatcacagctctctgtagctgatgctggctctacccactgtattcggggctggatgaaggtggggccatggaagcgttctacacaagaactcagcagtcctgttggagccagattggaaggaagcaggtctgattaaaggaagataaagtcttctctctgctaagtctcgcagggagagctaggcaatcaataggtctcgcagatcagtggagggtgcttggaatctggcagcatggggctttttaattaaacctataactgtgagaaaaggtaactgccttatttctgcagcttgtgtttctgtctgcctgccagaaactgaacaaatcaatgcacttccagaggttctgaggatcttgacaagggggcctctggttttgggatggccagaccctgcagggataaactctcgagtggccagggtgtcaggtaccaattctggagggtcaggtgttgccttttacatttaaatacccatagcaggtgtgattagcaactgcaattcaggggaaggcgaggccccttcccagccagcagcagcttgccttccaggattttataccaagctggccccctaccaccacaagatgtcaacattcctttttttaatagaagattttcttttattgtgggccaggcatggcggcttgctcctataatcccagcactttgggaggccgaggctggcagatcacttgaggtcaggagttccagactatcctggtcaacatggagaaacccctgtctctactaaaaatacaaaattagcttggcatggtggtgtatgcctgtaatcccagctactcagaaggctgaggcacgatcatcatttgaatccgggaggcagaggttgcagtgagctgagatcacaccattgcactccagcctgggcaacagagtgagtctccatctcaaaaaaaaaaaaaaaaaaaaaaaaagattttcgtttatcatgaagtagaattatgctgtttagggtatggtccatgcaccagcatcacagcatcatctgctgggaatgtgtcagagatacagaactccagccccaccccagacctactcagttagaatctgcattttaaccagatcatcaggaattcatatgcatattgatgtgtgagaggcactgaaattgaacatacatatgagacttagaagacaaagaagccaaatgccaatatgcagaccttatttaaatcctgagagagttaagaagttatctatgagataatttgagatttgaacatttgcagatattaaggaattattcatttcctaggtgatagggaggttttatttcaaaaaaaaaaaaaaagagcccttttggccatgcgcgatggctcatgcctgtaatcccagcactttgggaggctgatgtgggtggatcacctgaagtcaggagttcaagcccagcctggccaacatggtgaaatcccgtctctactaaaaatacaaaattagctaggcgtggtagtaggtgcctgtaatcccagctactcaggaggctgaggcaggagaattgcttgaacctgggaggcagaggttgcagtgagccgaggtcttgccactgcactccagtctgggcaacaagaatgaaactctgtttcagagaaaaaaaaaaacccttttcttttagagttacacatgaaaatacttagagataaaatgatttcatgctcgcatttgttttaaaatactggtggagctagacaaagtcttgacgtttggacacagcacgaatgactgtgagttgatggtatggggaactgtgtcacgacccaggcagacacagtacacagtatactgtttacttagtatatgtttcaaattccccacggtaaaaacctaagatgatgatatagaatattcacatagaaaatgcatgaaacaggctgggcacagtggctcacgcctgtaatcccagcactttgggaggacaaggtgggcagatcacctaaggtcaggagtttgagaccagcctggccaacatggcgaaaccccgtctctactaaaaaatacaaaagttagctgggcatggtggtgggcgcctgtaatccccgctactcaggaggctgaggcagggagaattgcttgaacctggaaggcagaggttatagtgaactgagatcacgccactgcactccagcctgggcgacagagcaagattctgtctcaaattaaaaaaaaaaaaaaaaaaaagaaaaagaaatgcatgaaacaggaaggtgttgtgatgagcattagttcaagtggacatccataaatctgttaccaggtcattaccggctcctgccctctgtcagaacctctgccccagagtaatttcttccctcccattctctggggcgctctcacccctagctgcctatggaatcgcctgggaaaactttacaaaacaatgcagttgagcctcctccagtccaatgaaaacatactccctgggagtgcgcacaggtgattctaatgtgcgaccttagctgccctagcttttcaggtgaatgccatatttgtgcttgaatttctcaacgagcttactgctgcttacatccaacaggcaatttcactttctcatcaagggactgagttgctggactgttgtataagcacaggttacattgcaacccatttttttccttttttttttttttttgtttgagactatgtttcgccgtgttgcctaggctggactcaaacttctgggctcaagtgatcctctctcttcagcctcttgaggagatggggctttagctaccgtgcctggcttgcaacccatttttgaaactaatgggtttttgtgtatttgtgataaatgtgtatctaccacatattgagtgctttccatttctctggaactctgctaagtactttattttatttaatccccaaaacgattgtggggtcagcatccctgtccctattatactgatgaagaaacaggctcagagagactatgtggcttgcttcaggtcacccagtttaaaaagtgctgagtgtggattgggttcatagctctctgacttaatgctcttaagcatcattttgtgccgttcattcagggtcttgattgaagagttgagggccagttagccacccacaatgaactggaagtaaacatggagaggtcgtcacagtgtcactcgaggcacacttaagtggtgtgccttggagctgagtttccgtctttgtcaaatggggacagcactgttttgtcttctctggctgacaacctcttactcatctctcaaaagtgcgtcagttgtcacagaatggggaagccggaaagctcctctgaatttcaagggacctcctggctaaagcagaattagtcatgtcctcctctagcctcacagaccacttgtccaggtctctgagagcagtcgacaggagccctacacttgtcatgtgagacactggcgcgtctaagaacaggtgctgttttgtagctatttctctgtctgcagagtccagcccaggggctggagcatggcaggggcccctgcatgtctgcaatttgaatgaaagacgagggtactgctcaaacaccaaagctttggtcagagcctaggatgtactgacacaggaccctttgggcagagatatatcacacacagccacaggagagtggttaggaacctggactctgaatgaagactgcctgggttcaagtccaagctctgccacttacaagctgaatgaccttgggcaagttatctcacttccctgggcctccctttcctcatctgaaaaaatggctacattgcagccttgttataaggattgaatgggtgggtgcagtggctcatgcctgtaatcccagcactttgggaggccgaggaaggtggatcacaaggtcaggagtttgagaccagccaggccaacatagtgaaacccgtctctactaaaaatacaaaaattagccgaaaaattaaccgggtgtggtggcacgtgcctgtagtcccagctactcaggaggctgaggcaggagaatcgcttgaacctgggaggcagaggttgcagtgagccgagaccatgccattgcactgtagcctgggtgacagagtgagagactccatctcaaaaaaaaaaaaaaaaaaagaaacttaactgggcatggtggaatccacctgtagtcccagctcctcaggaggccgaggtgggaggatcacttagcccaggagtttgaggctgcagtgagccactgcactccaacctgggtgatgtagtgagaccctgtcttaaaagaagaagaagaaaaaagaatgagtttgtattttaaaagcacttcaatgatgcctggcactctggtgccaggggccaaaggaaaagttagtaataccaatcatttcctgaagactgtgatatttgtttatcatgggtatttttgcattaattttgcattaattttttcattctttttcgtttttaaacatattgcatccaagtgttatttatcttgatgactgggtgtttggtgcctccttaaattttgctcccggggagaatgtctcacttgcctctccctcatcccggtcctggcacctaagaagcaacacatcagttctcatttgtctggagggagctcagcatcattatatgtatttaaagaaaaagatgaatgtgtatatattaccaatacttattcagaatctacaaaactctgagcactggggatgggactgtgtgatggttaataccgagtgtcaacttgattggattgaaggatgcaaagtattgttcctgggtgtctgtgagggtgttgccaaaggagatgaacatttgagtcaatggactgggaaaggcagacccaccctcaatctgggtggataccatctaatcagctaccagcatggccagaataaaagcaggaagatggacatggaaggacttgacttgctgagtcttctggccttcatctttctcccatgctggatgcttcctgcccaacataagactcaaagtcttcagtttttggactcttagacctacaccagtgtttgccaggggctctcggaccttaggccacagacggaaggctgcaccgtctgcttccccacttttgaggtgttgggacttggactgatccactactggcttccttgctcctcaacttgcagacggcctatcgtgggactttaccttgtgattgtgtgagtcaattctccttaatacactccctttcatatacacatatatcctattagttctgtccttctagagaaccctgactaatacaggctgggaatgagacattctcagccacggtctttgacctcaaggagttgacagatcactgattattgttaccacttattgagcatttactgtatgcaagacatggtgctagtgatgtttttattaatccttgtggtgacctttccagaaagaatcattacattcattttacagatgaagaaattggactcagagcaattaagccacttgcctgaagtcatgaagttatgagctggggtcaggatgtgaacccagtctccctatctatctatctatctatctatctatctatctatctatctatctacctatctatctatctatctatctatctatctatatcagggtcttgctctgtcacccaggctgggatgcagtggtgtgatcatagctcactgcagcctcaacaccctaggctcaagcgattctcctgcctcagcctcctgaggagctgggactacaggtgcacacaaccatgcctggctaatttttagatttttattgtagagatgggggtctcactatattgcctagctggcctcaaactcctgtggcaaagtgatcctcccacctctgtctcccaaaatgttgggattacagttgtgagccaccatgcctagccctgtgaacccagtcttttagactttctaccacggtatttgggtaagtccagagctctgtccccatcttctgcaagaacatcttgaaagctgaagttatcagatggatttttctgggagttccattgctgagttcctctgattcatgtctcaggaagctggagtctagacgtggcggggcctgtgggaggtggccctccccttttcagagtggatctgtgcagccatctgccatcacccattcctgtgggggaaaacacagattttcctgtgttaaaaaatctctgagacaagactttggcaggatctgaacagactggcgaagtggctccaggatttcctggaaaaggatgagaagggggaaagagagggcaaaggagaggaggagagagtgggagggaaagaaggaggtcagggagaagaaaaatgagcaggaagagccagcagacagcctcccaggtggatgtctttgaaggtaactgaaatgcatggtggggttttcccaaagggtttctgttagacatttcccactcccagtagggaaactggcttccctaatcagggaagggcagttcagggcagtggagcagtgggtgtcgataatgcccatcttgcagactagttgcgaagttccagtgagattgaatatctgaagtgtagtgttggcacacaataggtattcaacaatgtcagttcagttctctccttttttattttttatttttatttatttatttattttttgagatggggagtctagctcttgtcgcccaggctggagtgcaattgcccaatctcggctcactgcaatctttgcttcccaggttcaagggattctcctgcctcagcctcccgagtagctgggattacaggcacccgccaccatgctcagctaatttttgtatttttagtagagacggggtttcaccatgttggccaggctagtctcgaactcctgacctcaggtgatcttcccacttcagcctcccaaagtgctggggtaacaggcatgagccactgcgcccagctagttctctccttttttaaagacaggctcttactctcttgcccaggctggagtacagtggcacaatcatagttcaccacagcctcaacctcgtgggctcaagtggccctcctgcctcggcctcctgagtagctgggactacaggcatgcaccaccacaccccactaattaacaaattagtggaacgtagtggcaggcacctgtaatcccagctactccggaggctgaggcaggagaatcgcttgaacccaagaggtggaggttgtagtgagctgagattacgccactgcactccagcctgggtgacagatcaagactccatctcgaaataaaaagaaagcaaaaggttccttcattctcctgcctttatccattcactcagcacagtgagcacctaagtgtgccaagcactgtccaaggtactggagatataacagtgaacaaaacagacaaaagcccctgccctcgtggagctgagattctactgcggtaggaaaaagtaaaaaagaaatagataatattataggaacttagagagctgtgaaagctaaggataaacaaagcagagaaggaggatgaggggatgttagggatattggtttcctagttttttctgctataacaaattacagcatgaatctaggggctttaaacaacccatatgtgttatcttatagttctggaggtcagaactctaaaatggatcagcagggctgtatttcttcgggaagctctaggggagaaaccatttccttgccttttctggtttctagaggcttcctgcattccttggatcatggccctacgtcattctgatctacatcactcctcagtctctgaccctcttgcttcccttttataagagcctttgcaattagattgagccatacagataatctaggataatctcctcatctcaaaatccttactttaatcacatctgcaacctcctttttaccatgtaaagtaacattcacaggttctgggtatcagcatgtggacatatttggggagggggtagttgtgaattattctgtctaccacaggaacagagattttagataaggtggccaggaaatagcttatttatttatttgtttttagagacagggtctcactctgtcacccaggctggagggcagtggtacaatcatagctcactgcatccttgaactgtgggctcaagtgaacttcccacttcagcctcctgagtagctgggactacaggtgtgtgccatcacacccggctattttctttttttgtagagacagggtcttgctatgttgctcaggctggtctcaacctcctaggcccaagtgatactcccgcctcagcatcccaaagtgttgggattacaggcacaagccaccacgccttcccagaagaacttattgatgtgacttttgagtagggacctgaaggaagtgacggatagacacctggggagagaaccttccagggagaggaaatgttagtgcaaaggctctgaggagagagtacaatgagtgtctgtgtttgaggaccagcggggaggccagaaaggtcacagcagggagatccaggggcagaaagacaggaactgaggtcaaagaggtcctatgggtgggggtaagggagaggtcatgaaaggccttatagatgattgtgagaaaaatgtcttcctctgaatgagacggaaaaccataagacagtttctctaagcacctgttcaataactgactatgaaagaaaatctgggccaggcacagtggctcatgcttgtaatcccagcactttttgaggctgaggcgggtggatcacttgaggccaggagtttgagaccaccatgggcaacatagggagaccctgtttctgcaaaaataaaaacaaaaaattagcctgatgtggtggcgcacacctgcagttccagctatttgggaggctgaggtgggaggattgcttatgcccagcagtttgaagtttgaggctgcagtgagctttgatggtgccactccagcttgggtgacagaacaagaccttgtgtttctaaaaaaaacccaaaaaaacccaaaaaaaactaaaagagataagtgaaaagagaagtgcaaaatgaggtgtaaacatgtaaaaaggtgtaaggaaatatggaagggacacaattgacaagagaccagaaaattcatagaatgaagtcttcaatgtgtgaagggaaagggctaacataattatgtttcaaagaattcaaacaaatcactaagacaagtccctgaatctgggtagaaaaacaagcaaaggggtgcgaaccgtcaactcactaaagagaaaatgcaattagctaagcacatgggaaaagtcagcctaactagtaatcaaagaaatgcaaattaaaacaacaaaccgttatattttcacctcataaagattctgaaaatgagaatcctggctttggccttggtggaatgaaataggtgcaagaaccctggcagtgggaattggaaatctgattattttgggaaacagtttgacactgggtagcaaaaccttaaacatgggcatcctcattggcccaataagtcaatttttggcaatctagcccaaggaaataattttaaatctggagagagccttatgcattgctgccaaacaggagaaacaactaaactgtgagcaataggttaaataggccacggtgctcattcttttgatatttttgtcaatcatatgaattaggtgccagttatgtgccaggcactgttctaggtgccaggaatacagcagtgaacagaacatcttgaactccttgcccttcatggggttctgattctagtgagggagcaggagagcaaataagaacagatatgaagatgctacatgatgggggacaaagtagggcaatgtcacagagagtggaggggactgcagggtggacaaccaccagtttgctggggacattcagttttaaggctggggcagccctggacaaactgggatgagctagtcacactaagagggtcatccttgtgatgggagtggtcagggtcttgtcctctgaggaggtaggatttggttagggactcaatgcaatgagggagtgaacgatgggagtgctggctgagtaggtttccaggctgacagaacaatacctgcaaaggcccggaggaaggagtgttcctggggcaatgtgagggacttgcacaaggctggagtgtctggggcatagcatgaaggaggatggtggtaagatatagatttcagagagggaaactcttgactcttgcagggaaaggaagaagtttggattttattttaaatccagtgaaagcctatggaggttaagcagggaagcaacatggtaaaatttatgcttttagaaagacgactctggctgctgtgtggagaaggtgatgcaggacaagtaagccccaaagttggggcttagcttgggagggttcttggcttcacccaggaaagaattccagggtgagcggtggtggtggacacttttatttttttgagacagttttcactcttgtcacctgtgctggagtgcaatggcaagatctctgctcattccaacctctgcctcctgggttcaagtgattgtcctgcctcagcctccagagtagctgggattacaggcacccaccaccatgtctggctaatatttttttgtatttttagtaaagacagggtttcaccatgttggccaggttggttttgaactcctgaccttaggtgatccaccccctcccaaagtgctgggattacagatgtgagccaccatgcctggcctagacacttttattgaagcagcagtgcacagcagcagcagagggactgctcctcacagagcagggctaccccataggcagtgtgcccagagtagcagctcagaggcagttctgcagtcatatttatacccacttttaatgatatgcaaattaaggggggatttatgcagacatttctagaaaaaagttggtaacttccgggttgttgggtcattgccatggaaaggggcagtaactcctgggtgttgccatggcaatggtaaactgacatgccacgctggtgagagtgtctgttggaaagctgcttccactttggccctgttttttttttttttttttttttttttttttttttttttttttttttttttggtatttattgatcattcttgggtgtttctcgcagagggggatttggcagggtcataggacaatagtggagggaaggtcagcagataaacatgtgaacaagggtctctggttttcctaggcagagggccctgtggctttctgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacggggttggggataaggttacagattaacagcgtcccaaggcagaagaatttttcttagtacagaacgaagtggagtctcctatgtctacttctttctacacagacacagcaacaatctgatctctctttcttttccccacatttctcccttttctacttgacaaaaccgccgtcgtcaccatggcccgttcccaatgagctgctgggtacacctcccagatggggtggcggccgggcagaggggctcctcacttcccagacggggcggggggcagaggcgccccccacctcccggatggggcagctggccgggcgggggctgcccccacctccctcccggacagggcggctggccgagcgggggctgccccccacctcctggacggggcggctgccaggcggagacgctcctcacttcccagacggggcggccgggcagagacactcctcacctcccagacggggtggcagtcaggcagagacactcctcagatcccagacggggtcgcggctgggcagaagcgctcctcacatcccagatggggcagcggggcagaggcactccccccatctcagatgatgggtggccgggcagagacgctcctcacttcctagacaggacggcggccgggaagaggcgctcctcacttcccagactgggcggccgggcagaggggctcctcacatcccagacgatgggtggccaggcagagacactcttcactttccagacggggtggcggctgggcagaggctgcaatctcggcactttgggaggccaaggcaggcggctgggaggtggaggttgtagtgagccgagatcacgccactgcactccagcctgggcaacactgagcactgagtgagcgagactccatctgcagtgccagcaccttgggaggcccaggcgggcagatcactcgcggtcaggagctggagaccagcctggccaacatggcgaaaccccgtctccaccaaaaaatacaaaaaccagtcaggtgtggcagtgtgcgcctgcaatcccaggcactcagcaggctgaggcaggagaatcaggcagggaggttgcagtgagccgagatggtggcagtacagtccagccttggcttggcatcagagggagaccgtggaaagtgggagacggagacgggagagggagacgggagggggagggggagggggagggcagggggagggggagggagaggggccctgttttatagctagtcttcaatttggtctggtgtctgagccccacctctggagttgagtcctgcctcctacctctaaggcatgttggtggatgcagggtagtgggcagaatagaatcatgtagaccccttagaaggttgttgtaatctagggcagtggttctcaattttaaccatgcatgagcatttcatgcaggggttgttaaaactcagcctcctgcccctggagtctacgtctggagtctgcatctctgactagctcccaggtgatgccagtgctgctggtcctggaccacattttgagtagctaaaagctaggagagagataatggggacttgcagtaaggtggtacccctgctgaggttaggaagagctctggtctgggatgcattttgaagtgaaactatcaatctcatttcagttcccttttaatctgcttacaccaaggagaatagctcaatttgatactagtatgtttctaagacttttctgtattttagctaacagaaagcaggcctcaaagtgtagagcaggctgggcgcagtggctcatgcctgtaatcccagcactttgagaggccgagacaggtggatcacttgaagtcacgagttcaagaccagcctggccaatatggagaaaccccgtctctgctaaaaatacaaaaattagttgagtgtggtggcacatgcctgtaatcccagctacttgggaggctgaggcaggagaattgcttgaacccgggaggcagaggtttcagtgagccgagatcaggccactgcattccagcctgggcgacagagcaagactccatctcagaaaaaaaaaaaaaaaagaatccaatagtgtgatagtggacaaaagaatccaatagtgtgatagtggacatgaaaatacttcatggactacaaagctcttcaccctgctatctgcttcatctttgtggggcaggctgggtgcatcaccagactcctagtcaagtgctctctcttattgttcatggccttgtgttgccccagtcctgggggaggggctgacttttctgcaggactataggaaaggagaatcatagacatatgtccacttgtcagttacctgtgtttccttcttgtgctctgggcagccgatgcactttcctgattgctgtggagcctactaggatctaggaatgaatattgtgcctggctttgggggttcaaaactctccctcttggctcttgagctgcttacttgagcccattcccactctgtggagtgtacttttgcttcaataactctgtgctttctttttgtttgtttgttttttgagatggagtctcgctctgttgcccaggctggagtgcagtggcgcgatctcggctcactgcaagctccacctccagggttcatgccattctcctgcctcagcctcccgagtagttgggactacaggcgctcaccaccatgcccggctaattttttgtattttagtagagacggggtttcaccgtgttagccaggatggtcttgatctcctgacctcgtgatccacctgcctcagcctcccaaagtgctagaattacagacgtgagccactgcatccggcaaatctgtgctttcattgatttactctttcattgctttgtatgttttgtctgagtctttgttcaaactgccaagaacctggacaccctccactggtaacatattttggcgttccagccaggggacaataacgggaaagactccatctatgctacctgatcccccgcttggctgcatcctcaaccactggtatcaatttgaccccaataatctaaggaggaaatgcttgatattcttttgcaatagtttgtccccaatattgcttggaatctggagtttgttgttgaatgggaaagtgggatggtgttgtatgtatccaagcttttgtgctgctgttctaagcagggtcaggcctggttagcatgtggtgctctcttttggtgctgtttggccccggtgttctttggaatttaaaaatcaaactggcatggaaactgctttaccccaaaattttggttcacagccttcactggattacctactggggcaaacagagtgtaaccatgtaaaaccggcgagcttgtattgctatctcatggctagagttccaaggtaaaagccatttggatcttcatttgtgtgcgtgtatacatgtctaaatgtgtttatttgtatgtagacttactgttatatgttgtgcctaccacattggcttataagtaagagagtgcccataacttaataagtccaagcaattttcaagttcacgtgacttaagtaaatctttacgaaactagctagctttaaaattattggtaaatacaaatagaaatgtcttcagaattggcaacatacatttttatctgggttttatgtttttgtctttgctagatattttgaggtgtcaaggctatcaggctgggcgtggtggctcacatttgtaatgccagcactttgggaggccgaggtgggcggatcacctgaggtcaggagttggagaccagcctggtcaacatggtgaagccccgtttctactaaaaatacaaaaattagccaggtgtggtggcatgtgcctgtaatcccagctacttgggaggctgagggaggaggatcacttgaaccagggaggtggaagttgcagcaagccaagatagtaccactgcactccagcctgggtgacagagggagactcactgtctaaaaaaaaaaaagttataaagctattaacccagccaaaacaacaaaaacaaaaaactgtcccttttgcctttggttcactcttggatccagatggaaatctccagctgttctggtgttctggaccaagaagtttgagaaaataagaatccatggacaagaaaattttgaggtagtggttcagagttctggctcgtggcctcagttccaatcctggttctatccttgcttggtgtgaggccttaggaaatctccttgtgtcagtctgggtcctccgagaagcagagcttgctttgagactcaacatgcaaggattttttttttttgagacggagtctcactctgtcgcccaggctggagtgcagtggcacgatctcagctcactgcaagctccacctcccgggttcacgccattctcctgcctcagcctcctgagtagctgggactacaggcgcctgccaccatgcccggctaatttttttgtatttttagtagagacggggtttcaccgtgttagccaggatggtctcgatctcctgacctcatgattcacccgccttggcctcccaaagtgctgggattacaggcgtgagccaccgcacctggcctaacatgcaagggttttgttaggggaaacccttgtgtgaaaggagttagacagtgatgaagcctgactccaagggaggagaagagagaatgttggtggaactgtccgtgctgtgcggtctaaagaaaattggggtttccaaagtcagttgtcaagggcccctgtgttttctaggaatgagctgccttagtttctgtgctgccatacactattgatgggtgagatggattttaaatctagctgggcccttgctctcttatgctccccatagctggaggtcagtggcaggtgcattcttgtggccacgcatcacttaacctctcatgggattgttactacaatcaaatgagacaaggtgtgtaaaacacttggtacaagatctggcataaatactcaacatattttaactattatgattacccagttattctttcgaagccaacaagaaagttttcttctccttttgttatcaaccattccctgcatcagaggctgctaattcagtcagattccctgtaaatgagtgatgtgggccaagtgtaagacattagagagtgggagggactatggtaaactagaaagcacatgaaacatctaaaatggtttgaaaaatagctgggcgtggtggctcatgcctgtaatcctagcactccgtctcaaaaaaaaaaaaaaaaaaaaaaacccaacccaaaaccaccccaaaaaccccagtgaggttgattttcccacccccccaaacccattaataaatttgttgtgtatttgacgacatggagagacctggctggttgatttctggttttgtgcacagcttcagtgttgtcttttctgagaggttttgaatgtggacatcgggattggatggcatgggttgggatcttggctctcccacttgccagccatgagatattgggcaaattatgaaatctcgggcaaattatgaaatttcctggtaactcagtttttccatctgtaaaatggggataataatgattctcccctcatgaaatttcaatgaggatttaatatacagaaggagtttaggacagtgtctggaacatagtaaggctgagtaagtgttgatgttattctggggttgagagaaggagcaagaacaaccttgggttgctggaggctctcatggtttttcctcatcatttcattccacttaagcctaaaacaatatgatcggtataacacccagacaggaatgagtttctcttataccggtgatataatcatatataataatgccacttacataagcttccttagctccttgttaaggccacccacactccgttccacttcacactgttaaggaatgtttctcccacagggaaaaagacacccagctctatgctaattaccactttaaagcagggaccaaggggtgtgagggggggaaaccagcaaaggtgtctttggcagtgctcttgatttgggagagtaaagtctttagtttggaagcagtgagtcaggcctggggacctcagaggagccagaggcaacccatggtgtcccccagattaggcaggcccaacctacgccttaggtgaaaagtgtctgtgagccagccctctgcagacaaatgctaatctgccatttcttttattgcttaaaaaaagagagtctgagacatattctacgtgtgatacaagctcattgtggaaaatatggaaaatagatgggaacaaaatgaaagtgtaaaagtcagaagtcatgagcgatgaatatagtcaagctaacagaaaaaatataaaaagtcagaactcattcagctgaaagtgtcagaaatcaattgcaaactggtttagatgattcaagagaatatattggcccacagaacaaggctgtcacagaggtggatcaggcatggctgtatccagggctcaaacgttattagcggaatgccatcttgcttgctctgtctctatttcatgaataggccttctccagatggtggaaaaggtagacattatcaattccagattaatctccaccaactgaacaatgctactagaaaggaagaggctcttcccagtgctcagataggaaagtctcagggagggacttgattggctgaagatgtaccacgtgtgcatccttgaaccagtccctgtggttggggatgtaccacctgtgcatccttgaaccaatccctgtggttggggatgaggtgctctgattggccagatcagtgagtcaatggccaggggagatgaaatcaaggaatggtccacttaaataggtcctccacagggagtggtgattctgttccaaaagaaagagaaggaaatgaattgatgaaaacaatggatattgctatataagaagcatataacatctgtaatcccagcactttgggaggctgaggtgggcggatcacctgaggtcgggagttcgagaccagcctgaccaacatggagaaaccctgtctctactaaatataaatatatatatatttagctgggtgtggtggcacgtcccagctactcgggagactgaggcaggagaattgcttgaacctgggaggcagaggttgctgtgagccaagatgacaccattgcactccagcctgggtaacaagaacaaaacttcatctcaaaaaaaaaaaaaaaaaaaaaaaagaggtcaggtgcagtggtcacgcctgtaatcccagcactttgggaggctgaggtggtcggatcacgaggtcaggagatcgagaccatcctggctaacatggtgaaaccctgtctctactaaaaatacaaaaaaattagctgggtgtggtagcgggcgcctgtagtcccagctactcgggaggctgaggcaggagaatggcgtgaacccgggaggcggagcttgcagtgagccgagatcgcgccactgcactccagcctgggcgacagagcaagactctgcctcaaaaaacaaaacaaaacaaaaaaaagagaagcaaatgacaagtttccaatacttgcaccatctagaaataatgactgttgacttcttaatgtaaatcctcccagaattcacttccccttatttagctatacttataagcatatactagatacatagaacattgagatatcctatgcaaacttttgtaagctgattttgattgccttgtttaaaaatatcatttagatattttgaaatataagtggcatatcttctgggtagaaaaattagagaatatggacaaacaaaaataaaataactttttttaaataatttttttttttgaaacagagtcactctatcacccaggctggagtacagtagcatgatcttggctcactgcacctccacctcctgggttcaagcgattttcatgcctcagtctcctgagtagctgggattacaagtgcatgcaaccacgcccagctaatttctgtatttttagtagagacggggtttctccatgttgtccaggctgggattgaactcctggtctcaagcaatctgcctgcctcggcctcccaaagtgctgggattacaggtgtgagccaccacacctgatctaaaataacttataattggctggggttaatagtaagacttttaagaagccagattaagggcagggttgagatagaggaagaataatttgtcagagctcctcttatgataccctgtagtccctctttgcagtgctttgcacatttgtaattttacattaattactcaaagtggcttatttaaaataattttattctctaagtgttgctttccttaaaagaaataagaaaaaaaacccagaaaaaaagtgacctaaaataattttattctgaactatttcaggcacacaaaaaactataaagaccagtacagtgaacaaccatttacccgtcactcagtttaaaaaatataacaaagacaatcaagtccttctgtggacccctcttaatctcgtgctcctttctctcttccttccttcccaatgggatctctatcctgcagttgtgtcttatatttcatgcctattttgtattcttattgaatatatgttatccattatcaacatataacattatgttgcatatttaaacactttaagtagactaccactgtatgtattgttctcatggcttgctttttggttcattgttatgattttgcaatttatttttatttttatttatttatttatttttgagacagagtttcattcactcttgttgcccaggctggagtgcaatggtgtgatttcagctcactgcaacctccgcctcccaggttcaagtgattctcctgcctcaacctcctgagtagctgggattacaggcaggcgccaccatgcccagctaattttgtatttttggtagagatggggtttctccacgttggttaggctggtctcgaactcccgacctcaggtgacccgcccgccttggcctcccaaagtgctgggattacaggcgtgagccactgggcctggccgattttgcaaagtgttaatgttgatacaggttatgtttcatttattttctactattgttagtgttaatctgttagtactagcatccatggtagaactcaatcataattaatctatctattctgcagatggacatttaggttccttttttttttttttttttcttgagacagagtctcgctcttttgcccggctggagtgcaatggcgccatctcggctcactgcaaactccacctcctgggttcaggtgattctcgtgcctcagcctcctgagtagctgtgactacagcacccaccaccacacttggctaatttttgtatatttagtagagatggggttttgccatgctggccagggtggtcttgaacttctgacctctggtgatccgcccaccttggcctcccaaagtgctgggattacagtcgtgagccactgagcctggccgtctcccttcccttcctttcccttcccttcccttcccttcccttcccttcccttcccttcccttcccttccctcccctcccctcccctcccctcccctcccctccatctccctctcctccccttccttctttccttccttccttccttcctctttctctttctttttctctctttctttctctccctctttttctttttttcttctttcttttttttggagacagggtcttactttgtcacccaggctgaagtgcagtggtatgatcatggctcactgcagcctcgaccccccaggctcaagcgatcttcccacgccagccttcctgagtagctgggattataacaggcttgcaccgctatgcctggctaatatttgtattttttgtagagatggggtttcaccatattgtccaggctgggcttcaactcctgagctcaagcaatccacccaccttggcctcccaaactgctgggattataggcctgagccaccgcacctgacctgtttctatttttctattacaaacagtgctgtagtaaatattcctgtacaggccaggcacggtggctcatacctgtaatcccagcactttgggaggccgaggtgggcagatcacctgaggttgggagtttgagacagcctaatcaacatggagaaaccccatctctactaaaaatacaaaattagccaggtgtggtggcgcatgcctgtaatcccagctacttgggagactgaggcaggagaatctcttgaacctgggaggtggaggttgcgataagctaagatcacaccactgcactccagcctgggcaacaagagcaaaacgccatctcagatatatatatattcctgtacatttctccttgtgcaaactgatagagcttctcctggtctagggtatgtacctaggagtggaattgctgggctgtgggggttatacttcttcaactttactcaatttcaccaagttgctctgcacaacagttgtaccaatttacactcttacctgcagtacatgagaattccagtttctccgacatttggttttgtcagactttttatctttgccagtttgatgtgtgtgaaatgcagtctgctggcacccagtgttcaatcctgaagagctggatgcataggtcttgttcaccatggttcccccagcactttgcgcagcacctgaaatatagtaggtattccatattttttggctgactaattgagcagcagttttctggctcctctcatgtaaaattccattacaatttgttggagaagccatttgttctgcagggagtcctgttttcatctcactcttcccaattcaaaaccaggaaaccgggccaggcgcagtggctcactcctgtaatctcagcactttgggaggccaaggcaggtggatcacgaggtcaggagttcaagaccagcctggccaatatggtgaaaacccatctctactaaaaatacaaaaattagccgggtgtggtggcatgcgcctgtagtcccagctacttgggaggcagagacaggagaatcacttgaacctgggaggcagaggttgctgtgagctgagatcgccccactacattccagcctgggtgacagagcaagactccagctcaaatcaaccaaccaaccaggaaaccactcagggactaagcagagaaaacagcttttgattgccctgtttgcctttttgttagaactgcagttctcaaaactttcccatacctcagaaccacgtggagggcgtgttaaaatgcaaatcgctgggatccatccccccagaatttcttgttcaggaggtcgagggtaaggtctagggatctgcttttttttttttttttttttttttttttttttttgagacagggtcttgctctgtcacccaggctggagtgcagtggtgcaatctcggctcactgcatcctcgacctcttgggctcaagccatcctccccactcagcctccctagtagctgggactacaggcatgtgccaccacgcctagctaatttttgtattttttgtagagatgagtctctctatgttgcccaggctggtctcaaactcctgggctcaagcaatccacctgccttggcctctcaaagtgttgggattacaggcatgagccaccatgtccaaaataagatttgcgtgtgtaataagtacctgggtgattctgatgctggtgctgctggtctgggaactacactttgagaaccaccggatctgaggaacattcaatccagacattttggatatgatcaatgtggagtgtccttaaagagactgaatgcaaaacttgaaaagccactcccaaagtgtagagtggagggaagaatataacatctaactccacttagccggagtaggaaaaggagaagtctggaatgtttaagacagttggcagcatttatagagactgatataattcagtaagaatatattgggcaccaactgggttgtttccttccttcttctcttctcttctcttctcttctcttctcttctcttctcttctcttctcttctcttctcttctcttctcttctcttctctctctctttctttctctctctttctcccttcccttccctgcccttccctcccctcccctccccttcctttcctttccttccttcctttccttctctcctcccctcccctcccctccccttcccttccttttttttttgacagagtctctctcttgtcacccaggccggagtgcagtagtgcaatcttggctcattgcaacctctgcctcccgggttcaagcgattctcgtgcctcagcctcctgagtagctgagactacaggtgtgtgccaccacacccagttaattttaatttttattttttgtatttttagtatagatggggttttgttatgttggccaggctggtctcaaactcctggcctcaagcaatccacctgcctcggcctcccaaagtgctgggactacaggtgtgagccatcatgtccggccctgactgggttgtttccatctgctcgcaagtcttctacgtgctttcaagccaggatctttttttccattgatacttactcctgagatcaccgcaatcttctcttcttcctctacctcctccccttctcccccccccccctcctctcctcctcctcctccttcttcttctttttcctcttcttccatgaattaaattcagatgtggacttggctatgtgttgaaactataataaagatagctagcatttattgaggtcttggttgccaaatgcttttgttagtgttatctcacttcatcctccctcagacttcaggagataggtaccatagttacatccactttgtggatgaagtttagaggttacacagcaggtaaataacaaagctggggctgcaacccaggtcaccccaattccaatgtcttgttctttactgaaactatgtaccatacatctgtgattcttagcttccttattaattaattcaccaaatgttttctgagcacctcctaggtgctaggccctttgctgctgatatgggcaaatgagacagacaaaattcctggtagcacgacaatatgttttggccctgtgtccccacccgagtcttatctcaaattggaatccccataatccctaagtatggagggagggaccaagtggaggtcattgaatcatgggggcagtttccctcatgctgttctcgtgatactgattgagtgctcatgaaatgtgatgatattatagggcagtttccctgctcctgctcattctctctggcctgccaccatgtaagatgtgcctacttccccttcccccatgattgtaagtttcctgaggcctccccagccatgcagaactgtgagtcaattaaacttctttcctttataaattacacagtcttgaggctttctttccttttttctattttgtgagacagagtcttgctctgttgcccagactggagtgcagcggcatggtctcagctcactgcagcctctgcctcccaggttcaagcaattctcctgcctcagcctcccgaatagctggtattacaggcatgtgccaccacacctgggtaatttttctgtatctttagtagagaggggtttttgctatgttggccagtctggtgtcgtactcctgtaatcccagcactttgggaggcttgaggaaagtggatcacttgagtatttctttatagcagtgtgagtcatctcctattactgtttttttttttttttttttcaaaaagatgggatcttgctgtcacccaggttggagtgcagtggcttgatcatagctcactgcagtcttgaccttccaggctcaagcattctcccacctcaacctcccaagtatctgggacaacaagtgtgtgcaatcatacccgcctaattatttgtttattttttgtagagatgaagtcttgctatgttgcccaggctgttgtagaactcctggactcaagcaattctctcacctcagcctcccaaagtgctgggattataggcatgagccactgcgctggccacaatctcctattactctcatctatagaaggaaatgagactatccctctttgagggttgctgtgaggtttagggaaatgtgctcttggtacccagtagatgctcaataagcattacgctaggtatatagtaggtgctcaataagtgttgtgcttggtatatagttagtaggtgctcaataagtgttggctcctgatttccttcactcccaggagctggtaactctctatttgtgtacgtgggggagaatgaagccaattccaagagactacgatgttctcctagaaaaaggcattgcaccatctttaacatttgtgcagcccaccctctattagctcatctgagcaaatgcttattttcctggtctctggggacaagacttaggctcttttcatttgcctcctcaccctctccccatctccctattctagccagtatcacagaatatgcaacatcttgacaaaccaaaggcactgggcaatgctttaggaaactgtgcaatttagagagatgaacaatgaagaaatatcagctctaggcagcttgtgtgatggaaaataggagaagataagataaatgtgcagcttagaagggagagttctcacaggtaatgagagaaaatcaggagccaacatctatttagaggtattttccttcaagcatctggagcttttgaagaacctggataggagaaatctacattttaggagtgtaggctattttgtaatttccatctttgaaggcttcaactccatctttgctgtctgtgtgctagttatttctttttcaggctcaattttaataatttccttttttttcttttctcccaggaagagggtttaactctgcaacataatcagtgcacagaaacctaaattggaaatctctttcactacagacaagacagttcagaagtgaaaagtcacagtaaaattgggcatttctttccatagacttaacagaagcaacacctggattccagcagctgtactggtgtaactggcacttgaacgtctccatccaagtgcccctttgtggcagatgaagagttcaggttttgttcctcatcagctttgtgaccttgggcaaagtccttgacctatcagagcctcaatttccctatctgtggaaagacgaccatgaaaaaatatgcactatggggtggttctggtggggagagttaaattagatataatttagaaattcttagcataatatttgtatcatatatatgtttatatatgttaatatgtaacacataatagtatataagaaagtcatctatatgaacttcacacagcatattatattatatatacacactacatggtgtatatgacatatactatctaatatatgatatggtttggctgtgtccccacccaaatcttatcttgaattgtaaatcccacaattcccacatgttgtgggaggaacctagtgggagataattgaatcatgggagtgggtctttcctgtgctgtttttgtgatagtgaataagtctcatgagatctgatggttatatacacgggaatttccctgtacaagctctcttctcttgtctgctgccatgtgagacatgcctttcatcttctgccatgcttgtgaggccttcccagccacagttccacgtggctggggagtaataaacctctttcttttgtaaattgcccagtctcaggtatgtctttatcagcagcatgaaaacagattaatacaatatgttatatatatattatatagtatgtatctaatatagtatagtatactaagtattaaatattttataataaatataatactatagcatataaacatgagtacaatgatatatgctctaacatatgtactatgtaacataatggcacatacacatattataccatgtttgtattttatagtgtacataacatatactatatatcatatagtattctatagtatatatgatatacataccatataacacaaactataatatatgtactatatacactatatataatatagtatactatgtaatatatgctatatatacaagcaactgtcctctaaactatatcttatattatatattatgtaatataccaatataatatagtagagatgaaagtttcttgtgaattgaaaagccatgattaataaaagatgttattattcatatagagatatagatgactgataaggtttgtggtatgaccctgagtctctttttttctatcatctgcttgattcactacctgactcttaatttttctttctttctttttttttttttttgagacggagtcttgctctgtcacccaggctggactgcagtggcgtgatcttggctcactgcaagttccgcctcctgggttcacgccattctccgtcctcagcctcctgagtagctggaactacaggcacctgccaccatgcccggctaattttttgtatttttagtagagacagagtttcaccatgttagccaggatggtcttcacctcctgaccttgtgatccacccgccttggcctcccaaagtgctgggatttgagatggagtctcactttgtcacccaggctggagtgcagtggcgtgatcttggcttgttgcaacctccactttccatattcaagcaattctcctgcctcagcctcccaagtagctgggattacaggcatgtgccaccatgctcggctaatttttgtatttttggtagagactggtgttcgccatgttggccaggctggtctcgaactcctgacctcaggtgatccacccacctcagcctcccaaagtactgggattacaagcgtgagttaccatgcctggccctgactcttaatattttattttactgttttttcctcaactacttcttgttgcctttgtcattcggttaacgggccatcctcctctcaggagggccaccaaagggctgggagtcaccactgacacattgaaactcttttcctccctcctgctctacactcaccctacatctaacactctggctgcctctactgatcctggctctaaagcatggcctggatacatccactcttttctgagccccatcaccccatgccagctccccccacctgtctagacaactacaatagtctcttaactactctccctgcttcctccttcacctctttataatccactcttcacgtagtagcctgcgtgatcttttttttttatttttattttttttgagacaggatctcactgtcatccaggctggagtgcagtggcacaatcgcggctcactgcagcctcaacatttctgggctcagatgactctttttttttttttgagacagagtcttgctctgtccccaggctggagtgcagtggaacgatctcagctcactgcaagctccgcctcctgggttcacgccattctcctgcctcagcctcctgagtagctgggactacaggcacccgccaccacgcccggctaattttttatttttagtagagacggggtttcaccatgttagccaggatggtctcgatctcctgacctcgtgattcacccgccttggcctcccaaagtgctgggattacaggcgtgagccactgcgcccagccttgggctcagatgattctcccacctcagcctcctgagtagctgggaccacaactaatttttgtattttttttttactttattattattattattattgtggagacagggttttgccatgttggtcaggctgatcttgaactcctgagctcaaacaatcctcttgccttggcctcccaaagtgctgggattacaggtatgtgccactgtgcccggccaatctttaaagggagtaaatcggatcatgttacctagctgaaaacccttcattggtttttccaacacatgtagcataaattccgaactccttactgtcaatttttcctgaaatgtacctttgcctggatcactcccctgctctgccttgcccactctgctcctgcactggtgacagttcagctttcaaacacaccacactcaatcccaccttgtggcctttgcacttgctgtttccttgcccgggaatgtctttcctccaagatatctgcatggccctcttgttcactccattcaggactctctgcaattgttgctttatctggggggacattcctgatcatcctaacaaaaataacacctcccatcacttgtgtcttcttaacgtatcttgccatacatacatacttagcatttaccatatactctctggatatatatatatatatatatatatatatatatatatatatatatatttagcatttttacattctctgaaaggccccagagcgcttagtgtatggcacaaataggtaaataatggtaataattattactattcattttgttattatagacagtgctgtgtgagttttaaatcctttcatgagaaaaggtttttttaaggctgggcaaggtggctcatgcctctaatccagcactttgggaggctgaggcaggtggatcacctgaggtcaggggtttgaaaccaacctggccaacatggtgaaactccatctctactaaaaatacaaaaattagccaggtgtggtggcgcgagcctgtagtcccagctactcgggaggctgaggtgggaggattgcttgaatccaggagtcaaaagtttcagtgagctgagatcacaccattgcactccagcctgggtgagagaacaagactttgccccgccgacccccgccagaaaaaaaagttttttttttttttgagacagagtctctctctgtcaccaaggctggagtgcaatggcatgatcttgtttcactgcaacctccgcctcctgggtttaagcaattcctctgtctcagcctcctgagtagctgggattacaggcatgtgccaccacacctggctaatttttgtatttttagtagagacggggtttcaccatgttggtcaggctggtctcaaactcctgacctcatgatctgttccccttggcctcccaaagtgctgggattacaggcgtgagccaccgagcctggccctgttttttttgtttgtttgttttttgttttttttgtttttgttttttgtagagctgtagttttgctatattgcctaggctggtctcaaactcctggcttcaagcaatcctcctccctcggcctctcaaagtcctgggattacaggattgagctgccatgcaagaccaagaaaccgttttgatagtcagaaattatatagctaccatttatggagcttaactatgtgccccgcaggtgctaagttgttttttttttttttcaactctgtctcatttaactctcactatcacagaatgccttgaagtttgtattactgcaggagaggaggtgaactcaggatcagctttattaatattgataataatagtagtgttattaaatgaatgaatgaaagcacaacatgagacctattctaaggtgattagaagactaagcactcagctctgggattgaatggtggaggggcaggcagtttggaaggggaggcatcccttgtgtactcccaggagtgtccttatccagggtcaaccttggaggcaccaagatttattttattagagaaggcagccattcctcaccccgcactacccacagatccaaggcctgaggaatctgagaaatggcccccctagtccataggctcaatctattttcactgggagagaagcagcccaggcatatggggtctgcacctttcactgcgtaggtgataaaccttgagccaaatcagaattatcggtcttgtgttctgtcgtatggggcctcccaacactgtgaagtgcactcacacccacgtgcccttttatttatgacttttattgagccttctatgaagtcgtaaattgaccaaccctccaactggttccggccctcatcaggaagctatcatcaaagtgaatcaccttctcactggccacttgttccctgaaggttcattgcaaaggctgagatgttttctgggacttcttatagaatctgtcagccctagcttagaactgccaagccaaggtttttttgtttctgtttctgtttttttttttttttttttttttgttgttgttaagaaagagaagtaaaatacaaagtggaaaggtaatgtgtttgtttggccagggcctctcatctctgtacagtattctggaaatgcctcaatttctggagctgtggattggacgaggttgacctactcttattctggcctagaaaaagtctgagtaattcttgcatcagggaggccaggcatgttggctcatatctgtaatccagcactctgggatgctgaggcgggtggatcacctgaggtcaggagctcaagaccagcctggccaacatggtgaaaccccatctctactaaaaatagaaaatattagctgcgtgtggtggcagaagcctgtaatcccagctacttgggagtctgaggcaggagaatcccttgaacctgggaggtagaggttgcagtgagccaagattgtgccactgcactccagcctgggtgaaagagcgagactccatctcaaaaaaaaaaatatgtgtatatatatatatatattcttgcactagggatttggggacaaggcagagaacaacatattcctaagggaatatgggaaccagcaacttaaataaaaacaagggttggatcttggacgtaggagggacttgggtggaaatgatttccctaaaagcacagggtgctagagagtccctaagaactcctcagacacctctcaagccctgtgctggggaaacaacctgcattatctcatctactcttcagcaggcctctgtttcatctccatttcgcagatggagaaattgaggctcacagaggttatgtcactgtataagttgctctagatcacatggatactaaatggtagagccaagttctgaacacagattcttctttaatttattaaaattcacccatttggatgtgcatgtcaataatttttagtaaatttatttcgtttcattttatttcatttatttatttatttgagatggagtctcattctgtggcccaggcttgactgcagtggtgcagtctcggctccctgcaacctctgcctcccaggttcaagcgattctcctgcttcagcctcctgagtagctgggactataggcacatgccaccttgcctggctaatgtttgtatttttagtagagatggggtttcaccatgttggccaggctggtcttgagctcctgacctcaggtgacccacccaccttggcctcccaaagtgctgggataacaggcatgagccacttattttattttattttattcttttgagatggagtttcacttttgttgcccaggctggagtgcaatggcatgatcttggctcactgcaacctccgcctcccgggttcaagtgattctcctgcctcagcctcctgagtagctggattacaggcatgcaccaccacgcctggctaatttttgtatttttagtagagacggggtttctccatgttggtcaggctggactcgaactccctacctcaggtgatccgccagcctcagcttctcaaagtgccaagattacaggcttgagccaccatgcctggcccacttattattttgtaaagagacagggtcttgctctgttggccaggctggaggacagtggcataaccgtagctcactgtagtcttgaactcctgggcttaagccatcctcctacctcagcgtcctgagtagttaagactacaggcatgggctaccatgcccagctaatatttttagtaaattttaaaagttgtgtaattatcatgacaatacagtcttagaacctttccatggtgtccagaatgacccctggtgctgatttgccgtcaatcctcattcccatctgtagcttcagttgacaactgtgcctgggcctgtgtgtctctataaatttacctattccggacatttcatataaatagaatcacacaatatgtagtcttttcatttgacttcttttgcttatggtgagataactatgttgttttgtatattaacagttcattcctggctgggcgtggcggttcacgcctgtaatctcagccctttgggaggctgaggtgagtggatcacttgaggtcaggagttcaagaccagcctggacaacatgggaaaaccctgtctctactaaaaattcaaaaagtagccaggtgtggggaacgcacctgtaatcccagctactcagggggctgaggcaggagaatcacttgaacccaggaggcagaggttacattaagccaagattatgccactgcactccagcctgggtgacagagtaagactctgcctcaataaaaacaacaacgacaacaacatagttcattcctttttattcctgaatattattccaatgtttgggtataccccattttatttattcattttaccagttgatgagcatttggattatttctatttcttggctgctataaagagttctgctatgcacattcatgtgtaggtttctgtatggtcggatgttttcatttcatctgggtagtttcctagaagtggaattgctgggttttatggtaagctcatgttaaactttgtaagaaactgcgaaacttttcaaagagcctttgtcattttacattgaactcaggtctttgtgactctgacgtccaagttcttaaccactgcattatgtgtatgtctcatgttactccatgccatgaataatcaattcattttgacaattattgcttgatgtttattctatgctggtcgtggtactaaatggtaggaatagagaaatgaaaggatatggcttgttttctgccttttatggtagattgggttattattattattattattgttattatttttgagacagagtctcactctgttgcccaggctggagtgcagtggtgcgatcatggctcactgcagcctcaacattctgggctcaagtgatcctcctatctcagcctcctgagtagctgggatcatggcatgtgccaccatgcctggctaacttacacttttttttttctttgtagagacaaggtctcactgtgttgcaaagactggtctcaaactgctgggctcaagcaatcttcctgcctcaggctaccaaagtgctggggttacaggcttgagccacctagcctggttagattggttagtgatcacaatttttctaccatatgacctttcagtgtaccagatggacagagcatatttccccacccatattaggctgttcttgcattgctataaagaaataccagaggccacgcatggtggctcacacctgtaatctcggcactttgggaggctgaggcaggcggatcacgaggtcaggagatcgagaccatcctggctaacagggtgaaaccctgtctctactaaaaatacaaaaaattagccaggcatggttgcaggcgcctgtagtcccagctacttgggaggctgaggcaggagaatggcgtgaacccgggaggcagagcttgcagtgaaccgagactgcgccactgcactctagcctgggtgacagagcaagactccatctcaaaaaaaaagaaatactagagactggataatttataaagaaaagaggtttaattggctcacagttgtgcaggctgtacaagcatggagctggcatctgcttggcttctggggaagccgcagggagcttttactcatggcagaagtgaagagggagcaggcacgtcacatggcaaaagcaggagcgagagagagagtgtgggttagattctacaccctttttttttttttttttttttttttttttgagacagagtctcgctccagcaccaggctggagtgcagtggtgcgatcttggctcactgcaacctccgctttctgggttcaagccattctcctgcctcagcctcccgagtagctgggattacaggtgcgcactgccacgccgagctaattttgtatttttagtagagacagggtttcaccatgttggtcaggctggtctcgatctcctgaccttgtgatctgcccgcctcggcctcccaaagtgctgggattacaggcgtgagccaccgtgcgtagcccacacacttttaaatgaccagatctcatgaaaactcactcactatcgtgaagacagcaccaaatcatgagggatctgtccccgtgacccaaactaactccaccaggctccaccttcagcactggggattgcaattcaacatgagatttggctggggacaaatatccaaactatagcaccaccccatggtgttgggtttgcccatgtgacttgtggccaaggaacatgaatcagatatgatgcaaacagatgcctcacatgtgctttttgtgctgtagttcatgttcttgtgttctcctgatccattatgagaagaacacactctgcatagcggtttcttctttagtctgagagtcacagcaaaaatatgtgaggcagacctgaatttaacacacagcctaaagctaagtgcaggtttcccacagcatgaagtagacctgcccatctgatccctgcctagatcagttaaattgtagtcatcctactgatcactgagagttttcagaagtgtttgtcattgtaaacaactgaaatattagttgtttgttatgcggcaatagctgactaatgcatctttaaagagcctatataaagagatacacagaaatataaagcaatctataatagagagtacagtgaatgtctggagagagacacaaaatgagtactgtgggaaaccactctggtggtaagggtaaaattcagcttcatgaaaaaggtggtcttaaaggataaggaggattttgacaggtggaaatgagtgcagtgggatgtcatctaagcaaagaaaacagcataagcgaaggcctgaaagttttatacctccaggttttatgcctatctatggctcatgtcctgtgatctaagtttctcagaagacagagatgcatccactttcagggtgaggacctttagcttgtcacttctggtcatccctccagaatgagccgtttgcaatctttatgttagatctaaaatccacaggagcttagtgacagacattgatggctgttgctactgtctagatctggtcatggacgtgttccaccacccacagactcaccaccaccaccaccatatcgaatttaaaaatgagtctcttaaatacttaactgacttatcttgccaactcccattaaccagttttatgcctacttctctggagtgacaaccagataatgattatagggaaatttgtttttacttttcttttgcgtctgctgctttctttttgttagaatttttgtgatatacatttttgttttcaatgtttctatgttgtcttgttttatttgttgtttattgtattgcatagtcttgtctacagtatttaactggattttttttaaaagaagcactccaaactgaaaggcattgtcttttattagagaaatttaacccatttatgtttattgtgcctattgataagtttgaatttactcctgatatttcaaattccaatttaccatgttttaaaaattgatgcataataattatatattattatgcatcaattatgcaaaatatcacatgtatgaggtacatgtgatattttgatacgtacatacaatgtgtacttttcaaatcagggcaattaggatattcatcacctcagacatttatcatttctttgtgttgggagcatttcaaatattctcttctggctatttgggtatgtacaataaattattgttaactatagtcaccctactgtgctgttgaactctagaacttttccttctaactgtatttttgtacccgttaaccaacctctcttcacccctcactcacccccccaccctctggtaaccatacttctactctacttttatgagatgaactttttaaggtcctacatattagtgagaacatgcaatatttatctttttatgcctggcttatttcccttaacgtcctccagtttcattggtgttactgcaaatgacagaatttcattcctttttatggctaactggatattccattgtgtatatatattatattttgttttcttttcttttttttttttttgagacagagtttcactcttgctgcccaggctggagtgcaatggcacaatctcggcttactgcaacctccgcctcccgggttgaagtgattctcttgtcccagcctcctgagtagctgggattacaggcatgcgccatcatgcccagctaattttgtatttttagtacagacggggtttctccatgttgttcaggctgatctcgaactcctgacctcaggtgatctgcacacttcggcctcccaaagtgctgggattacaggcatgagccaccacgcccggcatatactacattttctttcttcatccattgacgaacacttagtttgattccatatgctggctattatgattagtgctacaataaacatgggtgtgcaggtatcttttctacatattgatttcctttttttggatatatacccagcatggaattgctggattatatggtagatctatttttagttttctgagaaatctctgtactgttttccataatggctgtactaattgtcattcccaccagcaatgcactagtgttgccctttctccacattctcaccagcatgttattttttgtctcattgatactagccattttaactggggtgaaatatctcgtaatggttttgctttgcatttcccttgtgattagtgacattgaatatttttttcatatccctgttgtccatttgtatgttttcttttgagaaatgttcatttaccctgttttaaagtttgttctttttctttcctgcttttttttccccctgttacattggttatgttttccttgatgcattttttttcttcagtggtttggaagaaatgcacgctagttctgtctctttggcaattatctttgacattttaaacacattatgaaacatactattctttcaaagtatagagttaattaggatttcatccggagcaaaagaacaagcagcatgttttcacttctctaccttagccatctgctgctatttcctacgttgaaatgatctggaactttagtttcagaatgttatttatgtacttatttatttttattgtggattcagggggtacatgtgcaggtttattatgtgggcatattacataatgctggagttttagcttctattgaacccatcacccaaacaatgaatatagtacacaacaggtaatttcaaccctttcccaccttccctactcccctcgcagaatattactgaaaacaattttagattttgtctgtttttccaaagtatactctttctggccaggtgcggtgactcacgtctgtaatcccagcactttgggaggctgaggctggcagatcacccgaggtcaggagtttgagatcagcctggccaacatggcaaaaccccgtctctactaaaaatacaaaaaatagccgggcatggtggtgcacgcctgtactcccagctcttcgggaggctgaggcaggaaaatcgcttgaacctgggaggcggatgctgcagtgagctgagatcacaccactgcactccagcctggatgacagggcgatactccatctcaaaaccaaaaccaaaaccacaaccacaacaacaacaacaacaacgtacgctctttcagaaagtctccgagttgaaaacgcctgtgtggccttctagcatccagtgttaccaacgaggaatatgctaccgatctgctacttcatcccttagtgaggtttttttttttttttctcttaggaactttttaggatactctgttctcactgaaattgcaccctgttgcaactaggtgtggttcttttccatgtcagattggtcttatttatagaatacatgatctgctcttagctctttgaagctatcagttatacttacattaaaatcttttgtttgtttgtcctattgtagtgattaagcatgtgagttctagaatcacaatactgggcttgaatcccagccgtgatcctttctggatatttgagggaaatttctgtagttacagcaggaacagaggtggggtgattccagattccagtattctaggcagaggcggcacttagcagaactagccctggtggaggtggccctctgataaattcagagctgatttatcagcagtgtcttcaatggcacaatgttagatggaggctgatgggttccagcctaggagcattagcagcttctaaaaatttattatttttatttttttaaacaaattattattattatttttatagaaatggggttgccccatgttgcccaggctggtcttgaactcctgggcttaagcgatcctgcctcggccccccaaagtgctgggattataggcatgagccacagcacccagcccattagcagtttttgatctacggttatcacgtcttctttttgctcctcagacccacccacttttccaattgctcttccatccatctccaaaccttatacctaactccttggtttgaaatatctagagtggtttctgctttgctgataccactggtttctgaaacatgagcataggacataattgatattggggtgaatgggaggaacagaatgatgcaaaattgtctgcttctgtgtatgagaaagacactggccaatcttaattctgcaagcccaggagggctcttaaattatatttattattattattatttttgagacagagtttcactcttgttgaccaggctggagtgcaatggcacaattttggttcactgcaaactccacctcccaggttcaagtgattctcctgcctcaacctcctgagtagctgggattacaggcatgtgccaccacgtccggctaattttgtatttttagtagaaacagggtttcgccatgttggccaggctggtttcgaacccctgacctcaggtgatccacccacctcggcctcccaaagtgctgggattacaggcatgagccactgtgcctggcctgttattattagtagtagtagcataatgcattgaacatagcttgtcaatgcttgggtgtcaggtaatcaacaccaagacgtcccttgagacttttgctttctaatttgccctgaggataggccaaaataagctagtgacatattgagttaattgggcatcaacccaggaattctgcttcttgctgtcctaccctggacttccccatgaagttagtggccccaggaggaaggtgagaaaagggtgaagctgcattacacttgcagtcagtgttcaagtcaccacaaaacggtgacctacctacacagtgccctgaatcctccagtcttgccccagatgacagaatccacatggacccttttactgaagcccgtcaggctccgcggttttatagatgatgtcaggaggagtgattaggaccaaaggaaaaaggttcctaggcacagttgctaaaactgtgctcctgaggtctgtaggagcccccaaggtctctgttgattactttaagcaaagctcttcagtttctctgtggggaacttctccctaagtgaccacaatcaggttagcaggtggctgagtaaacaaggctgaacaatgggttttccgtcaagttggtttatatcagcaagaagccctaaatctgttttttttttttttttccagtccctcctggagatgaagaaagagttcagtcaccctgctgaggagagaaaaggccattattgtcaaaagaaggcacctgtcctagatttaagggaggtgcgttatcctggatggtttctaggcctcagtgggatggtctgatgacttcgtctcaccccccaggtacctaggaaggtgatgaatgtgaaggtggattcttcatggagctccacactcaggatctggtatctgaagcttcctgcattatgtcagcttatctactttgtccagctccccattagagaaatcctgctttcttaccagcataggtcactgcgctactaagaacatttcttttccttttttttcccctccagagatgtggtcttgccctgttgtccaggccggagcacagtggtgcaatcctacctcactgcaccctctaactcctggactcaagtaatcctcctacctcaacctgcacgtagctgagactccaggcgtgagccatcgtgcctggctattttttgtattttaattttctgtagagatggggtctcgtcatattgcccagattggtcttgaactcctggcctcaagtgatcctcccacctcatcctcccaaccccgtttcttttcagtcagacaaccagcctggtctttattacactggttcagagtcagctggaaaagaattctcttttcctgggccaggcaatcagtgttcaagtcccagtgggatctcattcgagtcatgtgactttgggccggttcttcacctctgagaacctcagtttctccacctgtaaaatggatgtggcactagagcctgtaccacttgccttgtagggatgtggcaagtctcaaaggtggtgatataaggggagcgttgggtaaactgtaactctcagctatctgaatgtgcgcctgttctctctcacgttaggaaccgtagcaaggcactagaagaggttatattttatatatatattattttttatattattatatattaatgttatacaaaatacattataaatgtaaattatattattatatattaatgtaatacaaatattacattttatctacaaatcatttggctgagccttggatgtcaattgggctgtttaatgccctgacgaagatctcttatacatccatatgagaaagggtttctatactggaagatactgcctctctttttacatgcaaggaccttgctaaagtgcagtttctgattcactgggtctgatgcaggactggagattgattctgcattttcctcaaactcccaggtcatacccatgctgcaggtatcacatttagtagcaagaatgtaggaaacatggtcttttctggtggctctcttgatgttttgctacacttgtatttacttgtctcaactagactccacctcctgcagtctcacatgacccatgcaactcaacggaagtcatacaacaatcactagcagtaagtacccgcagctgtagaaacaaacaaacaaatgaaaaaacccaaacaataacatttgcacaaggacccaaacttggcagtgcacctagaagagtttgtagcgtaccattggttataaacattgtacaacacaaacctaaactattacatttgtgaggggataggttgccatttcccttgcttgtttatgagcaaaaacttgagagctgcattatttttgccttcccagatagcactgaccctcagtaaatgtttgatgagctaaaagtgcctttagtgagtgggaaattaagcaaggcccttgattgtacatctattgctccaaacttcagaaaaaccaatcataacttttacagaacatctcctccctatgctgctttatttctttccatacatagctgaactcatcacctgagactcaacttccacccatcttgtcctataagttcagatttataagggcagggcaggcaaagaagcccttagactttgcttgttggtctctcctgtaaccctgaaataaccacgtttaccacgtttattcccaaagctcatattgagttcaaatcccctgttactcatttagagagacaagtggcattcatcatttttgcctctctgtgtcttcctctcccccagaacaatggcattacatgacgattaactccttttgatataaacaagtccaatggcagagtgttggatgactcagaaaacccaggcattgaaagatgcaaaatattttattgtgttcttgcattatgaagcattggggagtgttaagcatttttctttgatttttctctccctccctccctccctccctttctcctgccctcctcccctttctcctttccttcatcctttccttccttcctttccctccctttctcctgccctcctcccctttctcctttccttcatccttcccttcccttgcctcccctcctcttccctcccttcccttcccctcctttcctttccccttcccttcccttcccttcccttcccttcccttcccttcccttcccttctcttccctctcttccatcttttcatctatatctgccattttgcctaacacccatgtgctggagaagaaagaaaacaaggacttaaagagggaaaaaattcaaagaaagaaaaatgaaaggtagacagagcttatgcattttgaaggtgtgaaaattaggatttcagcctttttttttttctccccactaaaccagcaagcaggcaaataaagaaaccctgcagggattgacacaagatgagcaaagttttagaagattttcctcagaaaaaaaaccctcgcagatttacaagcagcatatctgttgtgaggatttcgaaggagatgaaaatatattgctagctatctagacatttgtcaaaacaactgaattctatgaattggaaaggatgaacgaaacaaccaatcctggggaaagaaattcaagatgggctctgttgtgttagaatttttctacaaagacagggaagttttagctgtgtgagataaagccttgcaccaaatgagaagccaacagaccttggaaaggggcgttcagtttcaccttgaagggcacttggctttgtcaattctggatatgtggtcaaacccccttatcctcatacctgtctcactccatccctaaatcagggacctgtctgatttagaaaaatagtgcctcccttttggatatggggagagggtcaggataccttaatttacagttcgccatgtctcttcacagaagggagaggtaattctccaaaaggaaaaaaggggtgctgttaccagaagaatgattcgatgctgggcaactaaaaccaacaaatgtcttctccacttggagaataagacttaatttcaatattgaatcctgttgatgtcacagttgcctggacctgacttcccaggccctgtttgttatgagtgcatttgtttccttggtgcatggcataccagtaggaatgggcacacctaatgctcagatcttggctctttttttgtttttttgaggtggagtttcactctgttgccaggctggagtgcagtggtgtgatctcggctcactgcaacctctgccttctggtttcaagtgattctcttgcctcagcctcccaaatagctgggactacaggtgcccaccaccatgcccagctaatttttgtatttttagtagagacggggtttcgccatgttggccaggatgatcttgatctcttgacctcgtgatctgcctgccttggcctcccaaagtgctggggttacaggtgtgacaaatcttggttcttaaataccattgtgcattaaaagttagccattggagaaatggctgattccagggctggggcaggaaaactacaaggtacacctaaatttttttttctcatcagaatgtatggagtggtaagaaaaaatgacaggggcatgtcgcaatgatataggagccagcttgaagggagtccaacttcaaaatcagggtcaaaatattcagattgggctttccaaatctgggataatctaagcatggaaattaataatgacagaaatggaaaacaacacatggaatccctgaatttatactgatattaaaaaaaagacaagggagagagaagggaatgagcttatttactgaagaatgtcaactaataaatgtagaaggaattagacttagaaactcaaactcttgttgggtgcagtggcttatgcctgtaatcccagtgctttgggaggctgaggcaggaggatcattggaggccaggagttcgagaccagcctgagcttgtctctacaaaaaatttaaaaaaaagaattagctgggcacgatggtgtgtacctatagtcccatgtccttgggggctgaggcaaaagaatctcttaagcccaggagtttgaggctgcagtgagctatgattatgccactgcaccccagcctgggtgacagagtaagatggaatatggaatattgctgggaagggtatggtaccagtcttgaaatatttccccacagataacttattatttcatagtaaggcaccttcagagtggagaaatatgtgggcaccatcttagctgagtaatcaagctgatcatcatatgcttcctcatacaatgcctgtacaatattcttgccaaaaatgtaaccacaaggagacaatccaataaactcaactggtgatacatgcaacaaaaaaagagaataatgggttaaagagtgatggatggagaccacactgaacaagacagggaactctctgaggatggtgactcctgagcagagaccagaatgatgggaaggagccaagtatgagaagatcttggtggaaggtgttctgggaagagggaatagcaagtgcaaaggccctggggcaggagtgaatgaggagtagaaagaccagtatggctagagcattgtggaagaaaaggagagtgatatgatgtgagattagagagcgaggtgagggcagatgttgtagggttttgaggccatatgaggaatttagttttgtttttggtgtatatagtagagattaatttttaaatggatacataatatttttacatatttatgggacacatgagatattttgttacatgtctcacatgtgtaatgaccaaatcagggtatttaggatatccattatcttgagcatttatcattcctttgttttgggaacatctcaaatcctctcttccagccattttgaagtatagaacacatcgttgttaactgcagtcaccctgccatgctgttgaactgcagtactgattttttccatctaactgtatgtctgtccccattaaccagcctctcttcattacccccacccacacactcttcccagccttcggtatctatcattctaccctctacctccatgagatcaacttttcagctcccagatatgagtaagaacatgtgatatttgtctttctgtgcctggcttatttcacttaacgtaatgacctccattttcacagtaggagttaaattttaacataccatactctgagtatgtatctgtgctgaataactatatttacccatttatatctacagctatatctagaaactacctcactaacactactcaattcagctgttggaagactttaaaatatttttggaacaacttgtgcgtatgaatttactctttcaatggtaaattttatgaaatctaactatatagtaagtatttccaatgaaaatttagcatctgtatggagatgtgttgcaaatgtaaaatgcacactagattttaagaaaagaatgtaactatctcaaaaataattttaaattcttgatactatgtcgaaataacgttttgaatacattgacttaaaatattataaattaatgctgtatgtatctttttgctttttaaaattacagctccattgagatattcacgtaacattgaaaatgtacaatttgatcatttttagtatattcaaagagttgtgtgattatctctgcaatcaattttagaacatttttatcatctcccaaaaaagccccatactcttctcagttctaattattctccaacccttccagccttaagcaaacactaatctttgtcttcttggatttgcctattctgaacacttcacagaaatggaatcatatactgtaatatttgtttttttacatttgtcttctctcacttagcataatgcgttcaaggttcatctctgttgtagcatatataggtactttattctttttgactgctgaataatgttctattatatgctacattttgttgatgaacatttggtttgttttctctttttggctctggggaataatcctgatgtaaacatgcatgtacaagttttagtgtggacatgtgttttgatttctcttgggtatatatctaggagtgggattgctgggtcctatagtttttgctatttaattaattaattaatttattaatttatttattttgagacgggtctcactctgtcgcccaggctggagtgcaatggcacaatctcaactcaatgcaacctccgcctcccgggtttaagtgattctcctgcctcagcctcccgagtagctgggattacaggtgtgcaccaccatgcctagctaatttttgtatttttagtagagacagggtttcaccatgttggccaggctgttctcgaacttctgacctcaagtgatccacctaccttggcctcccaaagtgctggaattacagacgagccactggccagcttttggttttttaaatgtggcaactagaaaatttgaaagtatatgtgtggcttgcattataattctattgcaaagtcccaatctaaccaaatcaaatttcctgagaggtccctgtcctgccaaggaacaaggaaaacagctaaacttgccaattagagatgtctcggtctcttaaagttttgagtggtcccattttaccctcccataaaacaatctttttttcaggtaaatattcagctggtttaaacattcaactctcttttggggctattccttccttttctgtcttgcttctacagatggtgcctaggttcaagggacagcttgggaggaagtctgtggttcacactttctccttggcatctttatttttattttattttatttattgattgattgagacaaggtctcgctgtgctgcccaggctggagtgcagtggcaaaacctcggctcatggcaacatccacctcccaggttcaagcaattctcgtgcctcaggctcctgagtagctgggactacaggtgtgcaccatcatgcctggctaattttagtatttttagtagagatagggtttcgctatgttggccaggctagtctcgaactcctgacctcaagtgatctacctgccttgacctcccagagtgctgggattacaggcatgaaccaccatgcccagccccctccttggcatctttaaaagtaaatcctgggcagtgtagcacttttgtcttgtttctgggtatctagcaggcttgcccatggagcagtggtagagggagcctccagaaggtgatgtctgtggcctctgcttaactcagcaggccccgctgccattcctcctcagctctgggtgcctgtctgttggtgcagggccccccagtgatttccccagctgagtctctgcctaaatgcctccctcagacctttccaaagtcacatggctccagcactatgccaagcatggagaattttcccggggaatcagaattttcttggaatatgcacctgggatgtgaggagcgaagtcttgcaatggtcattctccaacattatccagttatttctaccttccctggcttcctaccccaaagaaagaagagccaggaaatttcactagatttggcaagatgattgatgactttgattttaaaaataataagttatgtgctggtggttatctaggtctacacatctgtgcatacataataagtgtatgcttcaaatgggtgcattttattctgtataaattttatcccagcaaagttgatttaaagaaagagcaggttcaatttatatacattgtgctgggaagatatttatgatacagtgttaaaatatatttttgcatgaaagaagccagttgcagagcaatgagtagtaagataatacttttgtagttaaaacgtgaaaaaagaggaaaagctcctatatatattctgtgtttctcacgtaaacacaaagagattgtagaaaacaacacaaactgcttatctagaagaggactggctggagaataatggtgggcaggggaagggttaagtttgtctctgtatcttcctgtattgtttaactggtccttttttgtcgtgagacagtcttgctctgttacccaggctgcagtgcaccaccaccaccatgccaccatgccaccatgccaccacgccaccacgcccagctaatttttgtatttttagtagag
